United States Patent 9,486,487 (METHODS AND COMPOSITIONS RELATING TO MICROBIAL TREATMENT AND DIAGNOSIS OF DISORDERS) - sequence listing, part 3

SEQ ID NO: 6 - DNA, 2400314 bp, Bifidobacterium longum WBS-01
attcagcacgctgcccggcatggccttcaacagctcactggcatcatccggcaaagctgtggcgtcgatggtcggcttggtcggctcggatgattcggttttctgctggctgtttgggtggtagtggaggtgccatcattcttctggatggcccaacccggccacacaaaggcgcgaaagcactgccaggataatcacaacagctgcggcaaccaccacttgcaatcaacttgccatgggattgcgtggtcgaggagttctcactattagtcatgccccgattctctcacagccgcgtgacgctagcggccgtaattttatcgttgtgcgcaagccgcgtgaaactcttgtgaacggtaaatttaccgtccgctggtgtttgggttagggtgagaccatggcgaaatcaagtgtgcagtatgtatgttccgaatgcggttggaacgggccgaagtggtacggcgttgccccgagtgtggtcagtggggcacggtcgaggaatttcacgaggctcggccggcggcaggctctcgcacggccgctcccggccgaacatcagcacgcagtcggttacggttgccaacaacgccagatctgcagcccgtccgattaccgaagtgggcacggaaagcgtcgagcggctcggtaccgggttttccgaattcgaccgtgtgctcggcggtgcgtggtgccgggttcagtaacgctgatagcgggcgaaccgggtatcggcaagtcgacattgctgttgcagacggccggcaatatcgcgcgcgttgtggcgggagacagtacgttccgaggggcaggtcagcggtctgcccaacagtcgggccgggcgcagggcaacgcatcgaacacggtgccgatgcggggcaacgcatcatcaacacacgccaacaccgtgctgtacatttccggcgaggaatcacaggcgcaggttcgtttgcgcgcttcccgcatcaatgcggtggagccgaacttgttactggcctccaccaccgacctgtccacagtattggggctgatcgaacagaacaagccggccttggccattgtggattcggcgcagaccatcgtctcgcaggaggtcgatggcatttccggcggttcgactcaggtgcgcgaagtggcaagcgcgctgatagataccgctaagacacttgacattccagtatttctggttggtcatgtgaccaaggatggttcgattgcaggcccgcgcacattggagcatctggtcgatgtggtctgccaattcgaaggcgacagcgagactgcgctgagaatgctgcgagcggtgaagaatcgttttggcccgaccgatgaagtcggctgtttcgacatgagcggtgaaggcatcgaagaggtcaccgatcccgccggattgttcctgtctggagacggccctgatgcggccaacgcggcacccgtggaaggcacctgcgtgacgttcacattggatgggcatcgcagtctgcctatcgaagtacaggctctggtcaccacgtcggtgctgcccacaccccgtcgtgcggtcaatggcgtggaccccagccgtatcgccatgctggtcgcggtgctctaccgtcacagcaagctcaacctgctgtccaacgacctgtatatctccactattgccgggggccaggccaaggagcccggttccgacttggcgatagtggcggcactggcgagcgccgccacgtcaaaacccattgcgcgagccacgtgcgccattggtgagatttccctgaccggtcaggtgcgcccggtaccgcgtatggaatatcgccttcgcgaggccgcacgcctcggcttcaccacggcggtcattccgccactgcgcaagccggtgcatgtcgagggacttcagctggtggagtccaacacattgtccgacgcattagacgccttgggagtgcgtaaatagccctgagatatgcctcaggcggtaagacgcttggtctcctcgacgttgcgcttgagttcgtcgacgagttggtcggggccatcaaacttgacctgcgggcgcaggaagccgacgaattcgacgcgaaccttgtggtcgtacaggtcgatccattcttcagtgatgcagtaggcctccaccacacgttcgttgagccctgttttctcgctgaaggtgggtttggtgccaatggagatggcggcgggccaacggttttcaccatctaccagccaaccggcatagacgccgtcgaccggaatgtagcctgcaatgtcggagccaagattggcggtggggaatccgatggtgcggccacgctcctcaccgtgcaccacttcgccctcgatggagtgcggagcacccagaatggcgttggcgtcctggattcggccatgagccagcaggtagcgcacattggtggagctccatgcgcgcattgccttggcctggttcttcttgctccatgcgcggcgctcggccttggtggcattggccagcgggtcgacgggctctccccattcgctcggggcttccggcttgaaatcgcgcggaatacgcacttcacccgggccacggtcatcgaccacatcaagttcgaatacaccggtggcggcggcaagattggcgatatgcttcacatcaccttctcgacccttgcccatggcggcatcctgcccaaggaccaacgtgcgcatacccagcttgccggtgagtcggccaaggaagaaaatgtatgacatagctgcgaaggccagcgtgtagtgcaccaccagcacgtggtccacgccgaactgttccatgcggtgcagtcgatcatccacactggtcaaggcttcggcatccacgttctgcaccgcgggttcttcgccatggtgcgagatgacccagccgtgcacgaatgcggggcgcggatcaaacagaatcaccacggaaaaagcatcatgctggtgcgcgagttccaccacacgcttgatcaccgcctgatgacccaagtgcatgccatcaaatgcgcccaatgtcaccacggccttcttatcgttactgaacgagggccattcaatcgaaccttcggcgtcaggggtcaggtgcgtgatatccatcagtgtgctgttccttttatccgtgcgatgttattcatgcaatatagacgttgttgtgcgcggcctgtatcaagctgcacttttcaccgcgtctactttacgcgagggggaatacggtgaccggcttggcctgatgagcgtttgcacgctcgataatcgccgccacatcatgcgtttgcggcacaatggcggcagtgggctcgctgattgtacgctcaatacggcggccgaagcgtaattcgctggcctcctcaggagtgatgtcaagcgccggcatcgcacctcgagcggcctgttccatggtaagggcatggtcaagcagccagttgcggcgctcgtcaccggcaagaccttcaggagtgtccaatacgcacttgttgcgcgtgacggtttgcccttcccgattagtgaacgtcttctgatcggtatgtgcggtgacggtatgggttcgcgtgtcaagcatcgcctcaggagcgataagtccgctggcatcgtccggcaacgcgaatcggccgactcgcgtacggcgcaaacgggtcaggtatccgccgacgccaagttctttgccgagatcgcgggcgagcgcgcggatataggtgcccgatgaacagctgatccgcacgtcaacatcaagtgcgggaatcgctcccgtgttcgcgtcttcccgcaatggttcagcggcctgctcccctgctacgaatccgctgcggatatccagcacggtgaattcgctgatggtgaccgggcggggtttgagttccacatccttgccttcgcgagccaagtcgtaggcacgctggccgttgattttgatggcggagaacgtattggggacttgttcgatatcgccggtgaaattggtggcgatggtgcgtgtgagcaggtcttgccatgaggcagttggtaacgccgttggttcgccgctctggccaccctcagtcagctgcgctgatagcgtttgccagcgggagcgggcttcgtcatcgacaagcacctcgccttcggcatcgtcggtagtggtgcgcaggccgaggcgtatggtagcctcgtaggttttgtcatgcgccacgatggcgttgagcagtcgtgtggcgtggccgaaggcgatgaccagcgtgccagtggccatggggtcaagggtgccggcgtgaccgaccttcttgatgtgcaacgcgccgcgcacggcggcgacggcgtcgaaactggtcacgccttgcggcttgtcgatgatgagcagaccgctgggggttgtatgaagcacactactcctcgtcagagtcgtcttcgaagtcgtcgctgggctcgtcgtcatgcttgtacggatcggcgtcgccggcgtactgggcggtggcgcgagcacgggcgagttcttcgtcacgcttcttggccacggcgagaatgtcttcgatctcgtgagcctcgccgggcacttcatcgaacacgaattggagctgcggagtcagacgcaggccagccttgtggcccaccagagaacgcaggtggcccttggcctgatcgagtgcctgctgggcgcgcttgcgttcgccttcctcgtggccttcgtggccgagctgggtccagtagaccttggcgatctgcaaatcgttggtcacacgaacttcggtgacggtgatgctggcgagtcgcttgtcatgcagttcgcgctcaatggaggaggcgacgacacgctgaatcaaggccgcaatacgtgcggcgcgcgggttggttcctgccataggaatttccttttctagacttgagccccctctgacgaggggctgccgaacgcagtgaggctgggggagagaaaatcatggaactaccatgtctctccccagtcagtctgcggctgacagcccctcgtcagagggggcttaacaatgactacttgcgctcgacttcccgcatctcgaaggtctcgatgatgtcgccgagttcaatgtcgttgaaggtgccgaggttgataccagcctcgtagccttccttgacggactgaacgtcgtccttgaagcgacgcagcgaggagatctcgaggtcgttgaccgtggccacgccgttgcgcaggatacggcacttcgtaccacgcttgacctcgccgtcctgcaccataacgccggcgatgttgccgaacttggaggagcggaagatctcgcggatctcggagtgagaggtgacgacctcttcgtattccggcttgagcatgcccttgagggatgcctcgatgtcttcgatcgcacggtagatgaccgagtagtacttgatctccacgccctcgcgctcggcgaggtccgcgacctgacggttcggacgcacgttgaaaccgatgataacggccttgtcgaccgtggccaggttgacatcattctgggtgatcgcaccgacgccgcggtggatgacctggatgccgacctcgtcggatacctcgatcttcatcaaggaatcctcgagcgcctcgacagaaccggacgaatcgcccttgatgacaatattgagcatgtcgatctcggactcggcgaacttcttcttgaagtcctcgagggagacgaccttgcgacgcttggccagctgggcggcacgctcggtggcctgacgcttctcggcaatctggcgagcggcacgatcatcggaggcgaccaggaagaggtcaccggcggtgggcacggaggtcaagcccagcacctgaacaggtgtggacggaccggccgcttccatcggctgaccgttctcgtcgagcatggcacgcacgcggccgtacgaagtgccggccacgatggcatcgcccacgtggagcgtaccctgctgaaccagcacagtggccacggcaccacgacccttgtcgagtcgggcttcgacggtggcaccacgggcgtccatgtcggggttggcgcggaggtccagctcagcgtcagccgtgagcagcacggcttcgagcagcttgtcgacgtgcaggttctgcttggcggagatgtcgacgaacatggtgtcgccaccatactcttcagggaccaagccgaactcggtgagctggccgcggaccttctccgggttggcaccgggcacatcgatcttgttgacggccacgacgatcggcaccttggcggcctgagcgtggttgatggcctcaacggtctggggcatcacaccatcgtcggcggcgaccacgaggatcgcgacgtcagtgagctcggcaccacgggcacgcatggcggtgaacgcctcgtggccaggggtatcgaggaaggtgatcttgcgcggttcgccttcaaggttcacggtgacctggtaggcaccgatgcgctgggtaatgccgccggcctcacgtgcgatgacgttggtcttgcggatggtatccagcagtcgtgtcttaccgtggtcgacgtggcccatgacggtaacgaccggcgggcgaggcttgagatcctcgtcatcctgcagttcttcctcgtcaaggttgatgtcgaactgctggagcagttccttgtcttcctcttctgcggagacgagctggatgttccagccgatctcttcgcccagaatctggaaggtctcctcatccaaggactgggtggcggtagccatctgacccaggtggaagagcacggtgaccagcgcggcctggttgacgttgatcttctccgcaagatcggccagggacgcgccctgacgcagacggatggtctggccgttgccgttggggatgcgaacgccgccgatggtcggtgctttcagctcctcatactcatggcgctttgccagacggttcttacgggcctttgaagacttgccgccctgacgtccgaatgcgcctgcggcaccgccgcgaccgccgcgaccgccgccacgtgcgggaccgttgctcggtgcaccgccgccctggaagttattgccgccgccttggccccacggaagccgccgcgtgcgccgccctgaccggcaccctgggagccgccgccctgacccggacggttgtggccccactggccgggacgcggaccgccctgaccaccttggcccggacgaccgccacggaagccgcggccctgcccctggccttggccgggacggcccggacgaccgccacgaccgttatcagcagtcggacgagccatcggatgcggacgcggaatatcacccggcgtcggggtgtgcataccctgcttgcgggagaacgggttgttgcccgggcgcgggccctgagcgtgcgggcgcggaatcgcatttgaagcggcattgccgccattggcaccggcgccgccctgagcgtgcgggcgcggagccgaagcattgccgcggttgttctgatgctgaaccggctggccattgttcggacggccctggttgttacgacgatcgttgttacggcgatcgttcgggcgactctgacgaccgttctcacggccttcgcgattatcgcgaccattctcacggttgtcgttctgaccgtggcggccgggggtcggcatgccggggcgtgcgccgccctgcggacgcggtgtcggtgcacccggagtcggagcctgctgatgtgccgaggcaggcgatgcctgacgtgcgggagcggccggagtcggtgcggaagatgaagtggaagccggggccgaaggtgcggccgggcggcgctgctgcacgggcttggaatcgcccttggcgttgtccttggcgaactctgccttcagacgccgggctaccggcggttcaatcgtagaagaagcggacttgacgaattctcccatgtccttaagcttctcaagcacggttttgctatcgacattcaaaaccttagccagttcgtatacgcgtggtttcgccactaattactcctattctgtgaccacgcgcgtgcatgggcgtggtcagttggtgatgacggcaagcctaccctgtctcatcgtgcgaccatgatcgtgttacctcgtctctggtgtgggcgatttcgcgcacactgcgccagcccacatacgccaatcaagcatactcatagcgctggatagcgtagacgcagcgagccgcgccattgctgacgcggctcgtatcaggaaataatgcgccctgaagatcattcgccttcgagcccggcggcctattcggcttccggagcagcagcctcggccgcagcctgggcggccttttcggcggcgactttcttggcatgggcctcggcggattcgatgccgatcttccagccggtcagcttggctgccagtcgtgcgttctggccttccttgccgatggccaaggacagctggtcgtcgtggatgaaggcgatggcggtcttgttcttctcgctgatcacctgcacgccggtggccacagccggggacagcgcggctgccacgaacttggccggatcgtcggagtagtcgacgatgtcgatcttctccgggccaaggttctccataacggcacgcacgcgagcgccgccggggccgatcagcgcgcccttcgggttcacgccatcggtgttggccttgaccgcgatcttggtgcgggcgccggcctcacgagcgatggccatgatggacacggcaccggagaccagttccggcacttcgcgctcgaacagcttgcggaccagctccgggtgggagcgggacaccacgatttccgggcccttgatgccacgggccacgttcaccacgtacacgcggatgcgttcgccgtggcggtaacgttcgccgggcacctgctcacggcgaggcagaatggcttcgacatcgcccatcgcgacatgcacgttggaggggtcggaagcatcctgctggatgatgccggtgatgagcttgcccttctggccggagaacgcaccgaataccttctcatcttcggcgcggcggaacagctgggtgatgacctggcgtgcggtggctgcggcgagacggccgaagtcacgcggggtgtcatcgtattcctcgcccagcttgggaacggggtaagggttgtcttcggtgggttcgaccggaatttcgtcggcggcccacacggtgaagttgccggaacgttcgtcaagctccacgcgcgcgtgcttggcggcgtgcggggtcttgaggtaggcgaggcgcagggcctctgccagcgcatcatccagggtttcggggtcgattccttgctcggcggcgagcttgtgtattcctgtcaggtccagttccatcgatccgtacctcctatgaagttatgtggcgcatggcctatgagtagtcacagttagctattagtgtatgtttccatgcagacacgcttctcttcaggacggtttacccggcgcttggcatccgtactatgcgcgagcgcgatgctgtgttcgctttcggcgtgttcgatgccgcgactggccggacgggccgaggcggaagctcaaatgaccccttgcgagaaagcgatgacgttggcgaactacgccacccatccggctgaaggcacaccgttattagagcagtatgccaccggtctggccgccccctggcttggattgacgttgccgggtattgttcgggtcgttttgccgagggaacgttacgtgacgcgcagaccaagcaatggatggcttttctggccgataaattcgggcagtccgcgcctgaggtgacgccggcgcgtcttgatggcgtcacgtccgccaacgttgaccgatcggtattggatgcgatggccgtggccgaggatcgcgccggattcgctatcgaggtcttggccgcacgaggacagaccgctggggctacgttggcgttgagtgatatgcataagaccgccgggcagcagttggttgcgctggcgaacggcaattttgatgattccggcgcacaatccagttcttccggccaaagcgacccccgccaaaaggtctatgccatcgaccaactactggccaaccccaccaccatcgccgacaaggcaagtggccaaaccgtaccgaccgccgccgccatcgaaatggactgcgcccgcgcgcagatcaaggccgtgaccgaatcgaaatcttccaccgagagcgatatgctgctcatcctcgccgcactggccgccaagcacgcctacaccgcgttccaacttggctacccagcgactgacgccgaattgttcgagtagacacacactcctcacgaagccgatgcgaacttgttggatgctagtgggcaagtcgagttgaggcacgttccaccaatgtgaaatcggtggtgtacgtacgggccgggcctgagtatccttcgatgcggtcgataagcatgtcaacggcatgcttggcataatcatcgatatgaggatcgatggtggtcagcgccggcaccgagtactcggcttccggcacgttatcgaagccgaccacttgtacatcgtcaggtacatgcaaaccacatcgttgcaattcatgaattgcgcctaaagcaatggcatcattgagacacactacaacatccgggcatgggagcttgtctagcatagcttttgtcacgcgcataccttcacgctgattcatgctttctgccggaatcacataccgccaatttaccgataatccgcgctcttcaaatgccttcacatatccttgggcgcgtaacgcctgggtcccttccgtctgacgacgcagcactgcctcatccaccagttcaggaagaacacccatcagagcaaccgtttgggcaccttcatccaaaaatcttcctacaaccgtggagatggattcaatgttgggcatggtgatccaatcgcttttcccgtaggccagatggtctccggtcgttacaatcggatatggctgctccagaacggccccttcatccgcgagcggcgacattacgaacagaatccatccttccgtccctaaacgatagaactcgtcaacgctggcaaccaacccttcaccgtcggaaccatatgtgttgatgactacaccgtaatggcgttcttttgcgtattcaatgaccttgtcagtgaaaaaaggaacgaacggctgcgagaaatcgaagatgttgagtccaataagctttgtgccgccagatcgcattgcacgcgccgaaatattgacggtatatccaagcttacgcatcacctcttccacacggcgacgtgtatccggtctcatactgccagtgtcattcagcacattggaaaccgtcttgatggagacgttcgcctcacgcgccacgtccttgatagttacgcggtttcccattgttcgaatccatttctgcttattacatgacacaccttcaacagcgtcattatgttcttattatggtaagtcacagtcgggtcgagcatctcctcctcatatcggaatcatctacccctcaacctcagaattcagccaaggagctttcctccgttggaccccatgcaccattaggcaaatatccttctgacaatactgcaggacgatcgaacgtagaggttaaactttctggttgaagaaacgcacgcacgccatccgaacaagggactttctgaccgccggctttcaacctagctttttacatacccgtcttttctccttattcctttgttgggtatcgaattgttccagtcgatgtgaatgacggcattgtcttcctttgactggtatgccacattacattagtggcgaatccgaacctctctttctgcaatccgggcatgttgatgattgtttgggtattgcttggtggttgtacagggcacagcaaccataagagactgcgccctgtcatgcgccaccgtcactcgaatcacttcacgtgcacggcggtccaggagaccggcggcaaggtcacacgcacagtgccggtatcggcgtcggacgtgatggtggtgttggggtgcagaacgactcggttctggtcttccagcgtgttttttgccagcagatcatcctcgtgcagggtttgcgcctcgaccgcggaaagtgcgaatccttccggcagcttgatggcaaagtcattggccgcttccatggagcgattgaccacaaacacgctgatcgtaccgtcctcaccacgcacggctacggaattgatcgtcggcacttcaccgtatttgtcggtttcatacgttccggaagccagtttcggttcaagcaccgtgccgcccttggcgagctttgcggtcagcgagaacggatagaacgtggtctgacgccacgccgggccgcccggttcggtcataatcggcgcaattacgttgaccaactgggccaggctggcggcgtgcacgcggtcggcgttcttgagcagggtaatcatcaaatcaccgaacaccacggcgtcggcggcgctgtacacatcctcgagcaggcgcggggcaaccggccaattgccgatgccttccggattcttgctcggctcttcgttgagataccagacattccattcatcgaacgagatgaacacgtcgtgcttgctcttcagccgggccttggttgcatcgatggcggcggcgacatcgttgatgaaaccgtccatatcgacgcccgaggcaaggaagctcttcatgtcacgggtgccatcaggctgaagttccggatggtagtacgcatggcaggagacgaagttgacgttgtcaaacgtcttctcaagtacggtttcttcccacttgccgaaggtgtccatcacgtggctggatgaaccacagaccaccagttcaacgttcggatcgatggcgcgcatacctgccgccaccgaggccgccaaggtgccgtaatcctcggcggacttgtgaccggtctgccacgggccatccatctcattgcccaagcaccacatcttgatgccgaacggctgatcggcaccattggcgcgacgctcctcggagagcttggtgccgccgggaatattcgcgtattccaacaggtcgagggcctcttcaagaccacgggtacccagatttacggcttccatcagctcgttgccgccggttttttccagccatttcgccatttcgtgcagaccaaactgattggtctcggtggaatgccatgccaagtccaggcgacgcggccgctcatcacgaggaccaacgccatcctcccagcgatagccggaaacgaaattgccgccaggatagcgaatcgtggtagcgccgagttccttgaccagttcgatgacgtccttgcggaaaccgtcttcatcggcttcggggtggcccggctcatagatgccgtcgtatacgcagcgacccagatgctccacgaacgacccgaacagtctgtcgttgaccggagctacttcaaagtcattatcgacgacgagtcgagattcctccagctcccccggtttattgtcgtgcgaatgctcggacatgtgctctcctttaatcgttgtcttcaataccgcaagacaacgttgtgctaaataccaaaagcaatcggcccatcttcttggttcacctgttttgcggcatcgccaatcagcggtgaatgtgcgttctggatatttaatacaaccttgtacttctgttgatatcgataatacgatggttgtacttagtacgcaagtcccgctgagtacaacgttatccttttcgctattttccacccgacacgccgtatacgatacagcacaggagcgaatacggacgttcgtatcaaaaacaaaaagggttccgggacaaacccggaaccctaaaggcggataaggcgagattcgaactcgcggaggctttcacctcacacgctttcgaggcgtgctccttagaccgctcggacacttatccatgctgccaaaatggcaacttgttcattatgccacattctgccgacctggcaaatcggagtttcgctgagctcgattcggcgtgggataatgcgattttgtgtgagattgcaatgggtcagacgatgagccgattaacagtccgaattgatcaactaccaaaatccgaatgttgcaacgacgaaaatccgaatattggtggtggtagaagcggtgacggggccactctgcattgagtggtctctccctcggtcagccttacggctgacagctcgaacgcaattaaggacagctttccagctgccattttatttgctcactgtcgttcgccttcgcctaaaaacgcctccggcgttttcttcacggctcagctcatcagagggggcttggaattttatttatgccacctgttcgtggacggaggcgttgacccattgggactgctggacgttgtatccagagaagatgccgatgtcgagcatgcagtcgcggtaatcgcggccgtgggcgatggtgatgtagctgtcgtccaccaatcggttatgcgtgggatccagtccgacccatcggccatcctgatacacctcgacccaagcatgggtcgcgccctctccccaagcaaaccggcaatgtagcgcgcggtcaatcccacatgccggcacacggacagcatcacgtgcgcataatcctggcatacgcccttgcgctgagccaaggcctgttcggcggtggtgcgaatcgtggtggaaccgggcgtatacacaaacgccttgtagacctcatccatcacttcggcagcctgctgcaccggagtggcgtcggaaggcagcgccgccaagcgttcgcggcatacggcaatcatcgcctccacgttcgggccgggaatggtgagcgctgaattgaatcggtacagcggtttataggcttccttatggatatgcgcattgtccacgaaggcgataccggtcaccgagtagctgaatatgtcgtgcggctcagggatgaatccggtcatcaccacggagtcaaaggagtcgatggtggtttcgagttcggtttcgggctgaatcttcacttccacgtcaatcacctgttggcgagggccagtggagggaatacagcgaagctggaacctgtgatcggtgaccggtgcgctgaaggacagcctcatctcatagtcgaacacgagttttttcacaacgtctcctgcacttgcacacgagccggcaaccggcatattctcgggataacgacactacagccatggctgaggtatggtccgtgcgctcacagcccacgcatatattccggcaatctgctgatatgcacaggccggcactcgggcgcacggttttttcgccataccaccatagcatttgaacccgtcagggtgtcaggtcgggatcagggacgcttggcgtccatgttcatggagctcagtgagcccatgtctttgatggccagcgcgctgacacggccggagtagtcgtcaaggtacttcttcagcaggtcggcgacttcctgatatccgcgagacggcagctgaccgaccagccagctcagtccgtcggcgaagcagctgggcagcggcatgccgtccaaggtcatcgaataggcggcgagcttcttgagcggcgcttccagatcctccatcgtcaggccgaagcgcgtgtacaggtcgatgcgttccagatatttgccgatgaagatgaacgccttcagcgtggggtcgaccggcgaattctcgatgccgccccagaaagcgagcatgtcatcggtaatatcgcgctgcttgtagatgtcctcggcatcggccgcgtatttggcggcatcggtgatattggtcatcgccaactccacgtactgcagcagacgcgagctcaattccgggcgcagaatcacggcgttgttgaatgcggaagttacggccgaccgcaccgaatcaggattggacccgtcgtacaggaagctgttcacgaacccgtcgaagtcctcgaaatcttcgggcaggtcgagtgcgtgagcgaacggacggaaggcgtccacatcggtgtccatcacacgatcgtagaacgggaagaactggttcagcgtggtgaaggcgcgctcggtgtatcgacccagccaatacaggttgtctgccttggaagcggtaaccagcgacaacgaatggtggcgggactggctcagcaggttcgccacctgcgtttcggcaccgtactcgtgctccacgccggattcgggtgccaacacccacgtatccttaaatccgccaccctgcgacgagttgacaatcatctggccgggcaccgacgagtatcgagtcaagcccgaataccacacgtgcgtattcttgccggtgaccacgaaggcacgcaaatcgcacttgcgcggcgacatctcgccggtcttcgggtccaccacatcgatatcacggaactgaatcacctcttgggcaatgaatcgacgcggctcctccttgatccggttggcgagctcctcacgtgcggcggcatccagcgacgaaccaaacaccacgccgtaaccgccggcttcggccacatccttgatgaccagctcgcccatccgattcaggacttccttgcggtcggcctcgaacatcggcatgtacgtgggcgcgttgttgagaatcggttcctcgccgagatagtacttgatcatctgcggcacgaagtagtagatggccttgtcatcggccgcgccgttgcccggcgcgttgacgatggccacgttgcccgcgcggtaggcggacaggataccgggcacaccgatcaccgaatcaggattgaaggcgaacgggtcgaggaattcgtcggacaggcggcggtagaccacgcccacacggtggcgtttgccggcgtagtcgaggaagtagaccttgttgtccaccacttcgaggtcctcggggaaggccaacgccgcaccggttttctccgccagataggcgtgctcgaagaacgcggaattgtagcggccgggagtcagtaccacggcgatgccctcggtggagacaaagtccatggctttgcgcaacaggcgcgggtattcgcgattatcgcgaatacgaacgtcgcggaacaggcgcggggagatgcggcgctcgatgtcgcgcacgaacagcgggtagctggcacccgagggaatacgcaggttgtcttccagcacccaccatcgtccgtcctcgccttggaccaggtcctcgccggcgatgtgagcaaaaatgccgccgggaggggtcacgccgttgacctgcgggaagtagccggccgaggtgtatacgtattcctccggcaccacgccgtcatggatgatggccttgtcggagtagatgtccttcagataggcgttcagggcgttgacgcgctgcttcaagcccttctccaattcgtcgtattcgtcggattcgataatgcgcggcacagggtcgtacgggaacagccggtcatggtattcgccgttcttgtagatgccgaaacgcacaccgttgcgggacagctctcgattgatcgcttcgcgacggtttaccagttcatgggccagtctgcgtgctgcggattcgatcatcgtgcctgctccttgctgtggcggcttctgtggcttcaagcggttaggcgttttgagcgcacgctgacgccgcaagccgtaaccgggtttgatggtttcaacctaaggcggacccgtttcaacaaacgcgcgagaatgttacaggcaggtcacttcgccggccgcgtgcatcttgacgaccgcactcatctcgccgaccacacgcatcttgccgaccgcacgcatcttgacgaccgcactcgtctcgccgaccgcactcgttacaatgaatggctatgacacgactgcgcattgacttggcctacgacggcggcggattctatggctgggccaaacagcccaatcttcgtacggtgcaaggcaccattgaagatgcgctgcacaaggtgctgcgggtgccggccgatgacgcggccgaaccgttacgcttgacggtggctggacgcaccgacaccggtgtgcacgcctcccaccaagtggcgcatctggatgtatccgatgaggtactgaatcgctgcgtaggtcacatgaccattccggtcaccgaggcgctgactcgcagactcaaggctgtgctgccttcggacatcgtcattcatggcattgccgtagctccggtcggcttcgatgccaggttctccgcattggagcgcacttatgtgtatcgggtcgccgatcgttcgtctgaggtcgacccgcgcctgcgtggatgcgtacttaccgtggatgaagcgctggatctggagcttatgaaccgcgcagcctcattgaccatcggcctgcacgattttggttccttcgccactccgaatccgggaggcactacgatccgtgaagtcaagaccgcctattggcggcgggtgccgatcactcccctagtaccggatgagatggcatcgcatgaagcatatcggactccgtcgctggagtccggcctggtagtgttcacgattgtggcggacgcctttgcccgcaatatggtgcgctccctggtcggctcatgcatcaaagttggttcgggacgcaaatcactggagtggtttgccggcaaaatggccgagccagtacgtgaaggctcaagcgggccgattgcgccgcagggcctgactttggagcatatcgcatatcccgccgatgatcagctggccgcaagagccgaggccattcgggccgtacgtacgttgtagattctatgaaaacaacgcaaaagggctggaacccaaacggattccagccctttcagctagcttagcgaaacgctattcagctcactcggccttctcggcgtcagcggcttcctcagcgggagcctcagcctcagcggcggcggtctcctcgaccggagcctcaacagcctcagcagcctcagtggcctcagcctcaacggccggagcttcttcttcggcaaccttggcggcggcttcagcttccttcacaacagccttcttggcaaccggctcggtgacgagctcgattacagcggccggagcggcatcgccaacgcgcggagcgatcttgacgatacgggtgtagccaccttcacgctgctccatctgctcggcaatctgggtgaacaggatgtgcaccacggacttgttgcggatgacgcgcatcacgcgacggcgggagtgcagatcaccacgcttggcgaaggtgatcaggcgctctgccagcggacgaaggcgcttggccttcggcagcgtggtggtgatgcggccgttctggaacaggctggtcgccatgtttgccagcatgaggcgctcgtgtgcggggctggaagccagacgcgggcccttcttaggtgtaggcattgggtttactccttatatgtccgttcttcaggcaagcaggtgggcatatgcccgaacatctgcttgcctagtgaacgaacgattggtcaaagaggcagatcactcgtcttccggcgagaagaacgtgccaccttcgagattattggtatcgaaggccatcggcgaggacttgaggctcaggcccaaggtctgcagcttctccttgacctcatcgattgacttcataccgaaattgcggatgtcgagcaggtcctgctcggtgtgggagacaagctcaccgatggtgtggatgccctcgcgcttgaggcagttgtaagaacgctgcgtcaggttgaggtcctcaatcggaacggccatctcggggttggtctcctcggccaccggggccggaccgacctcgacgccttcagcctgggcgttgagctcacggcacaggccgaagagctccaccaaggtggaaccggcggaagccaccgcgtcacgcggggagatggcgggcttggtctccacgtccaggatgagcttgtcgaagtccgtgcgctgttccacacgggtggcctcgaccttgtagctcaccttgagtaccggggagtagatggaatcaaccggaatacggccgatctcatcgttgtcctgcttgttcatctgggcaggaacatagccacggccacgctcgacagtgaactcgatctcgagttcgccatcgtcggcgagggtagcgatgtgctgctccgggttggcaatggtgacgccggccggcggggtgatgtccccagccacggcttcgcccttgccgctcttgcgcagatacatgaccacaggctcgtcgtattcgctggtgagcacgatgcccttgatgttcagcaggatctcggtgacgtcttcctggacacccggcagagtggtgaactcatgcagggcaccggaaatacgcacggaggtcacggcagcacccgggatggagctcagcagcgtgcgacgcagcgagttgccgagcgtgtagccgaagccaggctcgagcggctcgatggtgaagcgggagcgctgcggattcagagattcctcggtaagagtcggacgctgtgcaataagcactgtggttatcctttcagcttgaactcggtggtgcactcaccggtcaggcggttttggatggatttggtattgctgagtgctcagacgcgacgacgcttcggaggacgaacgccgttgtgggcttgcggggtgacgtcggtgatggaaccaacctcgaggcccgcagactgcagggaacggatggcggtttcacgaccggaacccgggcccttgacgaacacgtcgaccttcttgacgccgtgttccatcgccttgcgggcggcggactcggcagccataccagcggcgtacggcgtggacttacgggagcccttgaagccgacatcgccaccggacgcccaggacaccacggcgccggacggatcggtgatcgaaatgatcgtgttgttgaaagtggacttgatgtgagcctggccgaccgggaccgacttgcggtcgcgacgacggggcttacgagcggcttgcttaggcgctgccattgaccctcgtttcctagtaacgaactttgttgttgacgttcgggcgatgggatgaaaatcatcccgtggcccgaatcatgccaccgactacttggtggccttcttctttccggcgaccgtgcgcttcgggcccttgcgggtacgagcattggtcttggtgcgctggccgcgcacaggaagtcccttacggtgacgctggccttggtagcagttgatctgaatcttgcgacgaatatctgcatcgacttcacgacgcaggtcaccctcgatcttgtagttggcttcgaggtagtcacgcagcgtaatcagctgctcgtcggtgagatccttgacgcggatgtccggactaataccggtcgcggcaagcgtttccttggcacgagtgcgacccacaccgaaaatgtaggtgagggcgatctcgatgcgcttctcattggggatgtcgactccggcaagacgtgccattgcgattccttcttgttgccgtaggtcttgcacccgctcgcccggttacccggcacgggcctacgtacccgtggttcagtgtcgttcccttgcgggaagcactgtgagagagtgccttatttacttagtgccgctggagaatctgctctcagccctgacgctgcttgtggcgcgggttgacgcagatcaccatgacgcggccgtgacggcggatcacgcggcagttttcgcagatcctcttcacgctagggctgaccttcatggttatccttttcttgtgtacctttacttgtaacggtacgtaatgcgtccgcggttcaggtcgtaagggctcatttcgagcacgacacgatcctgcggcagaatacgaatgtagttcttacgcattttgccggaaatcgtggcgagcacgatgtgcttgttttcgagttcaacgcggaacatcgcgttaggcagtgcttccacgacctgtccttcgacttcaatcacaccgtcttttgccatgtgcctctagtcctattccgttggatgattactatggcatatccgaagacacaccaactgtcaactatatacgcacatacccctgtacgaacactcggcgtgtcgcacaggggtatggaaacgttgatgtggtatttcggcatcactccggcttgttgcccgggctgccgaacctactactcgaggtggctgatgatacggccgctgatctcgtcgatgtcgccgacgccgttgaccacgacgagcaggccacgggcctcgtagatgtcgagcagcggagcggtttccttctcataggtctccaggcgcttggcgatggcctccggagtgtcgtcagcgcggccctgctcggcggcgcgcttcttcatacgctccagcagcacgtcgcgggcggcttcgagggccaccacgtggtcgagcggagtgtcaaggtcggcgagcatctcgtcgagagcgatgacctgggcggcgttacgcgggtagccgtcgaggatccagccgttcttgcagtcttccttggccagacgatccttgacgatcttgttggtcagggagtccggaaccagctcgcccttgtcggtgtagctcatcgcctcaaggccgagttcggtcttgttcttgatgttgtagcggaagatgtcgccggtggagatggtggggatgttgaagtgttcggcgagcagagcagcctgggtgcccttgcccacgccctgggggcccatgatgagcagacgcatggtggtctccttttatgtcggttattaatacggttttggctcccttggttaagggagccattgagttatatgcggaagaaagattgctccgtcgtggaacagtccactggactgttccactcctcgcgcggccgcctgcccattgcgggcggccgctgtcaagcgggcgtcagccctctttgtggtccacgttttcgaacaggaagccggtgtactggaactgttcggtctgggccttggcctggcgcagggtgtcgaggcccacgcccgcgataatcaggatcgtggtgccaccgaacggcagcttggcgttgaggccgagggccatgatcagcacggtcgggatcagggccacgaacagcaggtagacggcgccgacggtgttgagtcggttcatcacgtaggtcaggtagcggctggtggcgttgccggcgcggatgccggggatgaagccgccgtactgcttcatgttgtccgcggtctcgtccgggttgaacgtgatcgaggtgtagaagaagcagaagaacacgatcatcagcgcgtacagggcgatgtaccacacggatgtggtgttcgccaggttggcgttgatccacttgacccacgactggtcggacttgccgaactgggcgatcagggtcgggatggcgaggatcgaggaggcgaagatcggcgggatgacgccggacatgttgatcttcagcggcaagtaggtggaggagccgccgtacatcttacggccgatcatgcggcgcgtgtactggaccggcacgcggcgctggcacagttcgacgaagtcgacgaagatgaggatgaccacgagcacgcccacgacgatgccgaacttcagccagtcgccatcggtgccgtcggtgccgtagccgatctcccacagctgcggcaggaagccggagcagatggacatgaagatcaagatggacatgccctggccgatgcccttgtcggtcacgagctcggccatccacatgatcaggccggtgccgccggtcatgatgaggaccatgaccacgaggttgaacacggaaccgtccgggatgacctggtcgcactggtaattgaacagggcgccggagcgggcggtgaccaggatggtggtggactggagcacggccaggccgatggtcaggtaacgggtgtactgggtgagcttggcctcgccggactggccctccttgtgcagggcctcgaagcgggggatgaccacgcgcagcagctgcaccacgatggacgcggtgatgtacggcatgacgcccagcgcgaagatagacagctggagcatggcgccacccgagaagaggttcaccagtccgatgaagttctcctgggaggcgctgccgatggtggccatgcacttgttcaccacgttgtagtccacgccaggggtcggaatgaacgaaccgatgcggtagacgatgatgatgaacaggacgaagagaatcttcttcctcaactctttggttttcagggcctggattagtgtcctcacctagatttcctcccaatagcgcgccaatcgcgcgaaatacacaaactaacgaacgagcatagtctaaagtgcctacttcggccacttcatgtctcgcgaatgttacctgaattatgctccgtcgtactgaacgggggaagcatactcaaaacgatcattgtgttgagactgcttctctgcactcagaacaacaattttttagaaaagggaacccccgtccacctattggcgggcgggggttgtacagcctattgcgctccccgtaggactaatcagtcctcggaaacggaaccgccggcggcctcgatcttggacttggcggaagccgaagccttaacacccttgagggtgaaagccacggtggtctcgccgtcgcccagaaccttcaccggagcgttgtcacgaacagcgcccttggcgatcaggtcggccacagcaacctcgccgccctcggggaagagctccacgagacgagcgatgttgatgacctggaactcgaccttgaacgggttcttgaagccacggagcttcggcaggcgcatgtacagcggcagctggccgccttcaaagcccggacgcacgtggttgcgcttcgtctggcccttggcgccacgaccggaggtcttacccttggagccttcaccgcggcccacacgggtgcggtccttcttggcacccggggcgggcttcaggtcgtgcatctgcaggatttcgttatctgccataatcagtcaacctcctcaacggtgaccaggtgacgcacggcgttcaccagaccacggttggccggggtgtcctcgcggacaacggtcttaccgatcttgttgaggccgagggtcttgacggtggcgcgctgagccggggtacggttcacgatgccgtggtgcagggtaatcttcaggttcttagccatgagtatcactcaccatccttctcttcggcggccttagcggcagcagcctcttcgcgagccttgcgagcctcggcaatgccggcggcgcgggcgcgcagcagagcatcgggagcgacctcgtcgagcgccaggccacgacgggcggcgatctcctcgggctcttcgagctgcttgagggcgtcgacggtagcgcgcaccacgttaacggcggtggcggagcccatcgacttggtcaggacgtcggtgatgcctgcgcattccatgacggcgcgcacggagccaccggcgattacaccggtacccggggcggccggacgcagcaggacggtgccagcagcgtcgtgaccctgaaccgggtgggtgatggtgccgcggacgcgaggcacagagaacatgtgcttcttggcgtccagctggcccttggcgatggcggccgggacttcacgggacttgccgtagccgacacccacggtgccgttgccgtcgccgaccacaaccagtgcggcgaagctgaaggtacggccacccttgtgggtcttggacacacggttgatggtcaccacgcgatcgagcagctcgtcgccgtggttttcttcacgacggttacgacgctcgccacgacggccttcaccgcgctggccacgacgacccttgcggtcctcgttgttggattcggtcgccacagtgttctgagtttcttcagccacttgggtttccttcgtttcgttgtcgctcacagtgcaagacctccctcgcgggcgccatcagcaacggctgcgacgcgaccggtgtacttgttgccaccgcggtcgaacacgactgcggtgatgccggcagccttggccttctcggcgatcagctcgccgaccttcttggcggcctcagtcttggtgccttcgaagccggcgaagtcggcctgaagagtggaggcggacaccagggtaatgcccttggtatcgtcgaccacctgagcaaccatgtgacggttggagcgggtgaccaccaggcgcggacgctcggggtaccggagatgcgcttgcggatacgcgcgtgacggcgcttgagagctaccttcttgccttttccgagaatagcaacgctcatatcacttaccagcctttccagccttgcgcaggatgcgttcatcggagtacttgatgcccttgcccttgtagggttccggagcgcgcagcttgcggatgttggcggcaacctggcccacgacctgcttgtcggtgccttcgacaaccacgtggttggcgtcggtcaccttcagggtgatgccttcgggcgggttgacggtgatggtgtgggagtagccgaggaagaactcgatgccctggcccttggcgacggcgcggtaaccggtgccgacgatctcaagagtcttggagtagccatcgtgaacacccttgaccatgccggccatgatggaacgagccagaccgtgcttggcacgggtcggacgcaggtcatcagcggcggtcaggacaatctcgttgccttcaacggcagcggtgatgccttccggaaccacgtaggagtcagaacccttagcgcccttggcggagaagttctggccttcaatcttgacttcaacgccagcagggatggcgatggggagcttaccaatatgcgatgccatgtttcagctctcctttctcaccacacgaaggcgacaatttcgccgccaatgcctcggtcgaggcattccttctgagtcagcagtcccgaagaagtcgagatgatggcgatacccaggccaccgagcggcatcggcagggagtcggacttcgcgtaacgacgaaggcccggcttggagatgcgcttgataccctgaatggaacgctcaccgttcggaccgtacttgagggtgacctcaagagtctggccgaccttggcttccttagcggtgaagtccttgatgtagccttcacgcttcaggatctcggcgatgttcgccttgaacttggagtacggcatatccacggtttcgtgcttggccgcgctcgcattacgcagacgcgtaagcatgtctgcgatcggatctgtcattgtcatttgggcttgttgccctttctcgctatggtttccgccgccctcacgcttcttctagaagcgttcgggccgcggaccttcagcgtcgatgtttaccaactggacttcgtaacgccgggcagttcaccgcggtgagccttctcacgaaggcagatgcggcacaggccgaacttgcggtagacggagtggggacgaccgcagacctggcagcgcgtgtaagcgcggaccttgaacttcggcttgccggccgccttgttcttaagagcggtttttgccatatcagttctccttgaaggggaagccgaggtgcttcagcagcgcgtaagcttccttgtcgtccttggtggaggtcaccacagtgatgtccataccgcgcacgtgatcgatcgaatcaggatcgatctcgtggaacatggactgctcggtgagaccaaagttgtagttgccctggccatcgaactggtggccgttgatgccgcggaagtcgcggatacggggcagcgcgagggtcagcagacggtccaggaactcccacatgcggtcgccacgcagggtgacgtacgcaccgatggcctggccttcacgcagatggaactgcgcgacggacttcttggccttggtgatcttcggcttctggccggtgatcagggtgaggtccttgacggcaccttcgatgagcttggagtcgcgggcagcggcaccaacacccatggagacgacgaccttctggacacgggcaacctgcatcgggttggagtacttgaactccttctcgagctcaggaatgatctgctcgttgtacttgaccttcaagcgcggggtggccggcgcttcgacagtagtatcggtcatgccagctcctttccggacttcttggcgacgcgcacgcgcacggtcttcaccttgccgtcacgcgcctcttccttaacggtgatgccaacgcgggtcggctgcttggtctccgggtcgatgaccatcacgttggagcgatggatcggagcctcagtggagacgatgccagcctgctggccctgctgcgttgcacgcacgtgcttcttgacgatctgcacgccttcaacgatcagtcgatcgttggagagcacctgcttgacggtgccttccttgccgcggtccttgccgcggatgaccttgaccaggtcgccgctcttgatcttggctgccatgtcagatcacctccggggcgagggacacgatcttcatgaacttgtgctcacgcagttcacgaccgaccggtccgaagatacgagtgcccttcggttcacggccggagccgagaatgacggcggcgttctcgtcgaacttgatgtaggaaccatccgcacggcgggattccttgacggtacggacgacaacggccttaaccacgtcgcccttcttgaccgacccgccaggaatggcgtccttgacggaggcgacgatcacgtcgccgatgccggcatagcgtcgcttcgatccgccgagcacgcggatggcgaggagttccttcgcacccgtgttgtcggcgacatgaagccgcgtttcctgctgaatcattgattctccttagccgagctggttctccccatttaccggggcatcgtggttgcccataatgccccggtaaatggcgagccttgccgaactttacttacttggcgcgctcgataatggattcgagacgccagcgcttggtcttgctcagaggccgagtttccataatactcacgaggtcgccaatgtgggcgtcgttgtgttcatcatgggccttgaccttgctggtggaacgaacgaccttgccgtacagcgggtgggtcgaacgctgctcgagctcgacggtaatcgtcttgtccatcttgtcggacacgacgtagccgcggcgaaccttacggaagttacgctcttcagccataatcacttctccttggattcggtagcggccggctcctggctgatgccaagctcacgctcgcgaagcacggtgtacatgcgggcgatgtcgctcttgacagccttgagacgggcggtgttctcgagctgaccggtggcgtgctggaagcgcaggttgaacagctcttccttggacttcttcaagaagccttcgatttccgcgttggtcttctcgttgagattcttgatggagtaatcagcggtaccgactgccatcagatatcaccaccttcacgtgcgataatgcggcacttcatcgggagcttgtcgatagcgcggcggagggcttccttagcgatgtcctcggacacaccaccgatttcgaacatcacgcgaccagggcgcacgttcgcaatccagaactccggggcacccttaccggaacccattcgggcaccgagcgggtgcttggtcagcggacgatccgggaagatcgtgatccacacgcggccaccacgcttgatgtagcgggtcatggcgatacgcgcggcttcgatctgacggttggtcacgtaggccggggcgagggactggatggcgaaatcaccgaagttgatctcgttgccgcccttggacatgccagaacgcacagggcggtgctgcttgcggtacttagtcctcttggggataagcattcttgctcactccttcgtttctgcagccggagcggcctcggcgggagcctcagccttgggggcttcggcggcctgcggggcggcggaacggttgccacggcgcgggcggcgatcgccaccacgacggcccggacggttgttctgctgagcctgctgctcttcgaactcggattcggtcatgtcgcccttgtagatccagaccttgacgccgatacggccgtacgtggtcttggcctcgaagaagccgtaatcgatgagggcgcggagggtctgcagcggaacgcggccctcacggtagaactcggaacggctcatttccgcaccgccgaggcggccggagagcttgatgcggatacccttggcaccggcgcgcatggcgtcctgctgggccttacgcatggcacgacggaaggtgacgcggttggtcagctgctcagcgatgccctgagcgacgagctgggcgtccagcgcggcgttcttgacttcgaagatgttgagctggacctgcttgccggtcagcttctcgagcttggcgcggacgcgctcagcctcggcgccacgacgaccgatcacgatgcccggacgggcggtgtgaatgtcgacgcgaacgcggtcgcgggtgcgctcgatgacgatgcgggacacgccagcgcgctcgaggtccttgctcatctccttgcggatctgatcatcctcaagcacgaagtcgcggtagcgttcgccggccttgttggagtcggagaaccacttggagcggtggttctcagtgatgcccagacggtagccaaacggattgatcttctgacccatctttagcgggctccttccttgttagccacgacgaccgtgatgtgggaggtgcgcttgttgatgcgagcagcgcggccctgggcacgagcgcggaagcgcttgagggtcacaccttcgtcaacgtaggtctccttgatgtacaggtcgttctcgcggaacggctcgccggccttgtcggccttcacacgagcgttggcgatggcgctctccagggtcttgcggaccggcagggccgcagcctgaggggcgaacttcaaaatggtgacggcttcggtcgccttcttgccgcggatgaggtcgaccatgcggcgagccttgcgcggcgtcacgcggacgtgacgagcgattgctttagcttccatgttctattccttatccttagcgacgggccttcttgtcgtccttcacgtgacccttgaaggtcttcgtgggggcgaactcacccagcttgtgaccaaccatggcctcggtgacgaacaccgggacatgcttgcgaccatcatgaacggcgaaggtgtgtccgatgaaatcaggggtgatcatcgaacgacgggaccacgtcttgatgacgttcttggtgcccttctcgttctgctcgtcgactttcttctgcaagtgggcgtcgacgaaggggcccttcttgatgctacgagtcatcttctcgatactcccttacttgcggttcttgccggacggacggcgacgaacaatcatcttgttcgaagccttcttcggacgacgagtacgcacctcgcccttgccccacggggagaccggcggcttaccaccgcgggtacgaccgccgtgcgggtggtcgaccgggttcatggactcaccacgggtgatcggacggcggccgatccagcgggcgcggccagccttgccgagctgaatgttggcgtggtcctcgttgccgacctcgccgacggtagcgcggcagcgcgcgtcgacgttgcggatttcgccggacggcatacgcagctgagcgtaggcgccatccttggcgacgagctgaacggcagcaccagcggaacgagcgatcttagcgccgcccagcgggcggagctcgatggcatgaaccacggtaccggtcgggatgttcttcagcggcaggttgttgcccggcttgatatcagcctgagcaccggtctcgatgacgtcgccctgcttgatgcccttcggcgcgatgatgtagcgcttctcgccatctgcgaagtgcaggagggcgatacgggcggagcggttcggatcgtactcgatctcggcaaccttggcgggcacgccgtccttgtcccaacgcttgaaatcgatgagacggtactgacgcttgtggccgccgccgcgatgacgggaggtgatacggccgtaagagttacgaccgccggtcttggacttcttgcgaaccagcgacttctcaggcgtagaacgagtcagctcggagaaatccgagacggacgcgttgcggcggcctgcggtcgtcggcttataaacgcggatagccataatgtagttcttcctttaacttttctcggctaaccttcagttaccaaagatgtcgatcgtctggccctcggcgacggtcacgatcgcacgcttctgggaagcgcgctggccgaaaccggtgcgagtgcgctgcttcttgccagcgcggttgagggtgttgacgttcgtcaccttgaccttgaagatctcttcgattgcctgcttgatctgcaccttgttcgcatccggagccaccacgaaggtgtactggccacggtcggaagcggcgtagctcttctcggagacgacgggcttaagaatcacgtcgtgagcgggcttgtgaatagcgaccatctaaatcaggcctccttcggctcggtcttggcagccacgaaagcctcgaaggcttccttggtgaagaccacgtactgcgaggtaatcacgtcgtacgtgttgagctgatcgacgaaaatcgggtgaacggtcgggatgttgcgcacggagagccactcgttgatgttgtcgcgagtgaagacgaccgtggtgaacttgtccgcggtaatcggggccagagcggcgacagcggccttggtggacggctcggtgataccgaactccaccacggcaacgcgaccggcgttggcgcgatcggacagggcgtagcgcagagctgcggccttcatcttcttgggggtgcgctgagagtagtcacgcggctgcgggccgaacacggtgccgccgtggtaccactgcggtgcacggatggagccctgacgagcacgaccggtgcccttctgcttccacggcttcttgccgccgccggaaaccatgccacgagtcttggtggcgtgggtgccctgacgagcagcagcgagctgagcggtgacaacctggtggatcagcgggatgtgagcctggacatcctcggcggaaacgccgaagagagcctcaggagcttcaacggtgccggtggcctggcccttggcgtcggtgacgttcagagtaacgtttgccatggtttatcaggctcccttcacagccgagcggacgagaacgatgccgcccttggggccaggaatggcgcccttgatggcgaggatgccgttctcgacatcagcggagacgacggtcaggttctgggtagtggcggtcacatgacccatgcggccggccatacgcttgcccttgagaatacggctcggagtggcgcatgcgcccacagaaccgggacggcgctcgttcttgtgagaaccgtgagtacggcggtaggacttgaagccccaacgcttgatggtaccggcgaagcccttacccttggtggtgccggtcacgtcgacctcagcaccctcttcgaacaggtcagcggccagttcctggccggcctcgaactgatcgacgtcgtcggtgcgcacctcgacgaggtggcgacgcggggtgacaccggccttggcaaagtggccagccagcggcttggtcaccttggtgggatcgatggcgccgtagccgagctggacagccttgtagccgtcagattcctcggtcttcacggcggtcaccacgttggtggacacgtcgacaagagtgacgggcacgaagaagccgttctcgtcccacacctgggacatgccgagcttcttgcccagcagagccttgcgattagacataatgcttcctcctcccttacagcttgatttcgatgttgacgtccgcaggcagatcgatgtgcatcagggagtccacggccttgggggtcgggtccacgatgtcgatgaggcgcttgtgagtgcgcatctcgaagtgctcgcgagaatccttgtacttgtgaggagaacggataacacagaagacgttcttctcggtcggcagcggaacggggccaacaacagttgcgcccgcgttcgtcaccgtttcgacgatcttcttcgccgattggtcgatgacctcgtggtcataggacttaagcctgatgcggattttctgtcccgccattgccgtccgccctttctagcgatgttcgttgtactgtttaccaacctgcttctagggcaccggcgcgcatggcctcccttggacatacgtcctctggcggtcatccgacatcagtgcgcggtttccggctgtcacttcacttgaagtggctcccggcccgcgctcgcttttttaattccaatttgcgagcccaaatcaggcaacttgtttattcaagcattgaggtgggacagtggagttcgcgcgtgtcgcgctcatgccgttcgtattacctcgcggcatagccgctcggcgtctgttcgattgtcgcaatgcaggtctcacatctttcttattgagaaccattcgctgcgatatcatgacagatatgacttcccgccgcaagactcttaaacgcgattggttcgacaaccaacctggcgcatgggtaatggttatgctgcccgttgtggctggcttctttatcggcgggcctaatcttgatacgctttggctattggcgacgtgggccgtgtgctattgcgtgcagttcagcgccgcgcactggttcaaagcacacttttcacgccgttatctgccgccgatgctcacttatgccgtagcgctcatcgtcatcggcttgccattcctgattacgcataccggcatactgcgttgggctcccttatatatagtgctggttgcgctgtcgatgctgtcctcgtggctgaggaaggagcgctcgctgtggggcaatgccgtgtcggtgattgccgcgtcggccatggccacggtgatcgcgtcgtttggcagcactgttgagacggcatgtgttatgcccatcaacgcagcacatgcctcgtgcgcagccgctgatgtcaccgccgcacgcgccgcgattcggaatatgccagatttgagccagatattcgaccttcacgcctggtggcccgcgggttcattgcccgtgagcgggctgattgccaccgtgctgtttgcgctgacgcagtatgggtcggttttagtggtcaaaaccatgatccgggaacgcgggaagcgttcgtacgtggcggcttcgtgggtatggcatgtggcgctattgctgctagccgccgtgccggctggacgcagcccgtatctgattgcgatgactgtgctgctgttggcccgcgccgttgcgttgccggtggttacacggcgcacaaccttgaagcccgtggtgaccggcattaccgaggcgtttgccagctttattgcttttggctgcataattgcggcgatttagcgacgcttcagcgattccatggggaggtaattacctcatggggcggtaattggcccatggggcggacggtaaaattttaccttccgcagaatagagccgttttcgtacaccgccccatgggggttttcaccgccccatgggcaagttaccgccccatgagtgggttaccaccccatggaggtgtacctgctggctgagggagcaccacatatgcaaaggagcccggcccctgtaatggggtcgggctccttgtgtcgcgctatgcagccactaagctgcaacaccgcggttggtggctactgatggtgccaccaaccacaaaccgcctgcaatcaacgctcggaggcttcctcagtggcggcctcaccctcgcgctcgatgcgcagcttgtggccttccgcctgggagacaccgtagtaagcaccgacggcgatgtccttcatgtcgttgatcagcgggatgcgcgggttggccggggtacactggtcctcgtaggcgcgcatgccgatctgatcgagcacggaccagaagtagtcctcgtccacaccgcaatcctggaagctcttgttcatgccgagcttgttgtcacggtagtcctcgacggccttcgccaggttctccacggcttcggccggggtcttgccggtgtcgatgccgaggttgcgggcgatgtcctggtagcgctccggggcgatgtacttgttgtacttcggccaagaggtgggctcctcaggaatctggccgttgtagcgaatcacgtacggcagcaggatggagttggtacggccgtgggcgatgtggcacagggcaccgatggtgtgggccatgccgtggcacatgccgaggaacgcggagccgaatgccatgccggccatggtggcggcgttgtgcatcttctcctgagcgttggtcttggccaggccgggctcgccattgacggactcagccaggttgtcccagatgagcttggccgcgtgcagggccatgccgtcggtgaagtcgttcgcgtacacggacacgtaggcttccatcgagtgggtcagggcgtcgaagccggcgtcggaggccagcttgcgcggctgggtgcgagccagcaccgggtccacgatggccacggacggggtcagcgcgtagtcggtgatcgggtacttgtagccggtcttgtgatcggtgatcacggcgaacggggtgacctcggaaccggtgccggaggaggtcgggatgcacaccagcttggccttcttgcccagcggcgggatcttgaaggcgcgcttacggatatcgaagaacttctcgcgcacgtcggagaaggcgatttccgggtgctcgtagagcagccacataatcttggaggcatccatcggggagccgccgccaaccgcgatgatcgtgtccggctcgaactcctcgcgcatcatctcagcgcccttttcgacggtctcgacggagggctccggctcgacgtagtcgatgatgcggaaggtcacacggttggagcgggcgcgcagctggtcgatgatcttgtcaacaatgccgagctgctccatgaccttatcgcacacgatgacggccttctcgatgccgtacatgtcgcgcaggtacttgatggcgttcggctcgaagtaggtcttggccgggatcttgaaccactgcatgttgttgttcctccgagcaatgcgcttgatgttaacgagattcacggcctgcacgttgccggacaccgagttgccgccgtaggagccgcagcccagggtcagcgacggggcgatggcgttgtagatgtcgccgatgccgccaagggaggaaggctggttccagatgatgcggcaggcgtgcatacggacgccgtactcacgcacgagctcctggttgttggtgtggatggcggcggtgtggccggcacccagcttgagcatcttctcgcacatctcgaaggcctgctccttgttgtcggccttgagcacggcctgcaccggagcgagcttctcgtgggtcagaggctcgtcgtcggagacttccttgcactcggcggccagaatggtggcgtcggacggaatctcgaagccagcagccttggcgatgaactgcggggacttgcctggcaccgcggagttcagcacgggcttgacgccggaaccggcagtgcagccgaacatgtactgttccagcttggccttctcttcggcgttgacgaagtaggccttacggaccttgagctccttgatgagctggtcgtagacgtccttgtgggcgatgatggcctgctcggtggcgcagatcatgccgtaatcgaagtgcttggagagcaccagatcgttggcggcgcgcacgatgtcaacatcggtgtcaacgtaggccggggcgttgccggcacccacgccgagggcgggcttgccggaggagtaagcggccttgaccatgcccggaccaccggtggcgaggatcgtggccacgcccggatgcttcatcagggcgcctgtggcctggatggacgggtgctcgatccactggatacagttctcgggagcaccggcttcgatggcggcgtcgcgcacaatcttggcggcctcgacggagcacttctgcgcgccggggtggaagccgaagacgatcgggcaacgggtcttcagggcgatgagggacttgaagatggcggtggaggtcgggttggtgaccggggtgacgccggcgaccacgccgacgggctcggcgacctcatcgatgcccatcacatcgtcttcgcggatgatgccgacggtcttctggccggccaagtagttggtgacgtgctcgcaggcgaagatgttcttggtggccttgtcttccacgagaccacggccggtctcgtcgacagccatcttggcgagaacgaggtgcttgttcagagcggcgatggaggccttggcgacgatacgatcaacttgcttctggtcgaggttctcgaattcgacgagagccttcttggcgcgggcaaccagcgcgtcaacttcggcctcagctgcggcctgcttctcttctggagtcggcttggtagcttcgaccttcttctttgcttctgccacttggggtcctcctcgatcttcttggggtatatggcaaagttctgggccatcgcctcgtcacctcagttgcaccagcgggataccgcctcagtaaccgaaaatgaccggtgatgcgttgtcacattgcatatgtgacctgaggcacaatatactgaacggtccggcgcgatgcatacgcacaaaatcgacggcgtttcacgtgcgatattgaacagtttttgttacgagttgtgcgaaatatcgaacaaatcctcactctatccggcgatttggtactttttgttcactttttaccgaaaatcacatgcctgcaaacaacacaatccgagaacttttttaaagtaagttttcaaaagcaatcattttctccacatttctagaaagttggtttaaaaaagtacccaaaatcgcctacaaatatacgattgttgcctcataacctccgcgtcgaggcacatgaaagccactttcataaagtaaacttgcatatatctcatcgcacaaaggggtaaacatgagggcaatgccatcgaccgcagtgaaagcgcacaaccgcagtgccatggcccagtatctgtatggccatagccatgtcaccaagcaggaactggaacgcgaactcggcctcagcctgcccaccatcacccaaaatctgcacgcactagaagatgacggactcatccgcaaaggcgaactgcaggattccaccggcgggcgcaaggcgcaaaattatgagttcaatcccgatcatcgcactgccatcggggtagtgatgcggtccaacgaactgcgcctgtgcgcgattaacctgtacggcaacgtcatcgaaaaacgcaacgatgccctgccttaccgcaacaccaacgtttactaccagcgtatcggcggcatcatcaacaacttcgccgccgacgtcgaaaagaagcacggcaaggtgctcggcgtctcgttcgccatccaaggcatcctctcccccgacgccaccaccatcatcttcggcaccattatgggcaacactgggctcacgctcgaaaccatcagccaatcggtccattacccgtgcatgatgatccacgattccgatgcctcagccatggccgaactctggttcgactccacgctcaccgatgcggtgtgcgtctatctggagcgacgcccgggcggcgcggtgatcgcggggggcaaactgtatcaaggcccgaaccagtgcaacggcgccatcgaacacatgacgctggtgccgggcggccgcgaatgctactgcggccagcgcggttgcatggacacctactgctcgccggagaccttgcccgaggattacgaaagcattcccggcttcttcagcgtgcttgagcagggcgaacggcatcatcgcgagcgcatggatgagtggctggattacgtggcgcaggccatcgtcaacgcgcgatccatcatcgcgggcgacgtgattgtcggcggtgaagcagcccagcatcttgaagacagcgacatcgaggatctgaagacgcgcgtcatcgcacgcagcccgttcggcaccgaccatttcaatctgcgcaagagctactgcgccgaagatcagaacatcatcggtgccgcgttgcggttcgccgagaattatctcgacggcatctgcggtgctgcggaacgcggcaggaaatcaagggcttccaccaaaagtgacaacacgtctacaatggaggtatgaaaaacccaccgttgcatcgttacgccactcgcccagggctgtacttcactgacgacggtggggctgacgtcgttgttcgttccgaaactgccgatcaggtttggctatgcgtactggagcccattgatgagcccagcgctttcttccaagacgccatccgcctgttcgaggacccgaatatctcctttatccagcagattcatgagttcccggtatgcacacgcattatcgaacatttgtatctgcgcgagaccttgttccgcatgaccgggccgaactacggcctgtggtacgtgcacctgcccaaagcatgggacggcatgcgttatggctaccgcgtggacggcgcatgggacccgaaacacggcgtgcgcttcaatccatacaaattcctgcttgacccgtatggcaagggcatcgacggctccatggagctcacccccgccgccttctcctatgaatgcgatgtcgtggaccgcaaggtaatcggctcggcatacggtgccatgagcaccgtagactcgctcggccatatgccggtgtccgtggccatcgacgatcgcgatacccataagcatgagggcgacccgcagcacccgcatgtgccgtggcgcaaaaccgtcatctatgagatgcacgtcaaaggcttcaccgccaacgcaccgtggctgcccgaatcattgcgcggcacgtacgccggactcgcacaccccaccacgctcgcctatctgcagggtctaggcatcacatccatcgaactgctgccgattatggccaagcaggacgagctcttcctgcaagaacacggccgcaagaactactggggctactccaccctcagctacttcgcccccgaaccctcctacgccactaaagccgcccaggagaagggcgcggccgccgtgcgccaagaagtcatagacatggtgcgcgcactgcacgaggccggcttcgaagtcatcatggacgtggtctacaaccacacatgcgaaggcggcgtcgaaggcccgacggtctgctggcgcggcctcgacgacctggcctactatcgccatcaaaaatccaataccggccgactcgaagacaccaccggttgcggcaatacgctggacttcaccaacacgcatgtggtcacctttgccatcgactcattacgatactgggccaagcgtatcggcatagacggtttccgcttcgaccttggcgtcacgctggcccgcctggaaggcgaattcacccatcatcacccgttcctctacgccctgcgttccgatctgctgctgggcaacctgaagctcattatggagccgtgggatctgggcaacctcggctggcgcaccggccaattctccgtgccgttcgccgaatggaatgaccgcttccgcgatacggcccgcaccttctggcttgaggatgtggacggcggctccgatttcgggcgtatcagtttgcaggagatggccacgcgactctgcggctcggccgatctgttcgccaccgaaccagggcgtggcgctccggcctccatcaatttcgtgtcctgccacgacggtttcacgctgacggacctcaccagataccgctccaagcacaatgaagccaacggcgaaaacaataatgatggctcgtcggtgaaccattccgccaatttcggcgtcgaaggcgtcaccgatgatccagacgtcattgcggcacgcgaacaggcggccatgaacatgatcggcatgctgctgctctcgctgggtacgccgatgatgctcgccggcgacgaattccgcaacacgcaggacggcaacaacaacgcctactgccaagacaacgacatcacgtggctgaagtgggattggatgtattccaccaacaagacgcgcgaaatgcgccgcttggaaaccgtgtctcgactggtggcgctgcgtaaatcactggacctgtatcaccacgaggatttcttcacccgactgacccagatcggcctactcaagccctcaagccgcgtgcagtggttcctgcccgacggtaccacgccgatggagcgtgactggttcgatctgggcgtacgtagcttcaccatgcgattgctgtccaacagtgaggtggacgtgtgcattgtggtcaacggcaccgctgacgaccgcacattccgcctgccgccagacacccactggacgcctaaatggtgctcggccgaaatcaacggccgccgagccgggcatggcactcaggtcgaggaatgcgatttgaacggtgacaccaccgtctggacgcagcatgtaccggacgccagcgagacagtactcaagatggtcgaagaagtggccatgcagcgtacggaatcctcgactgagaatgaagcggataccatcaaattcgcgatgccagtaacagatcacgccgcaaacggcacctcgtccgcgcctcgggatgaggtatcagctgatatgcccgatgcccctgtggatgatacaccggacactcccgtcgacgacaatgtctggaccatgccggcgctgagcatcacgctgatgaagcaggtgtgagtcacactcaagacagcgcgacacaaacacaaaggctctccgcggaattccgcggagagcctttgtatgctcggtacaggacaagcgaaattaacgcttggagaactgcggggcgcgacgtgccttgtgcagaccagccttcttgcgctccacgacgcgagcgtcgcgggtcaggaagccagccttcttcagggcggcgcggttggcatcacgatcgatggcgttcagagcgcgggcaacgccgaggcggatggcgccggcctggccggtggtgccgccgccgtcaacgaggacgatagcgtcgaacttgccttcgagcttgagcagaacgatcggggagttgacctcacgctgcagcagcttggaggggaagtactcctccagagtgcggccgttgatggtccacttgccgtcacccggaaccagacggacacgggcgacagcctccttgcggcgaccggtgccgtagcccggctcaatcgcggaggtgccggtgccagcgccagcgttggtctcggtggtgtagttggtgagctcctcttcggtctcgacaacctgggagtcgttggtgttttcagccatgattcttatctcctctcaggtttcacttggcctgctgcgagacctgggcgatctcgaagacctggggcttctgcggggtgtgcgggtgctcggcgccacggaagatacgcaggcggtcgagctgcaccttggccagacgattcttcggcagcatgcccttgacagcgttcttgatgatgcgctcggggttcttctcgagcagctcggcgtaggagtcacgacgcagaccaccaggacggccggagtgcgagtagagttccttgcccatcttgttgccagtcagagcaatcttgtcggcattgatgatgatcacgtggttgccggaatcggcgtgcggagcgtaggtcggcttgttcttgccgcgcagcaggattgcagcctgggtggcgagacggccgagcaccacgtcggtggcgtcgatgacgtaccagtcatgagtcagatcagctggcttcggagtgaaagttttcactggattaccttttctatattgtgttccgggtctcagctgcttggtgtggcttggtcagggccgcatccaagaggcgtcgaacctcattatccgtgggctccctgaaagtcctcgatggcgagtgggatagcgctttgaaggaccccttagggaaacacaacaatccactagtatatcgccgggcttgacatagggcaactggggacactccattgggtttatggcttctcttcccctatttatggtttctctcccacccacttcggctaaccgactcacctacggtgaggcaattccctgccttctctcagctatcgcttctttcaggcctcgtctacggacagtccactggactgtccgcttaacgactcggctcgtcagagggaggtaaagcgggtcaggaattgaagatttgggcgaagcgttgggcaccggggtgtcgaagagggtttcgagcggtaccacgttgcccttggcgtcggccagtgggatgcgccagttcgggtattcgttgttggtgcccggctggttctgcgcacgcttctcccccaccgcgtcggtgatcgaggcggcgagcagcttgcacggcgaacccttcagtgcgtggtacagcgcgtcgacgatatccgcctcgtgatcctcacgatgttcggcaaagtcggcatcaagataaccctgctcgaccagcatggccagcatcgcatcctgctcggccttggcggaggcttcgaattcctcggccgggccggtcagcaagcccagacgctcacgaatcttgacgtgctcgtattccaggtaaccggcggccggcggcaaatcgtgcgtattcacggaggccaatgcatacggacgccactgggagggggcgcggaacacgccgtcgcactgctcgaaccattcaacggcgcaaccgagaataccgtggctcgacagggaatcggccacatggtccggcaccacgccgaggtcctcacctacgaccacgccgccggcacgagaggcctcgatggccagaacgcccagcatgatgtctgagtcgtagtacacgtaagcgccatccatagccgaacggttctcgggaatccaccacaggcggaacagaccaaggatgtgatcgatgcgcaccgcaccggcacgggcgaacatgccatgcaccatattgcggtaggcctcgtagccggtggtctccagattgatcgggctcagcggcggctggctccagttctggccttgctggttgaacatgtccggcggtgcgccgaccgtggctcccttggcgaagcgctcgggattccaccacacgtcagcgccggaggggtgcacgccgacggccatatcggacatgatgccgatatgcatgccggcgtccttggctgcctgttgggcggaggacagctgctcggcggcaatccattccagccagcggtagaagtccaaagtgtccgggtactgcttgcgcagattggcgatttccggggagttgcgattgaacttgcgctcccagttgccctcctcgccgttgggcgccccccacttgtcgtagcacaggcaccacgtggcatacgcctccaagtcggaaccacagtccgccttgaattggtcgaatacgctttggcgttcggcggtacggccggccttgaagataatccacagggcgtgcatcttgctgcgccacatggcgtcacggtcgatgagctgggaatcaccgttcagcggttcggtgtcggcatgcagtccgtcgacggcattcttgtcgccctcgctgagcgtggcatattcggcgatcgcctcaggacggatgtacgtgaagttgatcaggcgacggcttaccggcagatacggcgacggggtgagcggggacaccggctcggcggcatgcaccggattgatgagcacgaagtcggcaccggtcttctgcttggcgtccaccagcatggtcttcagatcctcgtaatcgcccacgccccaggagttggaggagcgaatcgagtacagctgggccatccagccccacagactgccgcccttcatcgggtcaagcagatcgacgcgatcaggtgcactgatcaaagtggcgtcttgcacacggtcggcgaccttgacgtgcagcgtatggtaaccaatcggcagatcggcgggaatgaccacagccgcattcgaaatgaacgtaccatccaagtcgtaggcctgggatccatctccaggaccaacttcaatggtgccttgatatggctcgccattctccagcgtgatgctcgccgaaggcacgtccagaataccggtgttcaccagcacccggtcctcgctaccggcgatatgcagcacggtgggtgccaccaatcgggcgtaacgctcgttcagaatgcgtcggatggcgatgagttgggcgctctcgctggaggcgtcgatgcccagcgctgccagcacctcgatcaggacgtcatcgtctatctcgtggtagtcatggctcatgcccaaataactcgtgccgacaccgaccaacttggccagtcgaatcaacggacgggccagacgctcttcactctcggtaatctcactcatagccccagtctaacgccgtttgattgcgccacaccgtaagaaaaatgccatgattccgccaaattatgtactttttaccctcacatagtgagatgtgagcgctcacaatggtggacagggggtgattgccggccaaatttgcgcggcaaaacacagcaatagtgtgcttagcggcggctttccacggcgtgccgcacctcggccgaggggtcgttggccaatttggcaagcatcgcttcggacgtattggggttcagtgccacggcacggcggaccatcgaagaaagcaccgccggtgctccctcttcggattcggtgccaagtacgcccaagaaatccaatgtctccgcatccgcagtggggtcctgcgcaccctcaagccgcatcttccagctggtgcgcttgtttttcaacgccgtatcccggaccgcaggcaccgggtccttggtcagacggccgaccagccaattcttgtcgtccccgttggcggccacggcttgacgcacggacggttcggggtcttcggagagtttgaccaatacgttcgggaacggcatggtgtcggcgaggaacacacgatcggccaccggggtgtgcgggttgccggccacagcctccaaaagtgcggtggcgcgggagaacgccgcctgatcggcacggtcaggcaacggccgacgggcgaattcggacagttcggccgggtcggtggaatggcgcagacgctcgtatgtagcggtcagcggttcgaaatccaccggagcggcggactcggctgcggactgcgcgccttggtcctgctgctgggcgtccgtgtcggttgcagtctcggccgcggcctcggttgcggcctcggtgggctgggtctgctggctggtggtgttctcgtcggtcatgatgcccagcttagtcatacaggcgtcacgcgagcggaaccggaatgttgaccatgtcaatcggagccggcaccacagcggcattgaacgcttcccgcacacgctcctcgaatcgcgcgcaatcatcctgcggcaccaccgcggtcaactcgacgttcaccgcatacgattcatcctcctgactgccaccaagctgcgccaggatctgctggaatcgggccaactgcgggtattcgaggcgaacccggtatcgcttggcggtcatgatgcgggcggcgcgggcggctttcatcgccaatgatgcggcggatgagtacgcgcggaccagcccaccggagcccagcagaataccaccgaaatatctggtgacggcaaccacgcaatcggtggtgcccgactgcttgagtacgtcgagaatcggcttgccggcggtaccggacggctcgccgtcatcgctcatgcgttcggacagtcgcccatccgcgcctccgcacacggcggcatacgccacgtgtcgggctttcggatgctgctcacggatcgcagccacgaacgcgagcgcctcgtcgagcgtatcgacatgggcggcgtcgccgataaattcggactttttttcgacgagcgaatcgtgggcaggatcgtcgggcgtgttgagaatcgtctgcatgagcgtgttccggtggtcgactggctgggtgttcgattgagcgcgaggctaggcagggctatcagcgttcggagacgacgacgttatagtcttcgccggcgaagtaggcggtcaggcaggcgatcatctggcgggtgagctccttgaacgcgccgtcggcacgccagccgacgtgcggggtcaggacgatgccgggcacatggcagatggcgtcgtcggcggtcagcggctcatggtcgaacacgtcgagtgcggcgggaacatcgcccttttgcagtcgggcaagcagcgcaccggattcgatgacttcggagcgggcggtgttgatgaacagggtgccgggcttcacatgcgcaaggttctcggcggtgacgatgccgcgcgtggcgttgttcagcggcagatggacggagatgacgtcgctggtttcgatgagcttgttgagatcgtcgaccggagtggcaccggagcgttcgaaatgctcgggcggcacatgcgaattccatgcggcgacctccatgccgagggcgcgggcgatgccggccacggtggagccgatgccgcccagtccgatgatgcccatgcgacggccggcgagttgcagtccatcgccgctggcccacgcccagttgccggccttgacgtccttatcgagttggccaacgcggcggatgagctcgaacagaagggcgaaggtgtgctcggccacggcgtgatcgccataatgttcggcgttgcagacgcggatcttcagctcgcgcgccttatcgagattgaggtagctggcgacgccggtaccgcagaacacgatgcacttgacgtgcccctgcccgctgatggtgcgcagcagatcgtccgaaatgtggtagccgcccaccagcagggcgtcggcatccttcagacgctcggctatggtcgcctcgtcggacgtgaattcctcgaacatacgcacgcgggcaacgtcgtggagcgcggggaactgggccttgatgggctcgatcatcgagtcaagcacggacggcatcacgacgaggggcagatcggtgcgttcgctttgggtttcgtaaatctcggtcatgggctccacattaggaggccggcgggaaaagcgtcaccttgcggcttcccctccttgagaccaagccgagcaactattgctttgccgcctgctcctgcgtgatgttccattccttgacgacgttctggtccgcgcccatcgaatagatgacatcccagatgcgttggcgtatctgagcgtcgtaggcttcgtcccaacatgtgactatgggatggtcgctggatatcgggcaccattggtagttgccttgatgcacgttggcggtgggcacccagtcgatgcggttgacgcgccacgaccccttgacgcccttcttgccggcgaactggatgcgtgcggtcacaccctggttgttgaccaaggtttccggcgtgttcgccgactcggtgacggcgttgcccagaccgtagataatccacgtgccgttatagttctcgatgggctgcgcacaatggcagccggcaccgtagataacgtcgaaggcaccagtgtcggcaagctcatgggcttccgaaatctgccaggaatcggcgtaatcaaggtattcctgcaccgagtgcatggcgatggccaccacatcggcaccttgctcgcgggccttgttggccttgtctaccgcgcgctggatgtcgctgccgtgattcgggtcgccgtcttcgcgcagacgatccacctgccagtcctcgtcggcggtcatgccgttgagggagaccgtgccggtgaccagacccagcttgccgccgccggtcggggaatcgatgactaacggtttggtggagtcggcttcggttttgtacgagccggtctgggcgatgccatcggcctcaagcgtgtcccacagacgggcgatgccatccgccccctgatcccaggaatggttggtggcgtgtgtgcaggcgttgtatcccacgttgcgggcggcatccgccacttccggcggaatgttgaagatcgggtacgcggcatatgggccgccgcgctgggcgatcggggtttcgaattcgcacacggcgatgtccgaagcctgaatgtactgcttcatcggcgcgaacagcgggtcgaagttgaaggcggtgccatccgtggcgttggggttcaggccttggaaatggctccacaatccctcatggaacaacaaatcgccgttgaccagcatggcgatgcagtccgtatccgggcaatccggtgaattgccgtgatgttcggtcaccggtttgggcgtgttcttcgctttattcaacgcgacgtccgacactccggcgcgtgcggggccattgccgtccgtgcgatgggttgcgaaccatgcgccgatgcccagcgtaacggcgagcgcgatcacgaacacgataatcagcgccgcacggttggttcgtgtcgagttggagcgatgttgcccctgcccagcgatatggctcatctttgcccacccttcggaactcttcttctctctctagggtaccgcccatctcagtcaaacactgcggggaggaaggcgatgggcaagcgattggacaagcgacataaaccggttaatcttcaatcaccattcacgaacaccacgcaaaagtctcacttagtggacatttttctttcgtcgctcggacttttcccgacgtgccgcactcgttcgcccactaaaatggcggtttggaggcggacggacaatggcgtacctccgactccgcttaccacaagcggagaccgcccgtcctcggttatttcaggagttacttaacccggagtttccggaaaacaaaaaagttccgagctttcacccggaaccttaatcggcggagtcagagggattcgaaccctcgagccgtttacacgactaacaccttagcagggtgcccctatcggccactcaggcatgactccacgttacgcaataatgcgcaacagcaaattactgtaccacgtcctgcggatacggcgtgccgaacgacacattattgaacgtccgcgggtgcggcgtcgccggagaacgtaacgataaccgcgcaaatcaccaacgccacaccgacgatttcaccaacgctgggaatctcgccgaacgccagtcccacggccaccgccatggcgggattgatggattgcattaccgaaaatgcgccggatgtggtgcgtcgcagcgtgatctgctccaccacatagggaatgaacgaggccatcagggaaatcacaaacagcagagccagcagcttcagcgagccgccgggctcaagcgcccacgtggcatcggccttggggtgaaccacatgagccacagccggcacgccaaggaacagggactggaccagccagccgatggtcacggcgatgcacagattatccagcgaattgccgccagccgccacgcgccggccggtgatgatatacatgccccacatcgacccgccgatcaaaatcgcaatcagaccatacaaaaacgtgccattgccggacggattggccaatgatatgccagctaacagcaccacaccgaccgccgcgataccgataccgacccgctcgcgccagcttttgccggtaatcaccgccaccgaaagcggtcccaaaaattcgatagacacggcaatgcccatatccatattgctgatggccacataaaacagggtattcatcagcaccagcgagcagccgagcagtacgaccagcccccagctgcgggcgtcgcggtgaaacagttgcgctcgcttcgccttgttccagggcctgcgccacagcagcaacagcaccgccatgaatcccacgcgataccacaccgagtacagcggatcgagctgggtgaacgcaagtttggcgacggccgtagccaaataaatcaccagtgcctcaccaatcacgataagaaccacgggaacacggttgaggataccgaccactgccttcttcatgaggtttacgctactcggagagccgggacagcgcgcattgacttggaaggcgttacggacagtgacgcaatgtggacgattccgtggaatcgcacccaccatgcgaaacagccgcacagtgcgtaaacccttggaattccggcgatattcggcattatgacaatgagcgccgcgtcatgcgcgccacatagtgagcatgacctcgttcggcattcctacaatggtggcatgagcaccgcaccgagacttgaggccgccaaacgcgattggggccacgacgagaccggatgcaccgtgctgcatatcgacatggatgccttctatgcctcattggaggtggcgcgcaaccccgggctcaaaggcaagccggtaatcatcggcaccgggccgcgcgcggtggtgtccgccgcgagctacgaagcccggaaatacggcatcaattcggcgatgccggccgcgcgcgcccatcggttgtgcccgaacggcatttttctgccagtggatatggcgtattaccgcatgatgtcgcaccgaatcatgcatgaggtgtttttgaccgtcaccgaccggttcgagcaggtttcggtggacgagggctatatggatgtgtccgccgcactgctggagtgggggcggccgagcgcgatcggcgcgtggattcgcgctcaggtggccgagcgcttccacgtgacgtgttcagtgggtatcgcctgtaacaaactggtgtccaaaatggcctcgaccaatgccaagccggacggcatgctgctgattcccgcggcccgctcggccgaattcgtgcagatgatgccattgcgtggtattccgggaatcgggccgtctttggagaagcggcttaatgcttggggcgtgcattcggtggctgaattggctcagctggatgaggctgcattgactcgtgccactggctccccggctgcggcacgtggattatgggcggcctcgcacgggttggattcccgcgaaattaccacggtacgcgaggagaaatccattgggtccgaggaaaccttggccgaggatacacgcgatatgcgcgtggtgtgtgggctactgcgttcggcctgcgacgaagtaaccagcacgctgcggcgcaaggggctggtggcgcgcacgctgacggtgaagttgcggttcgccgacctgagctatcagacccggtcttttacgatggagcggccgaccgatacggccggcgtgctgtacccggaatgcgtgcggcagctgaaagtcatgctggggctaccggcctcggcggagtctgccactcccctgcccaaaactattcgcttggccggtatgagcacgtcttcgctcagtaaggcggcggctacggccgtgcagccttcactggatgacatgctcgaagaggccgacaatgcccgcggccagacctcacaggcgcgtttgcatgatgccgaggccgcactggacgctgtgcgccgcaaattcggcaacaaggccgcccagtttggggcgtgaacggctcaacgccacttacgatctcattacgccgtgagacgttcgcaggcggaacggatggcctcgtcggtggcggtggcggagaaacgcaggtaggcgggagcgccgtagaattcgccggggctggggatgatgccgatcttggcgagctcggccatatcggcccagcagtcgccggacttggccttgacccatacgtacagcgcgccggagggcatttgtgccgaatagccatatgccttcagtgcgtcaaccagcgcggataggcggcgacggtaacgcctccattgctcgtgcacagcggctgtgtccttcaggcctgcggccatggcggcctgcactgggccagggataatctggccgatctgcttgcggtattcggccatttccttgaccagccggtaatcgccggcaattagagccgtacggtagccggccatgttggactgcttggacagcgagtagagcaccaggatgccagctgccgaaccttcacacacatgtggattcagggcacatggcgtggcggagagactgaatgcggtatcggaggcgggctcgttggattcggccaccggtgcggcaggcacagacgcagcagatgcagacgcggcaggcgcagaggacgcggctgtattgcggcgcaccgaacgccagtccattaacgcatagcattcgtcggagagcaccacggcaccgatgcgacgggcagcagccacgatgtcggtcagccagtcagcggagatgacctcgccggagggattacacggcgagttgatccagatggccttgacgttcggaatattcacccaggaatcgacgtcggtcacatcatcgactttgaccacggtggcgccggcaagttgggtaccgatttcgtaagtcgggtaggagacagccggttggacgaccacatcgccttcgccaaggtgcagcaggctggccatcagcgccacggcctccttggaacccacggtgggtacggcggcagcgttgatggatttcagatccaccccgcgcagttcgcggaaccatgtatcgatagcggccttaaggtcggcggtgccggcggtgaccgggtatccatgggcgttgggggcgtctgcgccggcaaccagcgcctgctggacactgctcggcaccgggtccacaggcgagcctacggacaggtcgatcatgccacccggcacggttttggcggtggctttgaagccggcgatacgagaccagtcgtatggcgacgaatatgcgtggaagcccatgagaacccctttcttggacggtatgttcctaagatacgacgaaccctcggccgtgatagaccgagggttcaatccgaactatgcgctgtgtgcagcgcttatccgcaaatcagcttactggttctgcggcggcagcgcggcgacctgttccgggtctttgccgattggaccattggcggaagcgccgcccaaatcgccgacttcagcgaagaagttgacagcggcatccttgtaccaagcccactcgtccggcagatcatcctcatagaagatggcctcggtgggacacaccggttcgcatgcaccgcagtcgacgcactcgttggggttgatgtacagcgagcgggaaccctcgtaaatgcagtcgacggggcactcgtccacgcaagccttgtccttgacatccacgcaaggctgagcgattacatatggcatggaatcctccttaacaaatactgatacaagggtacgcgcctgttgggacgctcctcgctctcagccgttaacggccttatcggtttcggcggacagcgtttcggtcaggtcgcccttgccgaggcgcgcatgccagtagccgtagccgaagtagatggcgaagccgaccacgagccacaccacgaaacgaatccaggtgagcacggacaggttgagcatcaaccagaagttggccacggcgatgaggatcggaatccacgggctgccgggcatcttgaaggcgcgcggcaggtcggggcgcttcttgcgcataatcgggatggagatggccaccagcgtgaaggcggacagggtgccgatgttgaccatgtcggagagcacgccgatgtcgaagaaggcggccacgagcgccaccaccgcgccgacgacgatctgcagagcggccggggtgccatgcttgccggtcttggacaggccgcgcggcagcagaccatcgcggctcatggcgaagacgatacgggtcaggccgagcaacagcaccataaccacggtggccaggcccagcacgatgccgaagctgatgatcttggcggcccagtcggcgcccaccagttcgaaggcggtggccagcgaggggctgtcttgcttggcgagatcggcataggagaccatgccggtggtcaccacggccacgagcatgtacatgacaatgatgagcagcatgcccacgccgatgccgagcggcacgttcttgtgcgggttcttggtctcctcagaggcggtggccaccacgtcgaatccgatgaacgcgaagaacacgagcgccgcgcccgagaggatgccaggaacgccgtacacggatggggtcatgccggtggcgaactgccacaacggctgggtcatcacgccggtgacggcggaggagccttccacggtggaggccggctggctcggcggaatgaacggggtgaagttggaggccttgacgtagaagaagccgacgatcaccacaaagaacacgatggcgatcttgagcacggtcatagcaccgtccacgcgggcgccgatcttggtgccgaatacgagcagcgtggtaaagaacgccacgatgataatcggggcgatatcgatgtggaaggagccgaacgtcaggttggtgttggcgttccagcccatcaggcgcatgaaatcgttgaggtatacgccccaatatttggaaatcacggagccggccatcagcatttccaggatcagatcccagccgatgatccaggccatgatctcgccgaccgtggtgtaggtgaaggtgtaggcggagccggccaccggaatcatcgaagcgaattcggcgtagcacatcacggctgcgccgcacacgatgccggcgatcaggaagctgatgatcacggccgggccggcgtggaaggcggcggcctgcgcgcccaccgagaagatgccggcgcccacggctacggccacacccatgattgacagatcccaccaagtcaggttgcgcttgagcttgcggccctcttcaccggtttcggcaatggtctgttcgacggattttgtacggaacagttgcatagtgctcttcttttttctctgttgtttgcgcaccgaatgcgcacaataccgacaatcgagtatagaagagcccgcgtgtcttgtctattaataagactcagagtccgcaatatatgggattaataacccactccatcaatcaatagcgcgattacagcacaccgacgcagaccggttcgggcaccaagtccactccgaacgcgctcttgactgcctgctgaaccgcacgcgccaaagctgcgatatcggccgcgctcgctcccccacgattggtcaaggccagcgtgtgctgcgtggatagactggccggcgcgtccgcatcgaccttatatcccttatggcagccggcatggtcgatgagccaggcggcggacgtcttggtgccgggagtgccgtcaggcagagtcgcgtcgaacttcggcgcatcttcgggcagggccgccgcttggtcggcggtcagaatcggattcataaagaacgagccgcagctgtggcgattgtagtcgggagcaggcagaccgtcatcgccaacgggaatgccggcggcctcattgagggaggccagacgctccagatcggtcaggatattggcctcgcgcttggcggtggccatgtcaggcaaggcgtagcgagtagggtcctcgagcatgcccttggcggcacgtactgcgagcacggctttgcggatgtcggcggtggccatacggtcgcccacttcgacgccaagcgctttggcaagctgtccgtaacctaccgtgccttcggccgagtgggtcagggcaaaggtgacggaaagcaccacgtaacgtggcgtcgggaagaatcggccggccggccggccggggccggcgtacatgctggtcttcagtgcggagtatcgatagccgaatcgaagatcggcgggtgtgaggtcgcgcgttgttttggtgtctcgatcccagacttccaccgattcgaccgaagtggcgacttcctgcccgtaggcaccgatgttctgcaccacggaagcgccgactgtgccgggaatgccggacagtccctcgacgccctcgagcccgagctctacggtgaaggccacgaaatcatcccaattggcaccggcctcggcattgacatgcacggtgcgatcctcgccctctaccggtgcagcctcgtccggcacagtgatgaggcgtcgggcgtctcgaaccaccacgccgtcaaaaggcttatcggaaacaagcaggttggagccgccaccgacgacgaccaagggcaggcctttggaatcggcttcctccacggcttcgatgagtcccacgcgcgtggtcggctcgatgaaatgggcgatggggccgcccacgcccatggtggtgatgtctgcaaagcttgtcatggcttactatcttagtggcgcaggtgcgatatcgaggcaatcatcggctgaaacggcagaacgcccgcgtctgaacgaaggtggcgcgggatttctgccgttttggcggcccgaaacgacagaacgcccgcgaggggttcgttcagacgcgggatttctgccgtttctcacgcgatgcggatactgattccgcaccctgccactcgcctccggaggcaatacgcaaaaacccggccgaatgggccgggttttgtaaagctgtgatacttgcgatcaacgagtctcgcggtgcacggtctgcttgccgcagcgcgggcagaacttcttgagctcaagacggtcgggcgtgttacgacggttcttagtcgtaatgtagttacgctccttgcactcggtgcaggccagcgtgatgcccggacggatgtcggcgctcttagccattgtcattcacctctgtgttcttaggtatagtgcgcgcccaccggttagcgggcgcgatttgtagcgaggaagaggctcgaactcttgaccttacgattatgagtcgtacgctctagccagctgagctaccccgccagagagccccgagtgagaattggactcacgacctcttccttaccaaggaagtgctctaccactgagctatcggggcgtggcggatagtggattcgaaccactgaagcacgaagcggctgatttacagtcagctccctttgaccgcttgggaaatccgccagtctgtttcccgccgcggtgtttgacctcaacaggcaacttggctatataaccacagattttccaggtatgcaaatcggcccctacgcgaaccttgttttaccgcggaattctgcggttttatcggcgtgtctcacagcgtgttttcagggcccgcttcggccctgcaaacagccccgaccaaggctgcaccccgcacttcacccaatcattttttcttatatggtgctctagaaccttgcaatggcgcggttttcaagcgatgtcgcctgtttgcgcggcacggcgcatgctggcatgctgggcgcatggcttctgatcttgtacatcacggacaatcattcgacgaccagccgctcggattcggcacgctggccattcacctcggtaacggggtcgacgccgaaaccggcgcgatccgtcgccccatcacgctggcgaacgcctacgcgctgccctacgacgcctcggccttggcgattgccaagcatctcgaatcgctggatgtggtgcgtttcgtggcgtaccccggtctggaatcgcatctgcaccacaaggtggcggccagccagctggcccgcccggactccgggttcggcggcgtgctgtcgtttggcctcgacaccgaccacgacgggcacacccgattcgtttccaagctcaatgtgattacgtctgccgtctcgctcggccatgactaatcgctgatcgtgttcctcggtgaggatgacgagcgccagtacctgtacccgcctgagttccaccgcggcttcttccgtctggccgtgggtctggaggatacggacgatttgattcgcgacatcgatcacgcgctggtggaggccggattcgaggtgtgagaccgcaccgcgcgcatgatttcggcctcttccgccctgctgccgccgtcagtgagtcacaagatggctcggtgacgacgatggcagggctttttacgtcagcacagggacaatacctggcggtctgccgacgatgacggcacttatcgtcggcagaccgccagtttttggaccgtcgccgacacaaaacgccgatttgccgtcggcaatggtccaaaaactggccctataacgacgccaacgcggctcagcatcggcgcatcgccatttcgtggcccactgccgacgctggcctcatgccacggcactcagcgtcggtagagagacaaccattggcacagcgacgacaccacgaacctgcgacacggaaaaaaacaacataccgtcgacctactgccgtcttgtgcaaaatgtcttaagccgctcggccaagtcgccaactgagcctcttccatagggaccccaatccgttacccagtgtagatgcggtgcaacgccgaactcaactacgttgcgcgcatgcacctttatgcatagcaggcatggctgggcgtttggtgggagcagctttcggctcccctctctgagggggagcccctttccgcctagcaagagaaaaccccgactatccgcgggaacagtcggggttgttgaagttcgctaggcgactaatcagccgaggatggcgagaatgtcgcgggcgccgacgatgaggtagtcctcaccctcgtaatggacttcggtgccgccgtacttggagtacagcaccttgtcgccgaccttgacatccatcgggatgcgctcgcccttgtcgtcacgacggcccgggccaacggccaggacttcaccctgctgaggcttctccttggcattgtccggaatgtacagaccggaagcggtctgggtctgggcctcggcctgcttgacgatgatcttgtcttccaacggtgtgagcttaatcgacactgtgggtcacctcgtatctacttgtagttcgataatgccgcgccagaacgcctcaagaggctgacgatcacttgcgttgtccctttgcgctaggacacatcgtagcgcgattattagcactctgccaactcgagtgctaacgctgtgagagaaaatcgtcgaatcgcaacgctcagttgccgcggcgggcaagaatggagtccaggcctgcgcccaacgaatcggtggtcgccgctggcgcttcgacgtcggcacgctcctcggattcgtggaatgcggctcgctgggcggcgtttgcagcctcgtcatcggcgtccgtatcggcatcatcgcgctgctccggctcagtgtctacagcgtttccggcgctgacagccttggcgtcgtccgcggccttgacggctcgggcctcgtcaatcaacttttccgccactgcgggttcgacaggttccgccttggacacctgacgggtcgacttgatctccaagctttccggagcgttgtcggcgttatgttccccacccaaagtgaaggagatgagatcctgcgaggtggacatatcgaagacgtccagtgctcgggcagggcgtacgctgaccagttccgacgtggcatcggcagcggcagcggcatcgtcgcgctcatcgcgctcgtcacgcaccgtaagcgatggttcaactcgaggggcgacggacttgtccgactcaatcgacttgtctgtgcgaacggaggcatcaggtgtggcggaagattcgctggtttcggcagcggacttacggtcggcggattcatcgaccatagcagacggctcggcggcaggcttatcggcggcggactgtgcaatatcagacttctcagactgtttggcgtgctcttccgcggcctgatatgcggcggcggactgacgcaacgccttggccttggcctgctcaatctcggcatcgcgtaacgcgcggcgaatctgccgctgttccatgacctcggtggcagcatcctcaatctgctcggcaggcttctcggcaggcgcagttacggccgcaaccggttcggccttgttcacacgcttgctgtccttggactcggcagacggtttcttggaccagcccgtaccgctatgagcccgctcgtagcggaccaccttgcgctcccattgccgggcctggcgtgaggcattggctcccagcaccagcaccagcagcaacagcacgaacggaataagagcaagcagcggactgaaatgcagggggaacgatacggcaaacaccaacacggttatggcaagcaggcatacggcgagaatctgccggcggcggatggccgcgcggcgcagttcccgcacatgggcgatgtgctcagatgtcagcctcgctgacggtgttgatgctggcattgctgcccctttcgccttatgcggcttgatgtctccgaatcgtctgccgttctctgcatcaacgatatgcagggaaggcgaataacgatcctgccggtgctcgtccacacgtttcatgccgttggccgtacgtacgggcagccatacaacgataataatcgccacaatcaccagcacgacgacagtgctcagtgactcataacccatagagtcaaggataggagacgtgccgacgaactggggctttccgtccgggcgtgtcggagcggaattcttccggtcgacgcttatctggaaccggcggcggcgagtctagcggcgaacccttgccccatatcttcagccaacagcgcaaacgttacgtggtcacgccactggccattgacatacatataccgctcgcgcagtccctcatgatgggctccgaccttacgcaccacagccaaagaacgcgcattatccggcagaatggcgatttccagccgatgcaacgcgggcccgaatgggtctccgagcgcccaatcggcaagcatggccagtgccattggcgcgaatccgcggccggcgcaccgttgatcgacccaataaccaaccacgccggtacgcatggcaccatacacgatggctcccaacgaaatctggccgacgatacgcatctggtattcgatggcgaagatcacgccgacgccatgctgctcgttacggcgctgccgctgcacccattgattgaatgtgatggagccgccatgcatcgggtcaccggattcccaaggtgccagccagtcgttgttgcgccagcgcacttcgttccagccgtcctcatcatccatggtcaggggcgcaggactatcggaaaaccgggatgggtgagacgtggcgggcggatctggtggtccagcttgaacgcctctttaatcgactggaaaactgacacggcctttattgtagccatatgaaggtcttgcgccgctaccgtggccactttcgttttacgatggaaacactagattgtgcggtatgagcgaagtgggcagtggcatgaatatcggcagcgactacagcggcacagagaaaacagagaagacggataaagcgacgctgcgccaccatatactgtctcggcgcaagcgcgttccagcggaagaacgcggagcggccggtgaattgctggtgcgacggttcccagcacacatgattcaggatggtcccacagtggcggcatatgtgtcgatgggttcggaaatcgaaacccggccactgttgcgatggctgcgggctcatggctgccacgtgttggtgccaaggttggggtctgggttggaaattggctggagtgtgctggattcattggaatcattgcgctcgatggatgcagtgggtggcgcgaacaatgccggtagctgcagctctcccagcaccgtccatcacagacccgatgagccaactggcgcagttctaccgcccgaagcgttggagaaggccgatctggtcatcgctccggctttggcagtggacccgcagggcaatcgtctggggcgtggagccggctggtatgaccgggccttggctcgccgcaagcccgcatgtcccctgattgcggtgtgctggccgtgggaggtgttggacattgatttgccggccgaaccacatgatgtgccggccgacggagtgctgacgccggagggataccggcggcttagctcatcgggcctgttgagctggccggccggccaagatactcggcgcaagccagactgaccaaccagccacgcacactggccgatggaaccagagtggcaacagcaagctggctagtaagaccgtaacgccaatgtgtcagggcggcgactaggatatgaacggttgcgtggcatggcgtttgggccatccgcgagaaatatgactttgttggaggaatccgttgcctacctatcattaccgttgcaagaactgcggctatgacttcaccgaacagcagtcgttcaatgacgacccgattaccgtgtgccccaagtgctcgcaggagcaggtgcgcaaggtgtattccgccgtgccgattgagttcaagggtcacggcttctaccgcaccgacaaatccggcaagtaaggtctgtacacccgcttttcctctgtaaacgacggtgtcgacggcggtatgccgcggatattggcactacgggcactgtctgttgcacgggtttgaagcgttgtggataacttggcaagctagaaccacataggtcgatttggcttgcgcttacgaaaaacttcaggtcaccatggttgcatggtgaccttttcgtttattaagccgcctgcgcgcggctcattgcggcgacggcgcatggcggatgccttgcgccgactcactgctgcgttgtgcgtgggactcgcagtgctgtttgggattgaagccgtattggccgtggtggagaccgagccgatggtggtggccgcccgctcgattcgacggggtgacattattctggccgccgacgttcagttggctgatatgccggtatctgcggcaggcccgtcttggacaggcaatattgaggatgtggtgggcaaggtagcgcaaatcgatatcgaagcagccgatcccatttccacgcatatggccagagatgcgcccgtagcaccgaccggcactacggtgattgaagtccgcttggccagtagcgtcgacgatgtattggccggcgatcaggtgagactggtttccgccgtcggttgcgaaggcgctgattgcacgctggccgagaacgccacggtgatgaatgtcggcaaaccggatgcgattggtgcattgggaggcaacgaccgactggtgtcgttcgcaatgccgccggaggccgcggccaaggttatggagctgcaacaggccggagcgattatggccgttgtgcggtaggaagcggaatcggccttcggccgatactgtgttttccgcagccgacaggctgcggaaaacacagtgttggggcgcacagagtgcgccccaactcctactcgcgctcgttaaaaacggcccaatgcggcggcagttcgccgaggatgcgtttgtcgtcgtcggattgccgttgttggtcggtctgcatgtctccgggctcgagtttgacaccgtcagcgtcaaactgctcagtgcccttcatcaccacgcgcttgtgcttgcgcggtgtgcgccgtgtagccgagtattccgccatggttattcaacctcgcgatagatctcaccgatacggctgacgatacggtcgacttccttatcggggtttacgaaggcggcgacactccagacggtcatcacattccagcccaaggaaatgagatcctgtgccgacaaacgatgacgcctacgcgtggattgcacggacataaagttcgcgtcatcggtctgcacggccaaggcaaacggcttgtccttcaatcccaccacgagcggaatcttcacgcccttgtcgaatccataatcaacagcagcgttcagtcctcgcgcgcgcaacctgtcggcgatatcgtcgaacagcacgttgccgcctgccgcatcacgcaacggaagcaccggacggtcgtcaagctgttcggcccacgtcaacatggtcttcaggaaccgaggaccggactggtgcagtcgttcttcatccaaatcttcggaaccaaaggccgacacaatatccaagctgtggtccgccaatgccagggcatccagcaacagtccgcgaccgcctgtgctttcgagcggaccgaactgctgaagcagacgtccgtgcgtggttttcgcatagcacatcgacagaatcacgtcagtggcacgacctccggccacgtcacgcaaggaaaccaaccgcacatggcgcaggaatcggcccatcgccttggatttgcctgccaacgacttcaattcggcacccaagcgtgtgcggaatgcgtcggtcaacatcacgaccacaagtcgatagctggaaggaaccacggcaaaaccggcggcacgttgcgtaatcagacgcaccacttcatcaatctccggctggctggattccaccagaccagaagacataaccggcacaccgctcgcttccacacggtggaatcgcacctcaccggcagccggctcggtggccacatcatagcgaacaggaccatatccctcggattcaaggaatgcggacaggcgcggcgcacggcgagacggggcagcatccacctcgatatgaggcaacgtgtcgatcagctgcttgacgctttcgctggttaccgtcgcgcagtgggcgatcaccaccacctgctgcacgcggccgatgatggacagcaactcgatagcgggaatgtgcgcgcacgcatcgagaatcgccacatcagccagcacacccggctcggtgagtgcggcgagcgtacccggcgcggccaccagaatcggcttggccgcggccagaatctccggatgatcacggcgaatcctgctcagcgacacactggcgcgccctgccagcacggtgtgcatctggttggcttcctgagtgcgggagaacagcatgtcgcacaggcggcgcatggattcctgcgacaccatcggtccgatggagcgcacgtgctccacatcgacctgcgcaaagcggtcggatgcggcctgcagcgcggcaccatcctggttggagatgatggcggacgaacgcacaatgtcctcaaacacggtggtccaccaggccagctgcacttcgccgcgcacctgctccacgctcactcggcgagcgttgagatcggcgaccagttcgttcagtccggcagaggcgaattcctgctccagcaggcaacgctccggcaaggtgtccagtgccttgcgatcatccagcagtgctttcaggcgtgcttccaccttctcgaaatcggcggtttccagattgccaccagcgggtgtggtggaaagcacggtatccagcgcggtcatattgctgaccagcgcctcttgggtggagatgatctcgtcgagcttgctgggcagcaccggccaaccgccgtgaggcacgaactgatgccactgctccccttgcttggcgactaccttcaacgcttcgtgcaagtcctcgacctgcgcgccgacgcgcagcagatccttggcttccttgatgtggcggcggcgctcccagaatcccatcgacgtgccctcggccttgcgctggctcttcggcttggtggcctcgatcatggagctgatgtctcgctcgaaaatctccggctggaacacgtcaagcactcgtcgcagattcttcaaaaccgtaacctgacgctcccactcgcgggtggtgggaggaaccgggaatccgcaggtctgcacggtgcgtgccacctgctcacgggtggcgggcaggaagcgacgcagcaaatcgtccacgcgctggtaggcggttactgcctgttcttcagtggtgatggacgccttgtaccatgcggtgtcttccgggccgatggtgtattcgccgagctcgccggcgcgttccatcttgccgatccatgtgtcaatatcgttggcgatgctcagggcacttgactcgtcaagtcgaacgtgggtggcagggtgcgtcgggagcacggagatacgggccagattctgaatggtctcgtatgcggacacattccacttatcattgcccccgtgcaggtcgcccagatagcgggtcaagcgcgagcgcacgcccacgagttcgtcggccaactggtcgaatcgctgggtggcgactcccggttggaatccgactgcggcaatcagctgcttatcaagcgcggcgttggcgtgttcatcggatacatccagtacctgcgccttcatctcattggcggaagccgtctggatgaacagacgcttctgctcggccacgccgggcacgtacagcacggaacgaccattcatcaggcagcgcgatgcgatggccacagcctgctccgcggtgcccttcgggaaggtgccgtcgaccacgatgctatggccattggcagcaagtgacgcggcatatcgcaccgtattgtccacatcgccgacttcgtactcggcatgcgggtctacgtcgaaaggactgtattgcggaatattggcatctttgagcgcggtgcgggcggattcgtcgccggcaagcgcgtccaacagcacattgccggtggggccgttctccagctggtcgatgaactgtcggctttcgctgatcatctgcgacgaggggtccatgaagcatccgagcacaatctggcgctcgatggcgaagtcggagatacgctccgacgcttcggacgaaatacgggcgaacatcgcggaagtttcgggagtgccactgtcatagctggcaccgtcaaacagggaatcctcatccaggaacaccccctgctcacgcaatgtattgacgaacgcgacgttcagggccacgcgaccggtgaatcgaatggtggtcgacaagccatcatcctcgatcgtgacgctcaccgggtacaacagcaccggcagcgcgttgcccttccatgtggccacgccgaccacgagcgacaactccgccacgccggaaatcctgcgtttggcggcctggtcatccagcacgcgcccaatatggcgttcggcggccttaagcacacccgtgtcgcggaacaacgaatccaaccggacatggccggaagcgaacagctgggcgatgccggagggatgggcatgggtcatctccagcttcgcggccagttgattcacatcctcgagcggcgatggcggctgcatgctgcggtattggtcacgccagcgacggatgcgattcagaccttccgtgagattctggttctgagtctggctctgggtcatctctcgactcactttccaaccgcttcgcggtattcctgatagcccttgttgtgagacagggcttcgtcaatatcggcctcgccacgggcggcgagccaagaatacatgtcgtcgtacaggtacggattcatggcgaggaacgccagcaattcgggatgacgggcgacttcgaattgaacattgaaatcttgcgtggtttttgcctcgtcagaggtcaggccatcgacttcgactgccggctcctgtgctttcagctcgcccttggccacacgctcgaacaccgagccgggctcgaagaccggagtgtgtacgcccgtggagtcgatatcatatgcttcggataccgactgctgggcggtttcggcagccggctgctggtctgctacgcctgctgcggtggcttcttgatatgcttcggctgcggtccgctgctgatcgtccggtacgtcagctgccggctggtcggtttcagactgggcggttgccggctgagcggtctcaggctgggtgttttcagattgagcggcttcggcttcccgggcggcttcaggctgggcaacttcagcatgctgttcgacagtgtccgccggctgagaatcgccggcattcctggtattcggagcggactgaacgttttcggctgacttgcttgcgccagccaccacatcggattcaacaaccgccgccgacgccactgccggctcgcttgtgctgggagcgtgcttaacaacggcatgggcgatggcatctactggaacaataccggagatcctgctgtgcttggatgcaggcgttacaatcgtcgactcaggttcggtctgctgcttcggcagtgccacggagttcatggcctgctggtttttgcgttcggtctcctgctcggcatgctgggccaacgcatccgcgaacagatcacggggtatggccggctcatcgtttttcgtcactggctgcgtgatattcagcgagccaagttcaagctcgtcgaccttgcgtcgaacattatccgcgctgaagatggcggtcggctcgccggcccgtaaatcaagaatatcgtcgacggacatatccgccgcatccggctcctgcggtgcttcgtgaaccgcatagccaaacaaatcaggcaccttgaggtcgagcggctttgccactggatcgtcgacacgaatgaagtccgcaggcacatcgccgaactgcatgcgcatgggagacgtcggcaacaggaactcggcattggccggcaagcgcaacaaatcgccattttcccgcaccacatacgatccattggtcgatccaagatcacggaccgaggccgtgccattgctttttaccgtgaacatggcgtgccgtttggacatcgatttggtttgatcggcgacgtcaaggcgggtgttgccatcatcggcaaggggcgtaacggcttacggccgatttccacgcactcccccggcttgacgctgatccggtcgacaccgttgatcttcaccgtccactcgctcaccgtgaccgccttcctggacacactatttgaccacactacgtgccattgtgtcatcttttaccggcttttggcggattactgggcacagaattgacaactttcgctcattgccagctttgtgtttccacgccggatcgcgttctccgcctcgtcctcgtcaactagtctactcagtatgcggaaaccccgcagcctgaaacacaggtgcggggttcctcgaaaagctgtgattgcggcttatgccgcacaaatcacttgagctcgacgctggcgccagcctcttccagctgagccttggccttctcggcatcttccttcttggccttctcgaggacggccttcggagcgccgtcgacaagagccttggcctcggccaggccgaggttggtgatggcgcggacagccttgatgacctggatcttcttgtcgccgacggcggagaggatgacgtcgaactcatccttctcttcctcagccggagcagcagcgccagcaacagcggcaacagcggcaaccggagcggcagcctcgacgtcgaacttctcctcgaaggccttcacgaactcggagagctcgaccagggtcatctcgccgaaggcttccagcagctcatcgttggtgtacttagccattatggcttcctttcaatcttggcggcggacgaagtggtagatccgctgcctaataaaccttattgtttaaattatcgaagcgactgattcatgccgtgagggcgtaaatcaggcagccttctcctgcttttcgcgcagggcgtcgatcgtgcgcacagccttggtaggcagagcgttgaacaggtacgcggccttggccatcgatgccttgatgtcgccggcgaattcggcaagcagctgcgggcgggacttgaggtctgccagcttcttggcgccctcggcatcgtagacagtgccgtcagcggcggcacccttgatgacaagagccttgttgtccttggcgaagtcacggatgaccttcgcagcctcgatgaagtcgcccttcacgaaggtgatggcggtcgggccggagagaatctcgtcgagaccctcaatgcccgcttccttggcggcgatgcgtgccagcgtgttctttgccacggtgtaggaagtatcgcggcctagcttttcacgcagatcggaaatctgcggaacggtaagcccgcggtactcggtcaggtagacggcgtcagcgttacggaattcttccgtaagctgagcgactaccgcttccttttcgggcctcttcatggcgttccttcctaagtcggccgttgacttggagttcggaactttcggccgggcaacaaaaaagccctgcgcacaggcagagcaatataatctcgcgaagcgaccttcgccggcccttgacgggcttatatctctcaacctgcgctggcttggcgaaccaaacttcggaaatgcactcgcgcgcacttcaaccaacggtctgtggtttacggatgattagattacggatggtcagcgacattgcagaattcgggcgtgtcgcggggcattacagcgtggcggcgtactgggctacggacgcggtgacttccttcagatagtcgagcgagcgacgccagtggccgggcacctcgatcgaatggttggcatccgggtattcgtgcacgtgcggggtgagcgcgttggcgcgggcttgatcgtagaacgggtcggcggtgccggcgcagatcagcggtgccgggccggagtatcgggagctggcggcgtgcgactggccggcctgttccgcgcggatgatcgcccttgcttcggccacgctcggggcctcggattcggcgacgatatcatcgccgacagccggcaccggaatcacccgggcggatggatcgaagtcggcgtgatgcagcaccggggtcagcagcacgaacggcagaccgtagtgtgaggccacatgtgggtaggtcatcgtcgtcagcgacttgccgatcagcaacaggcgagggccggacggggtgtcggaatcacggttcggcgagccagctgcgccatcggccagcacggtagcagaatcatcggcggcaacgccatccccggaatcaccggctttacccgcgccggactcgcgcgcggcggccacccagccgtcaatcgcctgattgaggaccggaatcaccgtggacaggtcgtcggaagcgttgcgtacgttcatgcggtcgattcgccagccggcctcgaccagagcctgggccgaccagtagagcagcggacggtcgcagttgtagccggtgccgggcatcagcagtacgcggccgtactcctgaccgggcttgacgacattcttcttccaagaggtgatgctgacttcgacggccggtttcatcgcgcgccttccttccacgggtgtgtcctgcgtgtccccctgagttgttccgaattattctggcagtcagtctactcccggacccgttcacgttgcctccacaagctataatcggccacggttctgattgggtgcgcagcgcctgacgcgcgttgggcaggccgatcagggcgagtcgcaattctcgccggggccagccgcagcattatgcacgcggtgcgcagccccgcataaacccaaggaagtagagagtaaatggagaagttcttccatttgaaggaaaacggcacgaccgtctcgactgagattctggccggcctgaccacgttcttcgcgatggcttacatcatcgtcgtcaacccgcagatcctgtcgcagacgggtatgccgtggggcggcgtgttcctggccaccatcatcgcggccatcatcggcaccctggtcatgggcctgttcgccaacgtgccgtacgcccaggccgccggcatgggcctcaacgcgttcttcacctacaccgtgtgcttcggcctcggcttcagctggcagcagaccatgtgcatggtgttcctgtgcggcctgatcaacatcctcatcaccgtcaccaagatccgcaagatgatcatcctggccatcccggagtccctgcaacacgccatcggcggcggcatcggcctgttcgtggcctacgtgggcatgctgaacgtcggcctgatcaagttcactcccggcgatccgaaggccgccgccaagggcggtgccgttgcggctaccccgggtctggccaacttcaacgacaaggtgctgtgggtcttcctgatcggcctcgtactggccattgtgttcaccgtgatgaaggttaagggcggcatgctgctggccatcgccatcaccaccgtaatcggcatcccgttcggcgtgaccacctggtccaactcgcagtccatcagcgagaccttctcccagctgccgcagaccttcggcgcgatcttctccgccgagggcttcccggcactgttctctgatccgaccaagctgccgctggtcatcgtgaccatcttcgccttctccatgtccgatacgttcgacaccctgggcactttcatcggcaccggccgccgcaccggcatcttctccgccgaggatgagaaggctctggagaacggccacggcttctcctccaagatggacaaggccctgttcgccgactccatcgccacctccatcggcgccatctgcggcacctcgaacaccaccacctacgtcgagtcttccgccggcatcgccgcaggcggccgaaccggcctgacctccgtggttgtggcgatctgcttcgccttgtccgcgttcctggccccggtcgtctccgccgtgccgtccgccgcaaccgccggcgtgctggtgatcgtcggctgcatgatggccgcttccctgaaggaagtcaagtgggacgacatcgccgaagccattccggcgttcttcgccgccgtgttcatggccttctcctactccatctcctacggcatcgccggaggcttcatcatgtactgcatcgtgaagacctgcaagggcaaggccaaggaggttcacccgatcatctggactgtggccgcgctgttcattctggacttcgtgtgcatggcgattctgtaacgctgattgacaacggattagcctttaaggattaatccgccgccatacggcataaaggccgggctctcacaagggcccggcctttgttgttgccacagtgatcaacgcccatgagtaccttcgatgatcatccgccattcttgatgcatgggaatagttgtcaaccgacaactaaacgtacatggcggcagcacgagtgccttattcaacatcgaaatatgcagcgcgaagaagccgaaaaaccaaaaaggcttctataccgaatgaaacggtatagaagccttttggtttgcgatcaagcccttctcgcccgagagaagctagagaacgatcagtcctcgaatgccgaaccgttaagcgggaagccctacgggcttcccgtaggtgagggagcggctatgccgcgaccgatccgtgagagggctttagtcctcgaacggatcaaagtcgcgacggacgcggcgacgcgggcgctcagtacgctcttcgcggtcggcgcggtagtcgtcgtagttgtcgtcggtggcgtagcgcgggttacggtccgagccacggccacggccacgggaaccgccacggcggtcatcacgatcgccacggtcatcgcgatcggaagagcgacggcgacgcggacgatcatcatcacgggagtcgcgagcatcacggtcatcgcgatcgtcgaagtcacggtcggcagaacgacggcgacgcggacgatcatcatcgcgatcatcgcgatcgaagtcacggtcatcggagcgacggcgacgcggacggtcgtcgtaatcatcctcgaagtcatcggagcgacggcgacgcggacggtcgtcacgatcgtcgaagtcacggtcatcgcgatcggagcgacggccacggccgccacggcgatcgtcacggtcaccacggccacggccgccacggcggtcatcgcgatcgccacggctcgggcgggcgttgttctcctgatcctcgaaaccaggaatggccagggagatcttgccgcgatcatcgacaccctgaacgatcacctcaacggtgtcgccttccttgagcacgtcttcgacagcgtcaatacgctcgccgttggccaggttgcggatctgggagatgtgcagcaggccgtcagtgccgggggtgaggttcacgaaagcgccgaacgacgtggtcttgacgaccttgccgttgtaggtttcgccggcctcgggcacgtgcgggttggcgatggaatcgatgatggacttggccttcttagcggcctcgccaccctcggaggagatgaagacggtaccgtcatcctcgatggcaatttcagcgccggtatcttcctgaatctggttgatcatcttgcccttcgggccgatgacctcgccgatcttctcgaccggaacggtggtggtgatgatgcgcggagcgaactcgctcatctcagccgggccgtcgatgcactcgttaatgacctcgagaatcgtggcgcgggcttccttggcctgctgcaaagcggcggccaggatgtcggcggggatgccgtcgagcttggtgtcgagctgcagggcagtgatgaactcggaagtaccggccaccttgaagtccatgtcgccgaaggcatcctcggcacccaggatatcggtgagggtcttgaagatgtgcttgccatcaacgtcgccggacacgaggcccatggcgatgccggcaaccggggccttcagcggcacgccggcagccaaaaggctcagcgtggaggcgcacacggaacccatcgaagtggaaccgttggaaccgatggcctcggagacctggcggatggcgtaggggaactcttcacggctcggcagcaccggcacgagagccttctcggcgagggcgccgtggccgatctcacgacgcttcggggagccgacgcggccggtctcgccagtggagtacggcggcatctcgtagttgtgcatgtagcgcttggactgcggaccggacagcgcgtcgatctgctgctccatcttgagcatgttcagggtggtgacgcccagaatctgggtctcgccacgctggaacagggcggagccgtgcacgcgaggcacaatgtccacctcggcggacagggtgcggatgtcgcgcaggccacggccgtcgatgcggtagtcctcggtcaggatgcggcggcgcacgatctggcgctgcagctccttgaaggcgttgcccagctccttgtccttctcggcgtcgtccatatcggtgaactcgttcgcgagcacctcgcgcacgtgctccttgatctcatggatgcgatcctgacgcggcagcttctcggcgatggagagcgcctcgtccagatccttgtgagcgatctcgtcgatacgggcatacagctcgtcggtgtactccgggaagagctggaattccttggtctccttggcggcgatcttcttgagctcatcctgagcctcgcagatcaccttgatgaacggcttggcggcttcaagaccaccggccacgacctcctcatcgggcttggtctgaccctcgtcatagatgaggtgccaggcgttcttgccggcacccgcctcgatcatggcgatggcaacatcaccgttctcgatcacgcggccagcgaccacaatctcgaacacggcgcgctcacgctcactccaacgcgggaaggcgacccactggccgtcgatcagcgccagacgcacaccggagaccgggccttcgaacggcaggccggagatcatagtggaggcggaagcggcgttcagggcgatgacatcgtaagcgtcatcagggttcacggcgagcacggtctcgacgacctgcacttcgttgcgcagggtgtgcgggaacagcgggcgcagcgggcggtcgatgatgcggcaggcgaggatggcctcggagctcgggcggccttcacggcggaagaacgagcccggaatcttgccggcagcgtacatcttctcttcaacatcaacggtcagcgggaagaagtcgtagttctccttcgggctggaaccggcggtggtggtggacagaatcatggaatcgtcgtcgaggtaggcggccacagcgccatcggcctgctgggcgaggcggccggtctcgaagcgcagcgtgcgcttgccaaacgatccattgtcgattacggcctcaacggccttgatttcgggaccctccatagggttcctccttctttaattttctaattattcctacatactgtgctgcggttcggcgactcgcttgaaccgcaactgtcctcttcagcggacgtcacataccttgtttcgactgaccccttggccgtcgttcctcgtgtcaacccttcattcgggttctcctgtcggccttacctgctggcctatcctctaaccctcttgccgttgttgccgttggctggcgatatgtaaaacgcccgagcaccatcctaggtactcgggcggaagtcttcaattatcgacgcagacccagacgctcgatgagggaacggtaacggttgatgtcaacgcgcttgaggtagtcaagcaggcgacgacggtcaccgatcatcagctgcataccacgacgggagtggtggtcgtgcttgtgctccttgaggtgctcggtcagatcagcgatacgcttgctcagcagagcaacctggacctccggagagccggtgtcaccttcatgggtcgcgtacttagcgatgatttcctgcttttcttcagccgtcagtgccacggcatcctccttatattgctgcgcggtgctaccggcccgatgccggcgcgctctctatccgcgggcgaaatacgccaagggtcaattatacaggagcaccagacaccacgaatcagaccaacgtcagcaggccgccaaacatcacaacaagcaaagcaatcgtctcaatcacaaaaaaaagataaacgacgcccaactgcgcgtcagcacattcaacggcgactcttttttaatcgtcaccaacaatcccacccacagcaccgcgaaaacggcaacgccaataccaactgaaataatgccaagattcgccgcattcgccaatgccgacgactctccgtacaccacatatgtcgcataccaaaaatcaattttcagaatgcgcaggccggcaatgagttgctccgccgccaagccaatcacaaaaaccgcgccccacaagcgccgatgggcgtcaacaaccagcagaccaaggccggaaacggcaatcagcgtcaccgtccaggcaacaaacgcggcgccgcgcggctcaagcgcgctcaaattatcaagcagccactgcgtatcgttcaccgcaatcgcacgcccccaccaatacggcaccacaatggccgcaatcaccagcagcgcataagccagccacaatgcaggatgcgagcgcttacgctcaatatcggccagcgacagcgtcgattcgggaatggacgccaccggatgcttggaaacatcgttatgtttggaaacatcgttgggcatgggcgaaacaccatcggaccgcgtatcgatttcagcctgcacctcaccgctcgcctgctggtcgaccggctgtttctccacgctggaattcaccgccatctacgtttacctcgcgttcgttgttcgacgccacacctgtctgcacaatgcgtcgtctcatgccgcgacgcccatgctaggacggtattgtatcgtgagtgcgccatacgataatgacatggcgccggacataacgccgcaatacctgattttcgctaatcgcaaccatgcttcggcggacgacataagccatacatatgttcataagggcgaaccatatccgaattactcactccgctaacatcaccacataacggcaacatagatacacagccatacttgatatcaggagaacgccgtcgattcgaaatgaaaactgccagccgcccacacaccagctcctttgtttccaaaatcgcacattctacgccgatgtcatgctccaccatgtctcacgccgcggtctcaacataacaggatgggttgtacgaatccacgttgccgagcattcgcacaacccaccattgcgacacatcactgattccgcacattcaatcgctgcaaccaacaggctgcggcgatatttcagcgcgaagagcggcgtatccgaatgacactgatgccagccagcatcagggcaattgcagacagcaccatcggtgttacggacgaaccagttgatgacagttcagatgaattatcatcagcagtagaagactgttgctggccgccatcaccggtctgatcgccgttacccgactggttaccgtcaccggtctgatcaccaccaccaggatttccgccatcaccagactgacggtcaaccgccaattgcgcgagctgcaaactcagtgcacgctgcggggcatccacctcattttgcgtggaaggatcggatgccaacgcctgctttgccttatcaagtagcgtgagcatcttatcccactcatccataggatattccgcagactgcagagagtcagcctgatcaatggccgaacgcagcttagacgtatccacagctttgccgtcagaagtcaacacgtcgctcaagtcatagtaatcaaaatcgacataaccacccgtattctccttggcgtaattgaacaagccgattcgataccccttaaagtgcgacaagctccaatcgtaagtcagcggcccctgctcgtcgccaagcttggaccattgcttaccgtccagactgtaccaatactgaatcgtcaacttaccactcgcattatccagtgtgttgtccgacttgatccacacattggtcgcatcatctggcaatgtcactgtgccgcccgatacaaaggcctcttcagcgtcacgatcaatcgtatcgtcaacgatattaccgtccgcgtccttcacgccattgtcgtagacacgcttgaccacgcccaacgttcgctgtccattttcttgacgcacagcggcataggcaaaactacgggtatatgtagcgaggcctgcggtgtctccatccttcatatgactgacatccatgtgggtttccacagacatggatccgccaaaggtacgctgcgacaaaacgttacgggcggtttcaaaatatgtcaggtcgccataagtgcctttcatatatttggccgtggcggaaaccttgtgcccattggtcaaacgcaaccagccttcacgatcagtgagagaccaatatcggttatctggattatgtccccattcccataccaaatcaagattcgaaccattgggttggtattcttcggcgaccggatattccttctcatcagcaagaccgatcagggaaatatcgtcgatgacgtaatccatgcacgtgccttccgcaccccacgcggtttcgacaatgagtttggaaccttccacattagcgtcggatgggatggagaactcacctgtgatagtagtcgtctccccacgtttcactgttcctgtggccacacgattaattgtgccgtctgcatattgaatcgccacataaaacaggtgggaagtcacagccgatgaatcgacgccgtccatctcatggtcgtatcgaatcgttgcactggcacgatatgtcacgccctgctgcaattttccatccatagattgacccgggccagcgccattgtattcgccacgattcgtcacagcaagactcgtggttccagaaagagaaccatccgtaatcgcggtaagcgtaccattccactgaggggtccacgattcagtcccgttttcgaaatcgccattgtccaccagctcgattccaatcagagaatcgtcaacctgaggaggctcctccagagtccaccaatcctgatcctgataagactgatgaggcgcgtcattatcaaaatcgtccgaattgaccagggaacgctggcgaaccagattctccaaatcagcaggcaaatcaatcagtttgtcgtaggtgtccgacgcgcttacctgattattgtccccaaacacaggccatccgtcatcaccccacgttgcaggaatcaaaccgggaatacgtccggtcggatatgtgtctcggaagaagaatccatgccaagacgtcgtgccatcaccgttgtcgacttcaacaaggctaccttgtgcgaaagcacctagataatactttttggcttcgtatttggagccatcaagcaaatcagtggtgcgcagcagcatcaccatacgaccgtctttgccccagtaaatcgttggagtatagaaataatcaccgattttgaaagtctgagatccttcaaatccggtaggagtctcaccaagatcatcagtgaactgttcggcagagatgatattctcatggctctccaccaccgtggttaaatcatcggacagcctatattggttgacgccggagataatccaaggactcccttgctcatcaaaatacaatgacggatcatggaatccccgattaagggcaatcttcgtccaaggaccattctcaatatcatcggtgtagtagatataagcgccattaaggttgttcgtattgaataacacgtagaagcggccattgtgatagcgcagcgacggagcccactcgccttcgccatacgagctagctccattgcgcaaggatgaagcatcgctcatagaaatgcgatcatacacgtacgtgactatccaccaattgaccagatcataggatttcataattggagatccgggactgagctccatagtggtactcaccatgtaatacacatcacgaccgtctttgttattcggatcgtccttcgacacacgaataacactgatatccggaacatccgtgttcaacatgggaatggaatacgtgccatcaccgctatcagtcgtggtgtaactgccatccgatggcgttgaagatggcgttgaatcatccgcaaagaccggcattggcgccaaaatcaacccacaagtcgacaacaccgcgatagcactagccgaaattttttgtcgtaaataattcataagtcttttaaactttcatgataagcactcaacatcgagtgcgtattccaatagcatgtccgcacaaatcagcaatgaatgacgataagacattcccgcatatggataagtgatggacattaccactgccaaaacttacgcttgaacaagtaccagttctaggtttcatgtgcggtcatcccgaggctgccgctacgggatgaccgcattaccaagaggtaactagcgcatctcgcgacgcactcgcgctacgatcacaccagtgagagccaagcaagcgacaatcacagcaccaggcaagacagaggaaccggtttgtgccaaatccacgccatccgtgtcatcaacggcatcggaagcattgtcattggagccgtcggcattgccatcagtggaatcatcagccagcttcagaccggcacgtgcactattcaatgcagcaagcgcatcttgaacctgctgttcagtagcggattcatcctgcaataccgcctgagccttctgcaatgcgtcagcaaacaccttccagctctcttccgtgtaatcggaagcgttcaggctggaattctcattcactgcgctctgcaaatcagacttgtccaccggagtcgaaggagtttcatcctgcgactccgtgaaagtgtacgtagtgatgtcgtacagctcatcctgagcattcgcaccaccatcggatttgaaggagaacaccacatgatgcacccctgtcacaccctcaagggtggtcgtgtaatcggcgtactcggatccatcaccggcaggaatcgaaatagaagccacaggttcggaatccggatcatcaagacgaatctcaaggatgcctccggctttgccagctgcagtcacagtcagcgaagaggcgccgttattcccgaaatcgacattcgccaaagacgtccactcaccattattaatattgctgagcttctgaccttcggaattgtctgtagtcatatcgaccacgcgcacaccagaagtcaggtcatatgcgttctgaatgccggaatcccatgcaatggtggaagctggaatgcctccatcttgatacgcgtccagattcttcaccgaagagagaccctcatatgtcattgcaatatcggcaatggaaccatcctcgttaaccgtaatcggatcgagatgagtatttcggtagccatgcgccgcgtcaagattaccgccgttcatcaattcctttgccaccgtttgcgcatggtaggtcatataccactggtcgccaagttgaaccatcgcgtgatgattgttgccgccaacaccgaaatacgtgctcggattcttcagaatctcaccctgataagtgaacggccccatcgggttgtctgaagtcatatacgcgatattgccgtaaccgaccgtgttaccatcaattacgttgtcatggctgaaattagtgcaatacgagtagtaataagtaccacctatcttggcaatcccggagtcctcaaacatggcaggtgcgtctatggcctgagcctcaccttcggtatgcagcatgtcatcggacagtttaataacgcgagccgtgttcggatgttcttcctcgcctgtcggaacaccacctccgtaatacaggtagccctgcccgtcatcatccacgaacaccgcgggatcaaacagccagaccacaccagcggattcaggagtaccgcccttaatcaacagctcaccggtttcgtccttccacggaccaacaggagaatccgaggtcagcacaccgataccgctgccgccattggcgaaatacaggaagaacttctctttaccgttgatggtcttatgagcgacggcaggagcccaggaattgctggcccaggtggccaccccctgttctccagccacacgaatgtaaccctcattacgccaattgaccatgtcatcactggacagaacattgatggtctttacttgagcgaacgaattgtccttgatctgcccagtactgtcatattcatagtcataattcaacgagccatcagcattcacagaagtgccatcacccgtagtgtagatatatacgcgtccgttgtattccatagcccacggatcggcgccataccaataatcgataatcgggtttgaatagtcgccgaaagccttggctgccgttgccgtacccgtagtcggcggcacgaatgaggaaccagaatccgaaccggttacggaaatgtcgtcgacaatgaagtcggcattgctcgtgccatacttgttttcaatcaccagcgagggactggtgaaatcaccactaccacctaacgttccagtacctgaaatttgtgtccactcacccgctttcgccgttccggtcgcaatctggtcacatccggaaccattacccgaacaaacagtgatattgaattcaccgtcttccgtggccttgacccacatacttccggtatatgtctgtcctttttccaccttgccatcaagagactggattgcaccagcatcagaggatgtacgatcagtaacgctcaaggcgccactgccaccatgcacatcatccgcagtgacggcaatggacgatgcggagctattccacaccgttccagacttccaaccattaagatcgtcttcgaatccgccgttgacgaccaattcgacgggttcatcggccgacgccgcagtcactccgatagtcgctggaaatacagcccccatgcaacacagcacggatgcagccgcagcagcaaccacacgaccggttttccttgtttgcaatatgtgaatgttataaaccattcagttccctttcctgaatgatggagggcgactcccccccccatcattttttcttcgccgcacaatcgaatcccacgttggttacgaccacatcgcggctcattgcaaagccatgccagaggaacgtccctcaagggcagccatgcaacagccattgtataaatgagcgcatttcactcgcgatcgtccttgataacaaattgataacgatatgcacaatgaaaataagttcacataaacgcaacgcaacacatcaaatatgacagtttcatatgccaattacacactttgcataacatatttcaacaaagaatggagacgtacaagcgaactcatctgatgccaccactcatcgcctataaagctggcgtgtcgcgccacaataacatcacagccgataaaacgacaccccgaagttgagactcattcaacaatgcggccagcttagacacacaaccaacgcttcgcttcatagcaccgaacattgattccagcacagtcacgaccatcttctttgaaggcaatcgtgtttacgccccgggttctaaatagaagtgcaacaccttgtctagggttggaagtgttcgaagtttctaacttaagaaggtgttgcactcatgggtcaacagtattcgcacctgtcgtccgaggagaggatcctgatcgagaagctgcattgcgaacagcatctgagcgtccggaagatcgcggaggaaatcggtcgggacaagtccacggtgtcacgcgagctgaggcgcggcctgtggttcgcgtccaacgagaacgggtcgtaccgtccctaccggccgaaacggctgaagaccgggccgtggacctcgggtccgttctattcggcgctggccgcgcagaggaaggcggacctgcgccggcgcggatcccgcaagccgcgtcgcatggactcggaccggcttcgcgcctgggtgctggactcgctgcgcagggggtggagcccggaactgatcgagggacggttgaaggcccagtacgccggcgacccgtcgatgcggatcagccacgagtgcctctgccagtggatctacgccaagccgcagcgggcgctggacctgcgccagtacctggcgcgcggcaggaaacgccggacgaggaaaaagggcaggaaggcgaaagggccgcgcatcccgatgcgcgtgcccatcgcggaccggcccgaggcggtcggatccaggaaggggttcggccatttcgagtcggacacggtggtcggcgccgcgccgtcgaggcgctgcatgaacacgcaggtggagcgcaggagccgcaggctgttcgcccggctcgtcgacgacaagagcgcgtccgccacggccagggccgaatacgagatcttcaaggacatcccgccggccgcgcgcgtcgaccgcacgtgggacaacggcacggaggcgagcctgcacatgctggtggacgaggcgctgggcatgctcacgtacttcgccgacccgtacagttcctggcagcgtggcagcaacgagaacaggaacggcaggatccgccgctatctgcccaaaggaaccgggttcgaggacttggcccaggaggacctcgacgcgatcgtcggggagatcaacgacaccccatgaagctcctcggctacaaaacgcccaacgaggtatgggacgaggagatcgccaagctacaatcgaaggcagccagcccgaacacaagcgttgcgcttacaaattgaatccgggggcctcatgagccgagggtgtaagggataaggtgtaaagggtaagggtttaaaggcgtaagggtgtaaggggacactcactcctgccggtacagccgcgaatacaatccgccggcctgcagcagttcgtcatgcgtaccggattcgacgatctgcccatgatccatgacatggatgcggtcgaaatcccgaatcgatgcgagtctgtgcgccacgacgatgcacgcattgtcggagtcgagcaacgccgtcatgacatgtcgctcggtatcgttgtccagagcactggtgggttcgtccataagtaggaagtccggtcttccgacgaccggatccatcatcccctcgttgatgccggcaacctcgcacgccctgacgatgtcgtcatccgtcagccacggacggtgcagcgtgatattgtcgcgcaaggtttcgttgaacaccgtggattcctgatgcacatacgccagcctgtcggccttccatcggctgtccgcgtcgtaaatccggcatccgccgtcgttgatggtcaccgtgccacagacgggttcgatgagtccggcgagcagtttcagcagcgtgcttttgcccgagccagtggggccgacgatggcgatcttgtcgccttcaccggcgggaatcatctcgcaaatcttgcgcatataggtggcgaacgccatgatctggctgatgacgccgacgatgccggagaaggtttcgatgaaggcgcgttgcacgtcagcctgcgcgacggtcgcacgctcgaccagcgtcctgttgcgcagggaataaatgacggatacgacgagcaccgccgcgcacaccgtcagggtcagcatcgtcaatggcgctgaataggcgatcatcatgatcaggtagaccacgaggaacaccatcgacacgaccgtcgacggcagactgccggtcacgatctgttcgacgaccatgaccaggttcgcgcggtagatcaggtcaccactggaacggttcacgaagaacgggaactcccgatcgagcacgccggtcatgtatcggcgggacaggtatcgtccgaatcgcacctgcacgcgggtgagcatcatggtgttcaacgcgccgaccgccatcgccgtgaacgccgggcgcgctgccttccacgcggccacgggaggcgtcgcaggcgtggcggcgggaggacgtcgcgtttcccgattcccggacgggttcccatctccgagcgtccgccggaggccggcgaccgcagcggtttcggccattgggaggccgacggcgtgatcggcgccggatgcgacctgcacactgaggtcgagaggaagaccaggttcctcatggccgggatcgtgcccggcaggaccgccggggaaagcgtcggggtgcggctggcgatgttctcgccgctgccggccggcgcgcgcgtcagcgtcacgcacgacaacggcgccgggttcgcccgccacacgcgcctgcgcgacgggctgggcatggacacgtacttcgccgacccgtactccagccggcggcggggaagcaacgagaaccggaacggcatgatccgccggtatctgcccaaacgcagcgagatccggatgggcatggccggggaactgcgggagattgtcgacgaggccgacaaccgtcccatgcgcgtgctggactaccggacgcccgccgaggcattcgccgacgaactgctagaattgcaggaccaacagggggtgttgcacctctaaatagacatcgggcacacggtttgcgcggtggtgagcagtgagcggtgagtattgagcgacgtacggcgactcacgtgcgctcacacagtggtgagtaatccgccaaacaacaccacgagcagggcgatggtttcaatcacgaagtacagaatgaaactcgcccagcttttggtcagtacgttcagcggcgaggtcttccggataatcaccagcagaccaacaaacaccagggcgtatacggcgatgccgatcgccgcccccataatgcccagattcgcggcatttgccagaccggcctgcttgccgtagaccacgtacgtggaataccagaagttgagattgagcatgctgagtcccgcgatgaactgctcacaggccagcccgagcacgaacacgatcagccatggccaggacggcgagacgaccaccgccatcgccaatccgacgtacgtgatcaccacggccacccaaccgaccagtgcgataccttgcggagacactccccgagcacggccacaatggagtcagtattattcaccgccagcgagcgaccgaaccagtatggcgcgatgatggcgcacagtacggcaagaataatcaacgcccaacgcaacggatgggagcgacggcgctcgatatcagccaaagacaaatcggtctcgggtatggaagcctcggggtgcctggaaacctcgacggtctctactttgccgcctacgatttccgtcgcctcgttaggttcttgctcgttggattcctgctccatgcaccgcctcgccgattacctgcttattgccatgtattgccatgccgattattgcgatgcctatcttagcgtgcgtgttgggcaagtacctgatgttccctgtggtttcgcgcactgattggatacagacaggctactgctgttgcccgtctgtatccggcgacttgtccgccgctgtatccgtctgttcctcaggcaacgtattggcagcctgttccttacgccgcctgccgtgcagcagggcctcgagcatgtcgacctgacgctccagttcgtcgatacgacgtacctgctgcgaaatcagcaagtcgcgtaggtcattgttctgctctttgcgggagacggggaagatgatggcgcgacgttcgggcgatacgtggaaatcggattcgctgccggtaccagccggaagtgacgattccgccgagtcgcgccaagctctcgctgctcgcgcactctccggaatgtttggtgcgcccgcggctcccgagcggaaaagctccgaatctgaagcccccccccagcttattttccacgccggctttggcattgccggagttcaggatttcgtcttgcgattcacgccagcgggcaaggcaacgttcgatgcgcttgtacccgattagagccggatccaatccggcttcacggaacatgcgcacgggtgaggcaccttcgttgtagtggactacacagtaacgcttgaaatcatcggtataggtgatgcgcttcgccgtggcttccgccactgccgacaacgacttcagatacttgatctcctcggggctaaaagtccctccaccactggtcatcctcatcccttacactcgttggaaggctcattgcacacccccttgattatggggtgaatgccatagttcgggatagtaatacttataattcggacatgcctaaccctagtagggtcgtttttatccccgtttaagtggagcctgagtagtggctggacggcaactgaacgataatcggcccacgaatggggtatacaggcccatccttcacctcccctacgattgtgttcgcttggcgattgttaccgagcctgcgtgaaacgtttgttgtggtgaaacacaagttattttcgatgcccggccccattacattcaaatcaaaatgccatacattgcccataagattcggagatggtccacaagtcatccgtctgagatgccgccaatatgacaaatggccgatctgaataatcagatcggccattgttatagctgctcagttataagcagcagtcaagctcacgcgttgagagcgcgcttggtggaacgggacttgacgaacacggtcaccgcggcacccgcgatcagcagaccgatcacggagaacagcatggttccggcggcaccggtgagcggcagctgggtgatgttcttgacgttggtgacctggaaggtgcccttgttgtccttggacaggttccaggcatccttaccagcgaaggtggcagcagcatctgcggttgcaccggtagtgatcgtgaacttgccaacgaaggtgccgttgtagccagtcgggaccttcgtctcaatcacggtgtaggtggtgttgagcttaagaccgttcagagtgtacttaccctcagcgttggattgcagtgtgtccgtggcgccttcagggtaagtgccatcagcattggcggtcggcagagaatacgcaccgttagagccattgaacttaagcggagtcttcgctttgagctcgtcagcggacagaccgctaacatcgccttcgtacacttggaactcagcaccagtcagagcagcagcgttcttgtcgactttctgccaagtcacggcaccagccttggtggtttcttccttgctgctcttcaggtcgacaacgccggcagcggcgagaacgccagtggcgttgttcacggacggcgcggcgcccgtgatagcagtgccagcgagaatcggagcattgccattccacacgagcttgtgagtgtcattatcttcgacgaccagctttccactctggtcgacaatcaagtacagaccaccctcagcgaaggtgaaggtctgggtcttgccaccgttagaagccgtcggggtaatgtccgtgacagccagatccttaagcgcgttcacaaaagcggtggtctgcgcggcggtcagggtagtgttgcccagccaggcccactcgttcagggaatcacccttggtctggtcgttgtaaccagcagcagcgaaagcagcatccactgcctcaccggagaccaaaccctccagctcaacgccagtgttgccatcagacacatacttggcgagctcaacgtacttgaacatgcgcaggttagcctgcaggtcagcggtgtcaaccggcttggtgtagaactggtttgcatccgtggcgttgactgtgatagtcgtgctggagatgatggcctcagccgcgttggcggtggtggcgccgaacgccatgccaccaagcagggtggccgcagcagcgacacccgcgaaaagcttcctcaacttcatgagaaaccctctcttccttattgtgattgattttcttgcaatcgcggaggctgcaaccccacagcaaggcctccgcaatccgcaaatccttattgttttttcggggagggaagccttcatcgactcccctcagtccgccttcggcggccagctcccctcagcgagggaagccaaaaccacctcaagtttcttgaaatcagaccagctgacgcttacgccagaccgtgtagcccgcagcagccagcagggccagcaggcccaggccaccgccgaacaccatccagtcacgaccagtcgtgccaccggtcagcggcagactggagatagccacatacttgttcgtgaactgtgccgactccgtattcgttcggtcggaatcgttctcgccgtactcgtaagagacaacggcatccgtcctggagaccgtgaccttgacggtcaccttatcgttgtcatacttccaaccggcagcaggcttttcggtgtcctccgaagcctcgaacgtgtagaccaaattgtcagcaccggtcggaaccctgaacttcaggtccccattgccgaagccaaccgtcgcgctcgcgccgctagcagtcaattcgtccttggacacagtcgtagtcagtccattgttggccaagccggtaacgtcagcgcacttaccagcattcgcatccgtgctatccacacacttcaggttgaagccgaagtccgaattagcagcatgtccctgcacaaccttcgtcaccttgacatccgaagcgggcaaggtcacgtaagaaggcgtgttggttaccgtgaaggcaccggattgtgcggtcaaaccttgtagcttgaggtcagtcttatcaaccttggagtcatagccttcaaccttgacctcggaaaccgagtatgtgtgcccctcagggccggcaggcaccgtgaactcgtgagtccagttgccggcggcattcagagttgctgaaccgttggcataatcctcgccgtcctgcttgagctggacctgcacggaatcattcgcgtgattctcgttgtcgtcggaccaagtcttcgtcaccgtaatcttggagaccggaagggtgatggtcggcttctgcgggtaggcggcggtctgcggatcgctcgtcgtcgtgccgccctgcgaggaggtcaccacggtcttgtagtcgacagtggcgctggagttgtcgttcgtgtagaagttgttgtcgccggaggcattggcatcgtccttgtggttcttaacagcctcgtcgaacgcagcctgcgtcggcttgacattgaagctcaccgtgtaggtgacgccgtcctcaagcgtgtcgtcgttggacgtgaccggccaagacacggtgccatcagccgcaaccgtcgcctccggggcgtcagcccacgccgtggtctggcctttccgggtcttcgtgtacgtgaagcccgcgggctctccattctcggaggcgctgtcggagctcacgacccagctggacagcctgtcgtgaatcgtcacgtcggcatactcagccgtcttggtgatctcctgataaatggactcgaagatgttgttcagctggccggcatccgtggcggccttgtagtagctgctggtctcggcgcggtcaccgaggttggcgttccaagactttccccacaaatgctcactgctcgttgcagtggcatccgggtagttgctggagatgccgtgcatgtacttgttcaggttgctcgaggtgtcgccggggttggcaccgctgacgacgccgatcgagtagatggtcgtcccggcgtccttcaggctcttcgccttgttcaccgcggtggcggcgacggtggggtcaaacccgctgccgtggttcggctcgccgtcggtgaagaagatgacgaccttcttcgcgttggcgcgaggctgatacgttagcgccgcctgggcgcggttgaaggcgtagtcggcggaggtcgcgccggacgcgctcaggccgttaaccgtgctcgtcagtccggagacgtcgtacgtcaggttgctgacgatctgcgtgtagttgtaggaggaccagccttcgcggtaaaagtcattgccgacgctggtcttctcggtgccggcgaacttcaccagggcgatgcggttccgctggctctggtcggtaatcttcgcgttctctgcagccgtcgcattgatgaatttattgaccgcggtcttgagcgagtcaatcttcgtaggctggttccaaccgctagcgatcttttcggccatcgaaccggacacatccaacaccagcacgatgtcgagtggctggttcgtcacgatctcgcccgtacccgcgctcttcgcaccggtgacgttcaacgccaccgtgtacgtgccgtcttcattggcggtaacggtcttctcgcgggccggagcagacaacgtcggatcatccggcacgccgtttgttccctcggtggaaagaggagcaggcgcgctggcggccgccttctcatcggtggtctgcgattgtgtcgtggaggcattcccatcgtccgccatggcggttgcgctcacaccggcgacgccaccgagcatcgccacggcggcaacgatcgccactaaccgtttgcctttcctgcccgccgcggcccctaccgctgcgaaccattctgcaattctcttcataaccttgcctgtctcttacgatcacgtacgccaaaacccggcgttacgcttataaggcgttacggtattaagcaaaaagcacgaatgcgtacacccgggtagagggaattttttacccgacattgaaaagaaccttggaatttttgaaaagtggcaccctcgtcatccaccctgcgataacgcacttttcttctcgacggggcgtgccggtcccaccatctgggaactgaggcggatttgccgccgctgcgcggggaccggagttactgacgaccgtcagtatgccactgctccgcatgtgtgcagtatcacataccgctacgcatacacggagacatactacatgcaatttctgtgaacgcaaacatacgactcaccaaggccgtgttctgttgcgggcggtggtgttacgggcaatgttgtgggtagtaccctagccacaaacctatatagtggagcggatgacgggaatcgaacccgcgtaatcagtttggaagactgaggctctaccattgagctacatccgcgttaagcgtcgcttttggcgacttgagttattatacatatttcttcggggatggcaaacgcgtgtggctgcagcaggaccagccaatctagttgatggattgcggctttgccgaggactcccctcagtcgcctacggcgacagctcccctcaaagaggggagctagaaaccgtcgaaatcacaaatggatgagctgggactcgtatggttggaggtcggcgtccatcgcgttcagaatgccgttgcaggcgttgaggtgggcgtgctgcgggtcgggcgagaagttgaacaggccgaccagcgtcttgccttcgtgctgacgaatcacagcgagcaccgaatcgttgaacgtatcccacgtggacacccaagcgtcaggcgcgaagcagggatcgttgcgcatcgcgcgcaaatcttccatgcccttccacagctggttctgcaacgtaccggacttcttgcgcagagcggccttggtccagtcgaacttactacggtgcagattgcggctgtcttccacgcgatccgggtcttccttgtaatcccagccgttgagctgggcgatttcgtcgccgcagttgagcatcgggaaaccgcgcaggaagctcatggcgtggtgcatcatgaggtcgcgatccaccgaggtctctagcagtggcttgtcgtgcgtgatgatggccttttcgatgccgcacaggctggcggtggtgccgcaactgcgggcgtcgcgcgtggcttcgtcgtagttgtagagttcgcccatcgaccagctgccgggggttgcgccctcgtagaagtggtacaggaattccttgtgcttgagcgggtcgatgtcgaggtaacgctccacgtcttcgtccaagccccagccgatgtcgtcatggcagcgcaaataattcacgaaccagcagttttcgggcagcgagttgagcttgtcgatctggttcttgagcagacgcacgtcgcggctggcgagcgcgctccacaggttgaccatgatggagacgttgtacagcatgtggcactcgggggcctcgggcgtaccgaagtaggcggcgagctccttgggggccatgaccacctcgcccttaagcaccacggccgggcagacgcattccaaaatgatgcgcagcatgcgcacgatggtgtggacctgcggcaggttgcggcaattggtgccaagctgcttccagatgtacggcacggcgtcgatgcggaacacctcgacaccgaggttggccaggcgcatcacgctgcccatcatggctacgagcaccttcgggttgcggtagttgaggtcccactggaacgggtagaactgggtcatcacccacttgttcatcttctcattccaagtgaagttgccgggcgcggtgttcgggaagacctgcggcacatcccggtcgtagcggtcggggatggtgcggtccgggtagcagaagtaatagtcctgatactcgggatcgccggcttcggctgccttggcccagcggtgggtggaggcggtgtggttcatcacgaagtcgatgcacagactgatgccggcgcggcgcagcttcttggccagcgcggcgaggtcttcgttggtgccgagcttcgggtccacggtgtcgaagtcctggaccgcatagccaccgtcgttgttcgggtgcggcatgtcaagcagcggcatcaagtgcaggtaggtgagcttctgctccttcaagtacggaatcttgtcggcaagtttcttgaggtcgccggcgaacaggtcggtgtacatggtcatgccgaacatatcgccgcgcttgtaccagcccgggtcctgctcgcgggttttgtcgagacgcttcaaatcggcgggacggtcagcgtaggctgcggccatgcttgcgacgagtgcgtcgaaggcgtcgtgatcgttatataggctcatgaagagctgttcgagttcgtcttgatgagcagcaaggcgagcgttgaacacggcgctcgaagcgggacgcttggcggttgcggacttggtcgccgctgccttggaggtacgggccgaacggacggcagtcgtcgccttagtcgctgtggttctggccgtacgagacgtcgtgcgcttggttgcggttgtcttggttgccgtggaagtcgtagcggttttggccgctcgggttgatgctgtcttggcagccttcttcgccacctcggtcttctcgaccgattccactgcctgtgccgactggttgctttgagccaccggaaactcctttgtctctatccgttgcccgcgtcaatcgtttgacgctttgtattacaaaacatcaaaccggttcgacaatcgcaacccaagactcgccgagccaccggcgctattccacagaaatcgtcaccaccgcggaggcaatcggaccatcgtggctcagggaaatatggatatgcggcatcgaccccgcaccgaaagccgagcgctgcgccgaacgcgcattccgccgctcctgcatcactgcataaggcccgttatcggaagcaggggaataagcagaggaatagcgagcgcctgcagccgaattcgcgtaatcagtttggaagactgacgccgtccccttacccagagacacatgcggcacaccacgggaatcatccaagatctcgatttcaggccacgggaaattatcaagcgtgaacggatagggggcatcgccaagataatcgcaccacgctttgaggaacgcctccttgcctgcccacttggcggacagatgcacggcctcgtcatcgttcttcagccgtgcacgatccgccgcctgacgtacctcacgaacggaaaacagcgagcgcatgcgcgagccgggttcagacagctgctcggcgaatgcggcgacgtcaaccacgtcatgacctaaaccaaatgtgcccatagcacctattatcagccattcaacacgttgacaacacatccagaataacgaggttcacacggaacgcggcatccacaaacggaaaccctcggccgctccgcaagccgaatcctgaaagtcaacaccaagtcaaactgttgactaacggtggacacggcgtaaaatgtcgatattccgcccgacactccaatacgtaaatcgattgacgtcaaacgtttgactttttaacgcggttaacacaatgatccaatgaaggataacttcacaacaaccaaccacaaccagccaatgaagccagcaaggaggtagaaccgtggtcacgatgaagcaaatcgccaaccgcgccggcgtttccatctccaccgtctctctggtgctcaacaaccgcgatatcggccgcgtcagccccgatgtcgccgagcgagtccgcgacatcgccgccgaactcggttacctgaccaaccgtctggccagcgggctgcgcaccagcagtacccgcaccatcggattcctcagcgacgaagtggccaccacgccgtttgccggccgcatgattgagggcgcgcaagacgtcgcccgcatgcccgcgttcttcgacaagcacccggatgtcgacggcttcttctgcttcaacgacacccgcgcttgggccatctacaccgaggccacccgtcgcgggctgattatcggcaaagatatcgcggtggttggcgtcgacaaccaccaggttgtggccgaagcgctggatccgccgctttccactgtggaactgccgcattacgagatgggctactgggcagtcggtaagctggtctcgctcatcgaaggcgaggcacccgatccctttcctcgtgccggatacccggtcgagaaggttcagccgccgccactgagcgagcagtcaccccagcttgaatgccagctgcgcatcaagcaatcctgggtccggccccgctcccagcgatagcctgcccaaaaatcacgcatctatcctacttgacccggtttcgactgtatatcgaaggcgctattgctgttttcgtgggtggtggttcgttgttgaaccgttgcgggagtaagagacgacgaaccgacatccacgaaaacagcaatagcgtcaaaaaacaatagggtcgggaagaacaccgtaaatgacgttcttcccgaccctaatcgcgagacactcccctcagccggcattcaccgaccgggggagccagagaatatcaggcctcgtagtagccgtcggcaccgaggcgggcgtccgggttgaggagcatcgccttttcgacctcgtggtggtcgtagccacggtgatcctcgcggaagcgacggttgtcgatcggctcgtagagcgcggcgcgacccatcatgccttcctcaaggtgacgctggccggcagccaggcgggcgttggcacgctcacgccaagcttccagtgcggcctcaccatcggccttggccacggccgcctcgaaggcacccggatggaccagagccacgaagccggaaacatgtccgaagccgagcgaggtggccagaccggccttgaccgggcgaccagcggtctcgcgaccgaactcgtcctcaccaccgccgatgcgcaggggcttcctaacccagaccatgtggtcgtcgcgctggagcttcggatccacgcagtcgagcgccgcgttcgccggaatcacgccggacttgaacagctgcgtcagaccgttgacctggaagatgcaggcaccacccttggcgtggccggtaagcgtcttctgcgagatcacgaacagcgggttgccgtcggtgcggccgatggcgtgggccagcgtgttgtgcagctcggattcgttcgggtcgttggcgttggtggacgtgtcgtgcttggagaccacggcgatgtcgtcggctgagacgccgagcttagccaggtcgtgcacgagcttggagtccttgccgccgaggccggcagccagggcaccgaggcccggagccgggatcgaggtgtgagcgccatccgcgtaggagtggatgaagccgaccacggccgcaaccggcaggccgagcttttcggcgatgtcaccgcgggtcacgaggatcgtgccgccgccctgggattccaggaagccgccacggcgacgatcgttcgcgcggctgaagaagcgcgcgtcgatacccttgccatacatttcctccgagttggcggtggcgttcatgttgccgaaaccgatcacggattccacgccgatgtcgtcgatcgcaccggtgaccacgaagtcggccttgccgagggcgatcttgtcgacgccctcttcaagggagacggctgcggtggcgcaggcggagaccggctgaatcatgttgccgtagccgccgatgtaggactgcatcacgtgagccgcgaccacgttcggcagggcttcctgcaggatgtcggtcgggatctcgtggttgaggaagcggtcgaggtacagcttgcgcatcgacatcatgccaccgaagccggtgccctgggtcgaagccaccagcgaggggtggatggactcgaggatttcggccggggtgaagccggcgcccaggtaggcgtccacagtggtgacgatgttccacagggcgatcttgtcgacgtcgccgaccatcgaggcgggaatgccccatcgggtcgggtcgaagcccttcgggaactggccgccgactgtgcgggtcatggtggcgcggcgcggcacgcggatcatcgagccggcgtggcgggtcacgttccattcgccggattcctcatccggggcgatggtggtgtgagcctcgtccaacttgacgtattcggcggcgacttcgcgggtgggcacagagaaggtgacgtcgtggtcgaggaagacctcggcttcctcttcgtcagcaccgtccttgtagtcgttgcccatgccttcctcgaacgggcggatgccggagcgggccacgacctcgtcgtggtagcgctcggcgatgtcctcttcgggcacgaggttgccgtcggtgtcgtaccagccgggcttcgggctgtcggcccaagtcagcaggcccatgttccacgcgagttcgagcactgcgccggcgctgaggtcgacggtgccgtccgagtggatgccgagctcggcctgggcgcgcgtacgaccggagccccacgggcccagctcaccgacggaaacgatgacgatttcgtcttccggcttggcagtgacgttggtccaatcgttcaagtcgaccggagcctgcttggtgacgatcggtgtgggcagcgccttgatttgctgcccacgcgaggagtcggacagtccagtggactttccggcgacggagccatccgtttcctgagacgaggccgcagcagcttccttctcggcgtcggccatggcctccgcacgcagggccttgatgtcgatgggctcggagccgaggccaccggtcaggtccacatcgagcggggccttgagggcctgctcgcgcgattcggcagtgcacaggtcgagcagcttggccgcaatctgtgcggtggagtaggtgcggatgccgtgacgctcaacgacggcgaccagcgggtcgttaccgaccatcaggccggtgccacgcacccagccgatcttcgggtgagcgaaggtgacgcggctcgaccacaccttttcagcgcgggcacggttgacgatggcgtcaaaggcgctcttgacttcgccgtaggcaccgtcgccgccgaatacgccgcggttcggggaaccgggcagcaccacgtggagcttgtgctgcacgttggtgtcggcaccgatgtggctgaagccggcgatggcgcgttccacgccccacagcatcagtcgggcctgcgattcgaacaggtcgccggagtcggcgagcgtgccatggaccggcggagcggcgaacgggaagaacagagtcggctcccacgcgggcttcagaatcgtggtggtagcaccggaggtcttcttctgctcgtggcccacccagtcgaccagtgcgtcgacgtcgcggtagctggagaggttggccggaaccagccacagcttggcgttgccggtagcgtgctcgcggtaggcctgcttagcccaagccttaatggacggcttgaagctgtgcgaggtggccaccacagtggcaccgcctgcgagcaggccttcgaccacctgagcggcaatcgagttcgggctcacgccggtgacgatggcgatatcattcgcgtaacgggaggcgttcttgttggacgcaacctgttcgagggcctcggagccggccttctggaaggcggccttgagttcttcgctctccgactcgttggcgaaccactgggcttcggcggcgatggtcttgccaaggccgatgaagctgccgttcaaggcggcgggatcgttgtcgtagtaggcgcgggcgaggtcttcacgggcggaggcccaccgatcatcgaagaggatggccttgttggcgtcgaagcgcggagcgacctgcttaggccagtcggagccaagttcggcttcaaccgcggccacgacggcggcgttctcgtcctcggattcttccggagccggagcggccacgccgagctcgttcagcacgaagcgggcggtggcggcgagcacgccgttggaaccggtgaccttctcggcgaaggcgtcgagcgcggcggaatcgaccacagcgccaccagcggcaccaccggcggacggcagggccacggcaacacccttgagctgggcgacgacctcaacggccgcatcaatcagcttgtcggcttccggcttgttctgcacggcggcggtgggcagcttggccaggtcgccgccacgggagctggcaccctcgcgagtgtcgagcagcagtgcggcgagcacgctggccacccaaccttcaccgagctgccatacgttggtcacgcggtcgcggatgtactgctgcttgacgccggcggcaccgaacagcgagcgcaggcggtcgcgcagcgcctcggagagcacggcaccgaacggcttgtagttcggggcggccttgttgacgatttgggcgagcttgtcgagcgtcgcttcagcagcaccgtccacgctggcgactcccagctcggagctgatgtccatgagcagctggttgcggcgagaagagacaccgttggtcagggtgtcagtggtgtcgttgctgccgatctggtcgatgcgcaccttggcggagtaggccatgagcacgccgatggcatcggaagccttgaagggcaggtcggcgacggcggcaccggacggtgcgccggccgcggcctgccctgattgcaggccgcgcgaggagtcggacagtccagtggactgtccggcgacggagccatccgttgtctgagcagcctcagtcacggcatttgccggagcggcaccggaaccgagcttggcgacggcggaaccaccggcaggagcggtttcgaccggggccgaggccgcagcctcttccggctcatcgtcgggaaccagcgaatcggtgtcggtcatgtagacgcggccttcatcgcggccgacgttgtagacgaccgtatcgttgccggcgaactcgggtagacgcagggtcttggcaccgaggttggccagggtcggggcgttgccgaggccgacttcgacgtattcctccacgccgaggccgccctgttcgcgctgaccgaagagcagcgcctgggtttcaatccaacgcaccggggaggcgaactgccaggagagcagttcggtcaagagcagacggccgagcttctggtcgtcatcggcgtaggaatcccacacggccgggtcgtcgagcacggccttgatacgctcggacggcacgacttcgaggatcttggcggcgaattccttggtcatctcgaacggggtggccaccaggttcgggatgtagcggtccaccagacggccacggtagtcgatgtaagcgggaagcagcgcgtcgagcttgtcgcggaattccggcacgcccttgcgcagcagtgtggagtggaacggcacatcgatgccgggcaccagcatgaacgcgggcttgccaccgaatgcggccacgcggcgggcggaatcggccttcagagccttgagtccggcgatcgtaccggcgatggcgtactgctggccggcgaggttgtagttcacgatctccaggaattcgccggacgccttggccacggattccacgtattccttgacgtgcgcgtcgtccacaccgaactggttcgggcgcagggcacccatgcggtagttggagcgaccctgtgcgtcacgctcgatgaggtggtgcatggtggaaccacggtggaacacgagctccagcacggtttccagcggaatcacgtcggcgaacgcggacagcgcgttgtattcgccgagcgagtggccggcgaagtaggcgggccagatgtcggcgccggcttcgcgcagacgagcggtctgggcgaaggccacggtggcgagcgccacctgcgtgaactgcgtcaggttgagcaggccttcggggtggcgataggtcacgccgttggcggtgagctccttcgggttatcgcgcacgaggcccaggatcgagaagccgagcttggagcgggtgagcttgtcggcgcgctcccacacgtcgcgggcggcggcggacttggcacgctcgtccagaaccatgccctgcttctggatgccctggccggggtagacgaaggcggcgcgcggcgcgcggaccagtgcggtgccgcgggagacgagctggccgtcgatacggcaggtgacttcgagggtcatgccgccgtggcgcaccttgccgacgcgctcgacggagatttcgacggtgtcgtcaagctgaaccatgccgtacatgttgtaggtccagccggcaatctcgtagtgggcacccttctcgtccagcgcctgcacggcgtgctgggcggtggcggacagccacatgccgtgcacaagcggagcggccaaaccggagatgcgagcgccacgagtggaggtgtggatcgggttgaagtcgccggaagtgcgggcgaaggcggtcatgtcgtgtggggcgacgaccttcacgcggcgcagcagacggcgcggcgtgggcgcgatctcctcgtgctcggcgtcgccgaactcgggggcgtctgccggcaaagcatcggagtagacgcggccgcgaatcgcgaaacgctcggtttcgcgggcaagcagcgtgccgtcggcagcggtgtgggtcacgtggatggtgaccacgcggccggaggcggactcgaagtaatcctcagcccaagacttcagggtgatggtttcaccggtgtgcttaagcaggtcctcctcgttcacctcaagttcgatgaggtggtcgaggtgaacggcgttgagcaggccttcaatcaccgggtagcccttgacgtacacggagccgagcgccgtgtaaatcgccggccaggccgggccgaccagcgcatcgggagcgatgcggctgggctgcagggtcgtcggcagagcggcgccggtggccgcttcgtggtcgaagccgaggttggcggagagggtgtaggcggcggtggcggtagcaaacggacgctcgtcagaggtcttgccgtcaagctgcggcatctcggtgagcttgtcgccggtgatggcggtgttgccgatgcctgcggtggcggcgagcatcgcgtagacgtccggaatcaggcgttcgcggtccacgaccggcacacggccgggctcggcgccttccacgatgagcgggatgacgatatcgcgcacggcgtgcttggaggtgccgccgtccgggtcgttgtcccagtaggtgtcgaggtggatgtccagatcgtacttgccggccgcggcgtcaaacgcgcggatctcgtagtactggtcgcccagggcggtgccgtaggccgggttgtcggtgatgtggccgacccaggagatgttcggggacttgcggatgaagtcttcggcgctggtggcctcgccaagtgcggcgaaatcgtcgttctcagcggcatcggcggcctgctgttcgtcctgcacgcgcttgatggcggcggtttcgaagcggccgaggatgtcggcgatcggctcgtcgatggtggtgatgccggcaacggagatcgggccggggatggcacgcacggaatcggcggagtagcgctggtcttcggactgccagagctggtcctgcccccaccaacgcagcaggtcgttgtcgatgacgggcacgaacggcatgggcttggggtattcgcgcacgagcaccgggaaccaagccacgtcggtcgggaccaccttgagttcggcggtctgcgggtaggccagtgcgagcttttcgagcgcgggggccgggtcggcgagaatgtcgtcgtgggtcagcaggccagcggcagctgcctcttcagcagaaacgccatcagcggcgaacaacttggaggtgaattcgccggagtccgtgtcgttcacacgggcttcgatgcgctgcagcaggtgctggaagcggtcggcgtaagtcgggtcgacccacgggaaggcgagttcggcgaagcgctgcgcccactcaaggtaggtcatggaggccaggtcgccgaagtaaggcttggcggtcttgttcagggcttcgatgatttccttgcggcgggagtcgagctcttcggggtgcttcatgacgcgcacgagcagacggccgcattcggcggagtcgttctcgagctcgtaaatgtcggcgtgcaggtggctcaggccggaggacatgccaccgacggacttgccggacggcacccagtgggcggcctgcggggcgaacacgtcgtcggacttggcgtcggccggaataccgggcgtcttgacgagcagctgcttgacttcggggctggtgtgagcctccttggcggtcatcgcggcggtaccgataagcacgccgtcgaccggcatgtcgggcaggccgtaggcgtgggcccactggccggaaatgtagtcggccgcgcgttcgggagtgccgatgccgccgccggcgaccagcacgaggttgtcacaggcgcgcacttcggcgtaggtggcggcaagcaggtcatccagcgcttcccagctgtggtggccgccggcttcaccgccctcgacctgaaccatgatggtggtgggggccacggccttggcgatgcgcacgacctgacgaatctggtccacggtgccgggcttgaagctcacgtacggcaggccgtccgcctgcagcgacttgatcagggccacggcttcgtccagctcggggatgccggcggagacgaccacgccgtcgatcggcgcgccggatgcgcgcttcttgggcacgatgcgggaggagccgaactgcaggttccacaggtaacggtccatgaacatcgcgttgaattcgaccgtgcggccttcctccagctcgtcttcgagggtggcgatgtggcggtcgaacacttcggcggtcacctggccgccgccggcgagctcggcccagtagccggcgttggccgcggcggccacgatttccggttccacggtggtgggggtcatgccgggcaacagtaccggcggcttgccggtgagcttggagaacttggtgaccagcttggcgccggccggggtgttgatgacgcgcggggcgaatgccttccagttctgggtgcgctcaggctcgctttccagcgtggagagcgtggagcgctcggccagcgtggtggcttcgaccacgccgatgccggtgccttgcaccacattgccgatcagcttgccgagcgtgttgccggggccgaggtccacgatccacagcttggacgggtcggcggcgtcgaacagcgccttgacgcgggcgttccagtccacatggttcagaagcacttcctcggcaagcgcacgggtgcgcttctggtcgaagccgcaggcgccggcccaggccacggtctgctcgacggcgtcggccatgagcggcgagtggaagggcagggtgacctcaaggtattcgagggtcgggttgaacacggtgccgccgtggagcttctgctcgcgcagcttggcctgatgctggtgttcgcgctcggcttcgagggcgaaggcagacaggtcctccgggtagccggaaagcacgtggtggttgtcggagttggtgacggcgatggagatcgggccgcgagcgttgttgacgcgggccaccagagcctcaacctgttcgcgggtggcgcccttgacggagagcatcggactggcttcgccatacttggggttcaggcccagttcgcgcacgcggcgagtgccggctgcaccgatcagggcggcgacggccagaatctcgtcaagggtcttgccggcggcctcgatggagccggcggcctcgatggcgcgggccatgtgcacggcgagcacgccctgggagtggccgagcacggcgagcggcttggcctgggccacgctgtagccgaggtgttcgaggtcgagcagggcgccgagctgggtcagtgccacgccttccacggacgcggtggcgtcggctgcggcgccgaggcgggccgggttcggagtgaagccgaacaggtcgaccggacggccggtggtggtcagcaggtcggcggcgaccggggtgagcagtcggttggatgcggcgatgtggccgcgcagggcctcgtcaaggctgggatcggtggtctggtctgccagggctaccggccacggggtggactggccggcgaaggcgagcgcatggggctcggtggctaggcgattgaggaagaaggtggtcattgctttccttacttgtgtttggttgacgtcttcaaaaatcagaggggctggttgccgtggtgtttggtggtgcgcttgacgcgccgcttggtggcgagcgtggccagcgattcgacaatcacctcacgggtctgttcggggtcgatcatgccgtcgatctgcccgatttccagtgacaggttcgcgttgacggtgctggtctcgtactccttgatgtacttggcccgcagcgcatcgacgtcctgtccggaggccttggccttggccaggtcgtggcggtggatgatgttcaccgcgccggccgcgccgagcaccgcgatctgggaggagggccacgcgaagttcaggtccgcgccgatggccttggatcccatcacgatgtacgcgccgccgaacgccttgcgcaacaccacggtcaccatcggtacctgtgcgttggcgtaggcgtagatcaccttggcgccgcggcggatgatgccggcgtgttcctggtcggagccgggcttgtagccgggcacatccacgagggtgaccacgggcaggttgaacgcgtcgcacaggcgtacgaatcgggcgactttctcggacgagtcgacgtccaggatgccggcgagcacgttcggctggttcgccacgatgccgaccggcttgccgtcgatgcaggcgaagccgacgagcgcggaggcgccgaacagttcctgcacctgcacgaattcgccgtaatcgacgatgcaacgaatcacttcgagcatgtcgtagggctgacgttcgttggtgggcacgatggtggcaagtcgcttggcggtctcgcgttcggcgcgggtgacggcgtaggcgtagaccggcggcttgctttcgctgttggacggcaggtaggcgagcacggtgcgcgcatagtcgatggcgtcggattcgtcctcgccgaggtagtgggccacgccggacacccggttgtgcacttcgccgccgccgaggtcggccatggagatggtctcgccggtcgaggccttgaccacgtccggtccggtgacgaacatgttcgagttctcacgggtcatgatgatgaggtccgtcagggccgggcagtagacggcaccgccggcgcaggggccgagaatcaggctcagttggggcacgaagccgctggcctcgcaagtcttgcggaagatgcgaccgtactgggtcagggcggccacgccctcctggatgcgggcgccgccggagtccacgatggccacgatcggcactttgaggtcgatggccatgtccatcagtcggcagatcttctcgccttcggcggtgccgagggtgccgcccttgacggagaagtcctgggcgtagacggccactttgcggccgtagacctggccgaagccggtgatgacggccgcaccggcgttgccgccggcgatattgccgccctggaagcggccgatctcctcgaacgtgccggtgtcgaagagcaggtcgaggcgttcgcgcgcggttttcttgcctttggcgtgctgcttgtcgcgggcgcgctcttcggcggcgcgggccagttcggcggccttgaccacagcggtgcgcagcggctggtgggccgaaggctgtgcggcgttggcggccgaggccgcagccgcggccttcacggcctgcgaatccatgatgtcagtcattgccaccctccttcttggcgtcggtggccttatcggctccttctgacgagggagctgtcgacgcagccgcctgagggagagatcccggcgcagccgcagcagccttggccttgccggcgttcacgtccagcgtgaccagcgtgtcgccggcctccacgccgtcggccgggccaacgaaaatcttcttcacttcgccggcggctggcgcgtacacgtagttctccatcttcatggattcgagcaccaccagaaggtcgcccttggccacttgctggccttcggacacgttgatgcgcgtgaccacggcctgcatcggggaggcgatgacgccggatttggcgccgtcgttggccgcagcggcactggaggccacgttgtgcagtcccgcaccgcgcaacggctgggtgggtcgcttggcaccgcgggcgcgggccgagccggtgatgttctccacgatgtcgagtggcacggtgagcttgacgcggcggttgttcatctcgatgacgaacgtctccgacttggacttgtcgggcgcggccggggcagcggcacccggggcggcggccaaggaggccggctggccggaggcggcggaagccggtgtgcggttcaggtacgtgcgctccagccacttggtggacacagcgaacgggtggccatgctcggcggtgaagtcgtcgttgcggaagatttccttgaacagcggaatcggcgtgggcacgccttcgatcacaagctcatcgagcacgcggcgcacacgggccacggcgtcgagacggttctgggcggtgacgatgaccttgcccatcatcgaatcgaacttcggggagatggtgtcgccctgttccacaccggtatcgatgcgcacgccggggccggccggccactggatcttctccaaggtgccggagccgggggtcaggttggtggccgggtcttcgctggtgatgcgcagttcgaagctgtggccgcgcagttcgggggcgcgggtgagctcgccaccggcggcgatattgagctgttcgcgcaccaggtcgaggccgctgacctcttcggagacggtgtgctccacctgcaagcgcgggttgacttccaggaagtacaccttgccgttcggggtcaccatgaattcgcaggtgcccaggcccacgtagccgaccgtggtgaacaggcggcgggagtattcctcgagcgtgctgatgatttcctcggacaggaagggcgcgggtgcctcttccacgagtttctggttgcggcgctgcagcgagcagtcacgggtggagtacacggtgaagttgccgtgcgagtcgcgcccggactgggtctcgacgtggcgtgccttgtccacgaacttctcgatgaagtattccttcagatcgccgccttgcagcgcgtcgtggttcatgtagaagcggcgcagctcctcgtcgtcatgcaccacggtgatgccgtggccgccaccgccatcagtgcgcttcatcatgatcgggtagccgtgggtgtgtgcgaagtcgagcagcgtgcgcacgtcggtcaccggttcggacaggccgggcactggcggcactttggcgcgtagggccacgcggcgggcggtaatcttgtcgcccaaatccaccagcgcggtgtggtgcgggcccacccagatggcaccggcatcctcgaccttctgcgcgaagctcggcacttcggaaaggaatccgtagccggggtgcacggcattcgcaccggtcttgtgcaggatgtcaatcagcagatcctcgttgaggtacgtgtccttgtaggtgtcgccggagagcaggtatgcctcgtcggccatgtccacatagcggctattgcggtcctgttcggagtagacggccacggtggagatacccatctccttggccgtgcgcaccacgcgaagcgcaatctcgcctcggttcgcaatcagcagttttttgacgatagaagccatagtgtcaaattgtgctctctatatagaggagagggcaagctgcgttcacacaaaagctttcacgcccttttgtaggctacgaacaaacgcgcgcgtaggttccggcaacgtaaccgttggcgcctgctatcaaaaacgttgcaaatccgccgattgcacatccttgcgcgccggctcaagaagttgacgttacggttgtgttcgtcaacttatgacaaatcgaaatcgacaattttgtaaattggtacgaaaccgcacgaaatcgaacacctctacgatggcaaccgtaagttcgggggaaggctcatctgcgggcgaacggaaggtgaccggaccggcatcggtccatcgccgcacgattcgcccgcacagggtcggattcatttgggaccgtccaccatatggacggttcggactgtcggggataccgcacgacccgccggaacctcccctcatccatcgcataccgcccgccgttcacggcgatatcacgcaacataggggtcattgatatgcagacttcacacaccaccgcatccgctgcggccaccacatcgctcgcccgtcgtatcgtcgccgcatcctggaagccggtgctgttcgccgtgctgatgtggctgtccgcggccgccggcgagattccgattccgggcacgccggtgccgatcacgctgcaaacgttcgtggtgatgctcgccggtcttatgctgccgtggcgtcaggccggcgccgccgtcgccacctatctggcggccggtgcggtcggcctgccggtgtttgccggcggcacctccacgctggccctggtcggcccgagcgccggcttcctcttcggcttcctgccgggtgtggtggtcatcgccctgctgcgcggcaagtccgacacttcgtccttcgcggccgccgcgcgcaccgcgggccgctacctgctggccgcgctggtcggcggcgtcgtggtggtgtacgccttcggcttcgtcatccagtccgcgctgaccggtgcgccgctcgccgccgtggccctggcctccatgggcttcgtggttggcgacgccatcaaggccgtggtggcctctctggccgccgccggcctgtccaagctcggtcgctgacctgagctactagctagctactggccggctattacagcactcccacatcggcggtgcggaccgtatggtccgtgccgtcttgtgttctcaggatcagtgaggcgtcttcgttgaggccgatggcttcgccggtcagcgtggtgccgtccgtgaagtgcgcctcgacctgacggccgcgcgcccagcacaccgccttcacctcctcgcgcaacgactcggcctggcccttcgggtcggcgatgaacttcaccaaccgctcgcggaagccctcgacctgacgttcggccaccgcatcgcgcatctcgccgaacgacggcagcccggagacatgcagctgcagcgaggtcgattgcggcgtgggcagccgacaggcgcccaaggccaggttcaggccgacgccgaacacgatgacgacgtcgtcatcgacatcagcatcagtaccggtaccggacgacggcggaatcaccagttccgagagcagcccgcccagcttgagcccgtggcagaacacgtcgttcggccatttgagttccagcgagcagtccggctggttcggcgcggcaccgtattcctcgatcatgccgttcagggcgtccagcgtgaccagtccggcgatcatctgcagccagccattgacggattcgtcggtggcgatcgcgcgcggaatgcgcacggcataggacatcgtcgagcaacggccgggctgactgacccacttgtgaccattgcgcccacggccggcggtctgccggtcggcggccaccacggccaccgccagttcgccatcctggtggtcgggcaacgtcaacgacccgtcgccaatcatctgtacggccagcgcgttggtcgaatcggtttcgtccacggcgaccacatgatctgcgacggctgtagttctgggtagctgcggcgttgcagctttcaacgcaatcatcatgggcactacgttacctcgattttggcgcgatatgcccgcgttattccatggaaaagcgcgcaaaatcaactattttcacccacatagcccatgttaacgttcacaacttcggaaattccgcattcgccgaccccacgcatgcacccggccgtcatattggcttgcgaacaatggcgatgcccggcagacatcgaatatcaaccgttgacctgtgcggctaccatatattgtcatgacgtcaccagccaccgcgaagcttgccgccgtatccagccgccagtcccacccgcatcttgcgcgcgcgggcgctgccgcgcgctggacactggccgtgctggccggcctgtggcttgcactgtgcacggcggtcggcccgctgtactgggacgaggagaacggcaccctcgcccattggaactgggccaataccgcaatattcgtcgtgtcattcctgatatatctcggaatcatcacgctgatggtgcgattcgcagcaggccagcgcatactgccgagggctatcggcgagcgactacgtcaacatcagcagaatagcgaaacatcacggcccgccgccgatcagcaggccagccaaccagccaagacccgtcgtaccgttcgcgctatcgtcacgtccaccgtcactgttctggaccgctggatcacacgcggcacgaaccggttctggaagcttatgctggtgttttttgtcggctggctctgggtgccgaccactctgctggccgcattcggtgcggacctccgctcacagatccgtgaattcagctgggcctggaaccagtggaccggcctgaaacagccctatatcggcttcttctccttcgtgccgatggacatctaccccactgcgcactacatgtggccgtccgatcccacgtatctgaccgaccagcacaatgtggtactcactgtgttctatggcgcgatggtcacgtttgcgaggcatctgaccggctcaaacgatgccggtatcgtgacgttggctgccctgcagacgctgttcgccgtgttctgctgcgctgccgccgccaatcgattcctgaaccggccttggataggaaaaacggcaacggattccgccgctcccccacaggccggaggattggctcgattcctgattctgctgttctttatggtctgcccgctggccgtgttttccactatctccatcaccaaatcgccgctgttcgcgttctcgttcgtctggtggttcagcgtctggtatgaactcgtccagacctggcaccccgccggcacccgcaaacatcctcagacccctgccatcgccacgcccgtccacttgccgcgtcacagtttcatcgcctttatcctggccacgtcggtaatgctgatttccgcgaaatatgcgtggtacatcatcgccctacaaatcgtgctggctctgatcgccgaccgcaagcgctgggcgacttacgtcgtggcgctgctcatccccaccgtactgattcacggcggcatctccttcgccatctcctctggtgcgatcatcggcggcgacccaatcgaaagccgcggcgtacagctgcaaatgatcgcccgcgtggctcagcgcaatccggacggtatttcagacgaagccaaaaagaacctcgcgcccgtcttcaatctcgatcagatggccgacgcttactcccagcaggatgccgacccggtgaaatcctccggtattcaggccaagaaggtcagctacaagtggcgcacggtgacgcccgaggatatgaccaatttcaacaaggcatggttcgaaatcgtcaaggacaatccgatcatcgcgctggatgcgttgctggccaaatgcttcggatacttcaatgtgaacgatcagccgtacgtatcgatggattattacgtggccagcgattacgtgcagaaaaactccacatggatcaaggattacaaccatgactggcgtgagcacatcgccggcttcactcgcgtatggggcagtattcccgtgctcggctggcctacgcacggcaatttctacgtggtgatgacattgctgatcggcgcggccgaggtgattcgccgacgttggctcaccctcatgacccatattccgctgctactgctgatgggcgtgatgattaccgcgccggccaataatttcgagcggcacatgttgccggttgcgtttgtattcggattcgtggtgctgacgtattggcgagagtctttggctgaaaggcaacgccaatcagcgacgctacactagtgactatgtcagattttctcgaacttcttgctgccgacgttgccgattcgtccggtgcatccggtatgccgggtgcgcccgattcatccgattcggccgcacccggcatcaccgcgaccaaccgcgtacgcaccgtgctgttcgagtgcctgttcaatcatctggccgacgaacgagtggagtccctgttcaccatcctcggtttcgagcatgacttcgattgttacaccatcgccggataccctgcccggtccgccgcacgtacggccaaggaaatcgagaaaatcgtggccgatttcggcggtatgtgtctgaccgccaagcgcccgatcggcaacagcaccgccgtagtggcgttgattcgtccggtcggtgcggccacgccggaaatcatctgcaataccatcgccccgtcgttcgccgccgatcggccaatcgccttgggtccacagcgcaccggtgccgatggcgcgatgcgttcgattcaggccacgctctactgtcttcaggccgcgccggccctggccgccaccgtgcagccattgccgcgcccgttacgcaccgacgacgccctgcccgaacgtgcgttgatcggcgacgcggacgcccgtgacgaactggtccgcgtggtctacggaagcctgacagcagcaggccctgatgatccgacgctgctcaccgtctccacattcctgaagttcggcggttcgctcgagaccacggccaaggagctcaacgtacatcccaatacgatccgctaccgtttgaagcgtgccgccgaatccaccggctgggatgccaccgacccgcgcgaggcgtacgtgctgatcaccgccatcgcgttgggtcgtgtggccgaagcgtaacggaccgcagcgtagtcgggcagaagcataaccagcagaaccgtagccgtcaaaggccatagctgaccggacataaccgtccagcccgacagcctagcgggccgaatcaggctgcctgaatttcgcgtacgccatcgcgcagtaacgcggccaaggattcttgagtggctaacacttcgtccacgaatccaccggcggacaggctggcgatcacgcgaccggactcgttgtccacaatcggtacaccgacggcaccgacacccaacgtcacatcctcatccgacagtgcatatccacgttcgcgagtcaagcgaatatcctcgcgcaactgttccacactgaccagcgtgttctcgttatatgccggaaacggcactcctgcaagatagcgttcgacatcggcatcctcgaaatacgccaaggccacgcggccggccgcgccagcatgcagaggcagcacgcggcccgggcgcaggatcagcgaatcgatggcatgaccttgcgcgcattccacgcataccaattcagtgccggagaccacactgaggaatgaggtcatgccggtttgcgcggtgatggcatgcatgaccgcaatcgcaggctgccattcggtacgagacgtgcgagcggcatcagccaatcgcagccagtccagcgataatgagtagttgccatccgtatccgttacggcccaccccacatcgaccagtccatccagcacacggtatacggaggatcgcgggatatcacaggcgtcggcgatatctgccggagacaggccattctccgccgccaatgcgtccatcacacgactcgccttgtctaaagcgcgggtcggttcacgtttgtcttccgccatcgccgacgttccttccccctgacttatccctgactcatcgtattcaactgctcaggccaagataatcaccgctgtatccaaggcctcgcgacacctcgcggccgacagtctgcaccaattgcaccatgtcttgagccgatgccgttgccggtttcccatctaccagacaggccagctcaggttccaaggagcgggaaaggccactcagggcgattgccgcctgaatctctccggcgtgattgaataccggtacgctgatagtcacggagccggccatggtctggccgacatcataggtgaagccgcattcacgtatatgacgagcctgtcccattgctgtggtacgcatcgtggagaatgtgccgccgagctcgttgttataggcatagtgttccaacagctgctcgtagcgagccgggggaagccaggccgtcagtacatgagagggagcgctcatgctcagaggcaagctattgcccaccagctgtgcatagctttgcaatgcctcacgggtgcgtgtctcgatacacaccgtgcgcaatcgcctccgaacgaacagaccccagatgccgaactggccacgatgggcgcggaaggtacggcgagcgatctgctgaatgtccagtctgctttcgatttggccgccgatccgtacgcaatcgatgccaagccgatactcgccacgattgatgccgcgttccacccaaccgactgcggcgagattatccagcaaacgatacgttgagcttacgggttcaccagtacgttcgcttatggtttttgcagtgcttggtcccagttccgccaatacatcaagtactgccttggatttcaccaatgcatctacgctacggtcatcacggcttggcgccaccatgcgcgtcacctcctggcctgtatgttgatacctcagccatcttaccgggtattcagcgggttgccgcccaaaacgcactgggccccggcaggagtatcccgtcggggcccaagaggtttctggctcccctctttgaggggagccgtccgcgcggcggaccgggggagatccgagacgctaaggcccaaggacgcgagaaacaccccgacgcgcgggtgtcctgatatggggaaagccccttggggcgtgtgctccaaggggcttcctgtacgtgtgatgcggcggcgtgctactctcccacaccctgtcgggtgcagtaccatcgccgtgccaggccttagcttccgggttcggaatgggaccgggcgtctcacctgggccatggccgccgcaaatcttctcttatacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccccgaaggaatcggggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatccccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaactcttgttttgctcgcgtccactatccagttctcaagccaccacgcaccgccacgccgaccagaccggcacacggccggcccgcaggcacgacgggcatcgaatcgcgccaggcaaaaagcctggggtggcgatccgggagcccaaaagcgcatccataccaccccggcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaagaggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacggggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactctcgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggaacatccggcattaccacccgtttccaggagctattccggtgtatggggcaggtcggtcacgcattactcacccgttcgccactctcaccaccaagcaagcttgatggatcccgttcgacttgcatgtgttaagcacgccgccagcgttcatcctgagccagaatcgaaccctccacaaaaaaacttcatgaaaagcatccgaatagatgactctcaaaacaaaaattgacgagcacgtccttaaggaaggacgccctcaaaaaacctcacccctcatcaaaccctcccgggtacccaaccaccacgacaggcaatcaggcgaggaatgaactggcaatcattgactataaagaagtagtacaaacacgctcttgagttctcaaaccaccaccacaccagccagacgggaaaccaaccagaggaaggaacccgccgcgctgagcggcaacaggtgaataacttacacgcatgtccggattcacgcaaatcaaggcgcacaaaaaccccaggaatcgttgcaatcacacggttccctcggcgtgtcgcaaacagcctatttgcgctgttctgatatcagaataatccgttttgcattgccgatgcgtaacaaattcatgtgttcatcggcgtgttgcaagaattcgattgcgtgaccatccaggttcaccttctcgcaaccggtcatcgcatatgcaaaaagggacttccctttacgggaagtccctttcagtagctattgaagctcgctagcttcaggccagggtgttcgggtcaaccggaacgcccgggttcatcgtggaggtgatggttgccttggtcaggtaacggcccttcacggtggacggcttcagacgcttgacttcgtcggccacagccttgaagttctcgtccagagcggactcatcgaagctcatcttgccgatgaggaagctcaggttgccgttcttgtcgacacggaactcgatcttgccgcccttgatgtccttgacagccttggtgacatccatggtcacggtgccggtcttggggttcggcatcaggccacgcggaccgagcacacggcccagacggccgaccttgcccatcatgtccggagtagcaaccacggcgtcgaagtcgaggaagccgccctgaacctttgcgatcaggtcgtcatcaccgacgatgtcggcgccagcctcggtagcctcggtagccttcgggccacgggcgaacacgaggaccttggcggtcttaccagtgccgtgaggcaggttgacggtaccacgcacgagctggtcggccttacgcgggtcaacgctcagacggaacacagcctcgacggtctggtcgaagttgtaggagggcatgctcttgagcagagcgatggcctcgttggcggtgtagaggttgttgcgatcgacgcgctcagcggcttcgcggtacttcttggaacgctttaccatctgtccttctccttatcagtccgtaaccgtgatgcccatcgagcgagcggtgccctcgatgatcttcatgccggcctcgatatcgcgagcagacagatcttccatcttgatctcggcgatttcgcgaacctgcgccttggtgacagagccgaccttgtgggtcagcgggttctcggtgcccttctcaacgccagcggccttcttcagcagagctgcagccggcggggtcttgagcacgaaggtgaaggaacgatcttcgtaaacggtgatctcgacagggatgacctgacccatcttgtcctgcgtctgggcattgtatgccttgcagaagtccatgatgttcacgccatgcgaacccagagccgggcccagcggcggggccgggttggccttgccagcctggatctggagcttaatcagcgccgagactttcttcttgggagccatattatggttcttctttctataacgcggttcgaatggtcgccgtcctcaggttcggctgtctgccatcatgctcggtcttgactcattatttatccgtgcatgctgtaggcaatcggcctgtggtcggtctcctcccgcaacttatattgctgtgctgtgctagcgagtctcctctccagacacaagctttcctattatgcaaatccacccggacaacacaaaaagcccgaccacgatggtcgggctctgcaaagtttgggagttaatctagcttctgaacctggtggaagccaagctccaccggcgtatcacggccgaagatggacacgagcacggtgagcttctgagtggtgggctccacgtcggaaacaacggcggccatggtggcgaaaggcccatcggtgacggtgacctgatcgccaacggcgtaggagacctcgaccctgcgcttcttggcggcggcgggcttgtcgccggcggccttgagtgcctcggaagcaatcatcggagccatcatcgccacgacttccttgcgggagagcggcgccggatccttggtcgggccaacgaagccggtcacgccttcggtctcacgaacgatacggcgggcgttctcatccggccacatacgaatcagcacgtagccaggaacacgcacgcgggtgatgaccttcttgcccttctcggtgtgcttctcgacttcttccatcggcacctcgacctggaagatctggtcttccatgccgaaggaggcgacgcgggactcgatgttggtcttcacgcgcttctcgtagccggagtaggtgtgcagcacgtaccacttgccatcaagggaacgcagggacttggagaattcgtcaacggcctgctgaccggcatcggtctcctcggcctgctcggattcgttgacttcttcctcgtcctcatccagagaaacggtctcggtctgagtggaagcaacgggagcggattcagtcgccgccggagcgtcggactcaacatctgcattgtcgacggatgcgtcagattctgcggaaaggtcagcgaccggttcgaccggggcagctgcctcatcggcagcagcttcggaagcctcgacaacaggctcctcagccgggacggcgtcgaggttctcgagattcagttcatcactcatgcgttgttattcaccttaggttgtgcggatcagccgaacacccacagcgtggccttgcctagaccgaagtccatgccagtcacgagggccatcagcagcagcacgaagatgaatacggccagagaccagaagaacagttccttggcggtaggggtcacgaccttgcgaagctcgtcgatgatctgcttgatgaacagaccgatacgcatgaagacattcggcttgactgccttttcactcttgctcgtcttagccattccgtacctcgcgtcagctgcttgattattagaaacttggcagggaaggcgggactcgaacccacaacctacggttttggagaccgttgcgctaccaattgcgccacttccctaggtgaaaatccacctcggcgtgcgttccgtagagaacgcttcgccacggcgaaaccgccaagtcgttatagtaacggctccggtggattatcgcaaatcgcgtgtcgcgcgcgtagcacgcgactcttctcagttagcccattccttgaatcgacgcatgccttcggctaggtcttcgtcggccagtgcgtaggagaaacgcaggtaaccgggagcaccaaaggcctcgccggggacggcggccacgtgggcctcatccaacagtgcagcggcaaagtcagcggacgtatcggacactgtgcccttgggacccagcggcttgccaagcaaagcggtgatgtccgcaaaaacgtagaacgcgccggtcggagtcgggcagttgacgccctcgatatcgttcaaggcggtcacaatcgcacggcggcgcgcgtcgaaggccttacgcatctcgtgcacctcatccagcgggccggccacagcagccaaagcagcacgctgggagatgttggccacattggaggtcatatgaccctgcagcttggcggcggccttggccacctcaagcggagcgaccatccagccgacacgccagcccggcatcgcataggtcttggccacgccgttcagcaccagcaactgcccgcggcattccggcacggcggcaccgatgtaggtggtgtgcgcatcgtcatagttcaggtgctcgtagatctcgtcggagataacccaaatgtggtgctcgacggcccaacgaccgatcgcttccacggtttccggcttccagacggctccggtcgggttgttcggggagttgacgatgattgccttcgtatgctcggtacgggccgcttccagcgcctcaagcgagggctcgaagttcacgtcggcaccggcgaatacttcgaccggcacaccaccggcaagcttcacagcctcggggtagctggtccagtacggagcgggaatgatgacctcatcgccatcgttgagcaagatctggaaggattcatacacggcctgcttgccgccgttggtcaccacgacctgatcggcattgacctcatagccggaatcgcgcagcatcttagccgcaatcgcttcgcgcagctcgggcaggcccggcgtaggcgtgtacttgtaattcttcgggtcaaggcaggcatctgccgcagccttgaccacgtttgcgggggtcgggaaattcggttcacctgcgccgaagccgacaacgtcaagtccggcggccttcatggccttggccttggaatcgacggcgagcgtagcgctcggtgccacagtgttgatacggtcggaaagagtctgccattgcgccatagtcatggctcccatgctaaacctacagcacgaaaaatcgccagagccgcactatggtgatggaatctgtcgtgtgacagattccatcagtcacacgagcacgagattgtcgcgatgaaccagtgggtgggcgtactgggggccgaggaaacgcttgagttgggcggtgttacgcccgagcatctgcggaatttcttcggaatcgaagccggcgaggcctcgggccaggtgttcaccgctttcggcatcgatccagaccggatcgccggcggaaaaatcgccatgtacttcgagcgcgccggccgccagcagcgaggcacgcccgccgcgaatcgcctggccggcacccgcatcgaccacaatcgtgccgcgcgggtcggcggcgaagccgatccacagacggcgtgaggagccgcgggccttaaccggtgcgaacacggtgcccaccggatcgcccatcatcgcagggcccgcgttcgaggcgcaggtgagtaccgtggggatgcccgagacggccgccacgcgcgcggcctcgagtttggtgaccatgccgccggtgccgaccttggagccggagccggagacttggatgtcgcccagcgcatcaatcacgttgggcacatattccacacggcgggagccgggctgcgagggcggcgcagtgtacagcgcgtccacgtcggtcagtagcaccaaggcttcggcccgcaccaggttggccaccaacgcggagagtcgatcgttgtcgccgaagcgaatctcgttcgaggccaacgaatcgttttcgttgatgatcggcaccacgccgaggtcaagcagacggtccagcgtgcgttccacattgcggtactgggtggcacgaatcgtatcttcggcagtgatcagaatctggccgacgcgaataccgaatcgaccgaacgcagtctcgtagcgggccatcagtagcccttggccgacggctgcggtggcctgctgagtggccacgtccaccggccgcgagtcaaagcccagaggcccgaaaccggcggcgatagcaccggacgagaccagcaccacacgtccgcccatcaatcggacctgagccaaggccgcggccaacgcgtcgagcttgtccgggtcgaggtgaccgctcggctgggtcagcgagctggagccgactttcacgacaatggttccggctgcggcgatcatgcgccgcacctcggcctgactcggagtgctcatttattcctcggtttcaccatcttcgctggactcaccgtggccgaacaggctggtttcgtcatggcgatcgtcgtcaacggtcgggtcggcccagtggccggccttgcgttcggccatcatcgcgtcgcgcacggcggcacgggcgtccatcatctcgtggtattgggcacgacgttcggcgttggagcggcggtgcgtgcgcgggtccagctcttcgagacgcagatccttgcctcgggcaccgaggttggagccgtcgagcatttcggcaccagcggagatggtcggatcccaatcgaattcgaccatacgggcaccacgaccgatgcgcacttcgtcgccggggtgagcacccttgcggcgcagctcgtcctccacgcccagcttggccaagcggtcagccaggtagcccacggcctcgtcgttgtcgaagttggtctgcatgacccagcgctccggcttgacgccacgcacctcgaagaacacttcgccattgccgagttcgcggcgctcgaccgtgaactcaagcgcactgccgccctcgtcagcacgacgcggacggcggcccttggtctccaatggcttgatgaccacgcgagcctcctcttcggcctgctcgcggttggccacttcctcacgcatctcgtgcaccagcgcagacaacgcgaagttgagctcctttagaccctcgtgcgaggcagtggagatctcaaagaccttcagcccgagtttctcgaactccggacgcacgaactcagccaattccttggcctcgggcacatcgatcttgttcagaatcacgatgcgcgggcgttcgggaatcgggatggcacccaacggcagctcgagcttgtcggcgtagagcgccaactcgttttccagcgcgtggtagtcggacatcgggtcgcggtccggttcaagcgtggcgcaatcgatcacatgggcgatgatttcggtacgttcgatgtggcgcaggaactccagtcccaggcccttgccttcggaggcgcccggaatcaggcccggcacgtcggcgatggtgtatcgagagtcgccggcgataacgacgccgagattcggcaccagcgtggtgaacgggtagtcggcgatcttcggcttggcggaactcatcgccgcaatcagggacgactttccggccgaggggaaaccgaccaacgccacgtcggcgatggacttcaattccaaaatcacgtcgcgctcttcaccgagttcgccgagcagggcgaagccgggggcgcggcgggtcttgttagccagggcgatgttgccgaggccgccggcaccgccttgggcgacgacgcagcggtcgccctcgtggcgcaggtcggcgagctgcgcgccgggatgcttggctttgccctgttcgccgcgcgcctcaaagacgacggtgccgcagggcacgggcagaatcaggtcctcgcccttggagccgtccttattgtcgcccaaacccatggtgccgctgccggcgacacgatgcggcatgaaacgatagtcgagcaggctggtggcgttacggtcggccacgaacaccacggaaccaccgtcgccgccattgccaccgttcgggccggccaacggcttgtatttctcacgacggatgccggccgaaccgttgcccccatcgccgcccttgacatggacggttactcgatccacaaaatcactcatattgattaccttacaaaaaagccgcgtccttacgggcgcggcttgaaaaaagcttgacgctatatcgctcaggcgatgacgtcgacaaccttgcggtcgcgacgcacaccgaacttcacggagccatcggtgagggcgaacagcgtgtgatccttgcccatgccgacgttgtggcccgggtggaagttggtgccacgctggcgaacgatgatgttgccggccacgacggcttcgccgccgaacttcttcacgccgaggtattgcgggttagaatcgcgaccgttgcgagagctggacgcacccttcttatgtgccatgattcatggtcctttctataactcaggcaatcgccgtgatcttgacgatagtcagcttctggcgatgacccttacggcgagcaacaccagtcttgttcttgtacttctggatgctaatcttcgggcccttggcttcgtcgttcacaacctcagccttgacggacaccttggccagatcggcggcggcaagggtgaccttgtcaccatcgacaacgagggagaccgggaattccacggtatcgcccttcttagcgtcgagacggttcacgaggatgacgtcgccaacctcgaccttttcctgatggccaccggccttcacaatcgcgtacattatcgttccttttatgttttggaaagctaccttgcctaacacgcaccgagcttgcggtcagacaccgagtttcgaatctacaccaccatgcggactaaatcaaatgatttttgcccgcgtgtcaagcacgacacacctgttactcttccgcttactcttccgccgtgttgttggcagcgacggcagcggcggcaatctgagccagtttggctttgacgtcggcgctggaaccagccggttcgggagcgggagcggtgccgcgaccgtgcttgttggttttgacgaacgggtcgccaccgcgaagcgcgtagggatcgtcgtagtcggccgaaacggtcggctgatcatgcaggatgaaaccacggcccttgcaggtcgggcattcctcggagaacgcctcgaccagaccctggccgatgcgcttgcgggtcatctgcaccaaaccgagcgaggtgacttcggccacctgatgcttggtgcggtcgcgtgccaagcattcgaccaagcggcgcagcaccagatcgcggttggcgggcatgaccatatccacatagtcgatcatcaccatgccaccgatatcgcgcaggcgcagctggcgggcgatctcttcagacgcctccaggttgcaacgcgtcaccgtttcttccaaggacttgcccttgccgataaagcggccggtgttcacgtcaatggtggtcatggcttcggtgcgatcgatgacaatcgagccgccggacggcaggtagacctgacgctccatgcccttacgcagctgggagtcgatggaccacttgtcgaacacgtccttgccttcatgctcggccgggtcccacttctccagcttgtccttcaagtcgggggccatggtgtcaaggtattcctcgatacggtcgtagaccttgtcaccttccacgatgagcttgctgaagtcgtcgttgaagatgtcgcgcaccacgcggatggccacgtcgggctcgccctgcaggagcttcgggcgcttaccgtgccagaattcctcgcgcttggcgttgatgcgctcccactggcggaccagtgattcgagatccttgacgatggcgtcttcggatgcgccctcggctgcggtacggatgatcacgcccatgtctttcggggcgatcttggagacgatgttcttcagacggctgcgttcgcgctccgaaagcttgcggctcacgccggtcatgccgccggatggcacgagcaccaggaagcggccggcgagcgtgacctgagaggtcaggcgggcacccttgtggccgatcgggtccttagtgacctgcacgagcaccgggtcgccggacttgaacgccagctcgatgcggcgcggctggccttcgagacgagcggcatcccagttgacctcgccggcgtagagcacgccgttgcgggcctggccgatgtccacaaatgcggcctccatgctgggcagcacgttctgcacgcggccaaggtagatgttgccgacggtctgtacttcctgaatgtcggagacgtaatgctcgaccagaacattgtcttccaccacggaaatctgggtgtgatgttccttctcacgcaccaccatcaggcggtccacgttctcgcggcgtgcgaggaagtcctgttccatgagctggctctggcggctgcgctcacggcggttgtcacggcggcgctgcttcttggcctcgagacgagtggagccctccacatcagtgatctcgtcgatgtactgctgcttgcgggagcgtcggaccagcggctgttcgctgttctgactctggtcgtcggtgccctcgccgttcttgccgccacgacggcgacggcgacggcgagtaatggtctgctcctcatcgtcctcatcgcgatcacggtcatgatcatcgcgatcgtcacgacggcgggaacgcgtatcttcggcatcgttctcggcggtatcgtgctcgccgttggcaccggtttcgccgcgtgagccgcgacggcggcgacggcgcgaacgggtgcgggtggcgtcggattcttcgtcgccctcctcttcggcaatcggcgagtaggcgatatcgtccagctcgaggtcttcctcaatctgctcgacttcggcggctgcacggcgctcctgggcgttcaggcggcgggagcgacgggaacggcgagagtcggaagcgtcatcggaatcgaaatcatcatggtccgtgttggcgctggcattggcgtcaccggcggcagcgttgcgggaagcgtcacgagacgcatcacggtcggcggcattgcggccacgatcgtcacggtcgtcacggcggcggctgcgcggctgcgcgtcgtcatcatcgtggctgcgcgagcggcgggagcgacgcgacggacgttcgtcgtcgtcaacatcgtcatcacgagtgtcagcggtatcgtgcgcatccacagcggcgggcagtaccggttcctggaagagcagggacgtcatcggcttgccgcgacgcacggcctcgtggccagagggcagggattcgaccgcgtcgaacaggcgctcatccggggtgtcctcgtgcgtatccgcaactgcacggcgagaacgacggcgaaccggacggtcctcgtcatcatcatccatatccatagacgcacggcgagagcgggagcgaaccggccgatcctcgtagtcatcatcgtcggactggcgggagcgagagcggcggcgaaccgggcggtcctcgtcgtaatcgtcatcgtccacaaccgaacggcggcgggaacgtggggcgtcatcgtcatcgaaatcatcggcactgacagtgcggcgcgaacgacgaggacgatcatcctcgctatccgagtcggccactgcggaagcggcgcggcgcgaacggcggcgggttggacgttcggcggaatcctgggaatcgctggattcatcggaatcgctggaatcggctgacttggaatcggccgcagtgccggcatcgggaagcgcgggggcttcgaacagcggggcgcgttcctgcacttgcagttccagagaagcgccggcagcaccggtgccgcggaccacgcggcggccgccacgacgacggcgaacaggttcggcgggctgggaggcggcggcaggcgcagcgttcacggctgcagccgaatcggcattggatacggttgaattatcggttccgtcgttgacgaaaccttcacggttgtcagtgggcacaatgctcctcgcggcgcgctgcatcacgacgcctatttccaggcctatacgcttgtctcacaccacgctctcaccgtggccgcacgaaaacgcgccgcgtaaaggcaacttcgtctcaagtctgtcctgcgggtggcggacaccggcgcttgcgttgtctcattctcaagagccgcaaggggatcgacgccatctcgcacgctgatggttatgcagaaccaccatcctttagtatgccacatattttgtgcgggcgtggcccggcgaggctgacgttctctcggctcccctcccccgcggtgacagctcccctcagggaggggagctagagaggtgtcagaccagccagtcggtaaggattgcggccatggcggtcaggtcggattcaggcacctgctcgtcgtgcttgtgagccagcagcggatcgccggcaccgaggttgacggccgggataccgagctgagagaagcgtgccacgtcggtccagccgagcttggccagcgggtcgcggccagtgcgctccttaaccagtcggaccagatcctgggcgagcggggcgttcaggcccgggcgcgcggaggggctttcgtccttcatttcgatgccgtagccctcgaacacgccgccggtagccacatgctcgccattgccgagttcggcaccggcgtccgcgcccatcatcagagccttggcctcggccaacgacttgtccggggcgaagcggtagttgacgtgtacgcggcattcatccggaatgacgttcgtgcctttgccgccggagatcagcgtggcgttgaggccctcgcgataatcgagcccgtccacgttcacggtggccggctcgtaggcgttgagtcggttcagaatgtcggccgccttgtggatggcgttctcccccatccatgcacgggcggagtgcgcggccacgccgtgggttacgacgtcgaagcgaatcgtaccgttgcaaccgccctcgatgccgctgttggtgggctcgccgatgatggcgaaatcgccggtgatccaatcgggatgggcctcgacgactttgcgtaggccattcttttcggcgacgacttcctcatggtcgtagaagacgtaggtgaggtcgactttcggggtggtttccggcgtgcggccgtcgagcgtggcggcgaggtagagcatcaccgcgtcggaggccttcatatcggtggcaccgcggccccacagcacgcggtcttcgggatgagcgtgggcgatttcttcgcgaatcagcgaatcgccgggctccagccactttggtgggaaattgtcgatgaccggcacagtatcgaggtgcccggccaagatcacacggctcggcttgccgaagtcggtgctggccaccactgtgtcgccgtgacggcggacggtcaggtgctcttgctcgttaaggaaggcctcgacctcgtcggtgagggggccctcgtggtcggacacggagaagttctccatgatctgggtgagcaggctgttcagctgctcggcagtggatgcggtgcggttcaattcaagcgtcatgtgaacagcgtaccgcgtgggcggcgggcccagcacactcactacatgagattttgcggccgaatacatttttatgtgccacactggggtggcgaaagggaggattatgccaggtctaatcagcgccatgcaaggcttctgcgttatcggcatcgtaatcgcggtgggatatgttgccgcacgaatgcgaatcggcgggccgtccgctcagatggtgctcaaccggttctccttcttcgtatcgagcccgtgcctgatgttcgcgattctctccaaggagccgattttcgacatcttccacccctcgattatcgtggcgttcttctccgccgtgctggtaggcgtggtgtttttggtgctcaaccgtatgttcttccacctgaatgccccggacgccaccatcggtgccctgaattcgctgtacctcaattccaataacatcggcctgccaatcgccacctacattctgggcaatccggctcttgtggcaccgattctggtcatgcagcaggccatcttcacaccggtgggcctgacagtgctggacgtgaccaccaagggcaaggtctccatcaaggaaatcgccaagcagccactgcatcagccgctgcttatcggctcgctgctgggcattgtggtctctgcgatttccgctaaaagcggctggttcccagtgccgaaattcattttcgacccgatcgacatgatcggcgattcggctgtgccaatgatcctgatggcgttcggcatgtccctgcacggcaccaagccgctacagcagaagggcgatcgcccggccatcttcacggtcgcggtcctcaagaacatcatcatgccaattatcgcgttcctgctcgcctacttcgtgatgggcttccgcggctccgagctgtacgcctgcgtggtactcgccgctctgcccaccggccagaacgtatacaactacgcggcccgctacaacgtgggtctcaccttcgcgcgcgacggcattctgatgagcaccatgaccagcccggtgtttatcgcgatcatcgcggcgctgctgtcgtgatgggtgcgcagagaagcgttctcaatagtatccgtgcgcgcaaatgcacagatatcgcacaaacgaacatttgctcatccgcatatttgcggtgatttcagcgtttctacgttcgatttgcgtatacgaaagtacgcacagttgttattgagaacgattcgctgcgcagctcggctcagtcatcagcccgataatcggtcagattcaagctggccgccacatgattggacgcgaacgcgccgatggaaaccagcgcatagcacaacacaagcccgccgaagaagctggccagcgtggccggttcggtcatcgaagcggcgaacagaggggccataagcagcatggaacagccgccggccacgatcaccacgatgttgagcggggtgagtacctcgatgaatcgcgcacggttcaaggtcttgacatcagtgccctccaacaccagcatgcgatattcgccggcctgatcgtacacgctgccggcctgcatcacaccggagctgaccgcggcaagcacagcggcgaacactagcgtcaggatgccgccggtgccgatgtcgcgaatgaacacggtggacgggtcgttggcgtcatcgaccacggcggccgatccgaagaatccgcagatcgacgtgatgccggcgatgaacacggccaacgcaatgccggacacattgcgccaggcgcgcttagggttgtcgagaatacggcgcatggcaatcatcgtggccgcatccttggggcgcttggccttggccttggcgcgagcggtgaccacccacgtgccgataagattcaccagtgcgaagcacagcagcatgaaaccgatgatcacggcgtccatcaccgcctggccggcctgaggcagcatggccgggttcttgaagacgatcacagccgccaccatgaccaccacgaacagcaccatacgggtgcccgagggcagtgcggtggcggtgcgcgaggtgacgcccaatggggtgattgccacgcggcgcaaggtgaccagcgacgatatcagcgccaagatggccacgcccgccaaggtgattaccagcgccagcgggccgacccatagctgttcgaaggtgaaccgctgctcctggaagggaatcagcatgactgccggcatcagggcgcaatagccggcaatgccgataagcgcgccgatcagcgcctgtccggcggcgtcaagcgcggtgagacgcaccacctgaccggtggtcgcgccggccagacgcagggcggcgagacgggcgtcgcggcgggatgcggccagtcgtgcggcggaaccggcgagcgccacgaacggcacgacgagcagcatgcaggcgaataccgccaacgccacataggcggtggagaattgggccaggctcgtcgggtcgctgatctgccgtttccacgcggccaccgtatcgggccggcaggcaccgaagtcgaacgcgcaggcgacggtatgatcggccgaagcccgccagatgaaaccgtgtacgccgccgagcacggtgaggaagatggtggtggctgcggcgaaggcgatgattgccagcatcgaggtgtggccggcgctgccgcgcaagccggggcggtgaaacagccgccagagggcgaacgtgctcatcgcgcgcctcctgcggtggtttcgctcccgccggctggagctgccgagcgtagcgaggctgagggtggttcagcgccctcgggccacccccagtcagcctgcggctgacagcccccgccagcgggggcggagttggggttggcgtctgtctggtgcagacggccgtcctgcatcattacggtacggccgcagaacgaagcgacgttggggtcgtgggtgacgacgaccacggcggaaccgttgtcccgcgcggcggccatgagaatgcccatgacctcgcggccggtggcttggtcgagcgcgccggtcggctcgtcggcgaagaccacggcaggtttgacggcgagtgcacgggcgatggcgatgcgctgcatctgtccgccgctcatctcccccggccggtgcgtggcgagcgcgcgcaatcccatgcgttccagccacaggatcgccgtgtcggtggcggtgcggtagggcatgccgtcaagcatcatcggcagggcgatgttttcgaccgccggcagttcgggcagcagctggccggactggaagacgaagccgaagtcgttgcggcgcagtttggtgcgctcggcgtcgctcatgcggctcaggtcggcaccacggaagatgacggtgccggcggtcggcttaatgatgccggcgagcgcgtgcagcaaagtggatttgccggagccggacgggcccatcacggctaccgtctcgccctcccggagcgtgaagttcacgtggttcagggcgagcgtgtgcatggtcggcatggcgaagccgggctgggctggctgggatggctggccggcctgaatggcacccggtccggccgcagcgggattcgccgacgcataaccggctcccgtgccggctggtatcacgccggtgacgccgtgcccggcctgtgcgcgggccatgctggcggtgtagtccatgaccaggtcgtgcgcctcgatgaccggggcccactgctgggtgtgcgatgccggctgctggaactgttggggttgctgagactgctgaggctgagccgccggtcccggcgccggctgaggctgctgcaattgcgatgctgctgtattcatactcccgagcgtacggagcgaacgcccagccgaccatcgggctgcggtatgaacctttctggattaccggcccgctcctcatccgcaaggattagagatacgcaaatgattaatgaccggcaaccactattcggtgccggtcattatgagcattgcattcaggcgctacgcgcattattgcgcggtagccaactcgtccaggcgggcggcgaagcggggccagtcggtcttcatagcggtgaggagcttgcggttgggcacgtcgtcaatcgggacccagcagatttccatgctttcgtcgtcgtttgccttgggctcgacggtgtggccgggcttttcgaaggcaaacacggtggtgtaggcccacgggccgtggtcctcgcggtaggagccgaccacctcgatgtcttcgggggtgatgttggcttcctcgtagctttcgcgcagcgcgccttcgatggacgattcgccgtccgcagtggcaccgccggggataccccacgtgccaccttcggcgctccacgcggcacggtgctgcatgaccacgtgagtcaccttgccgctcgccgggtcgcggcgagccagcagaatgccggacgcaccgttggtgccccaatgcttgcggccgcaggcgcagtccacccagccatcgccgggctggtgtacgttttcgaccggcggcagaatgccagcgtgctggttgcccgatgccttgctttccggttccagttcaccacggccgacattccacaggtcagtccacgtgatgcccagttcgccggccagatgccgggccagcggcaagctgaggccgatgatgccgtgcggatcgccctcaatactgtcgatgaacgcaccaccgaagccttccagcgtgaacgatccggcgacttccagcggctcgccagtggcaatgtaccgttcgacgtcggcatcggtgaattcgccgaaatggactttggcgtggcttgcgccgcgcacggtacgcccggtcgcgaaatcgatcaggcagtggccggtccacagttcgccggtcgcgccgctcatgcgcttcagtcgttcgcgggccacggcttcgctgtgcggcttgccgtagcattcgccgcccaagaggaacatcgaatcacagccgagaatcagcgggccgactgtcgcctcggtcagtcccggctgtccggcaatagcggtggcgatgggttcggtgacggtcggcatatcgatgccggagaagtcgcgcgtggtggcgatttccgccttggaatagtcaatgggcttgccagcggcggcttcacgcaagtcttcgacggcagcttcgcgttccgaatccttgatttccttggccttgagcgggtaggcgatcacgcggtcaccggtcgcagcggcggcagtatcggccacatcacgatacgcacgatgaacggcctcggccttggccgcggccagaatcatcacgcgctgcttgatgctcaaatcgtcgacggtgacgccttcttcacgggcggccgcttccagcgcagcaggctcatccacatgcgagacgcgaattgtggggcagatacccgccgaatacagcacgtcacggcgaggcttggacttggaagcaagaattagtggaatgggcatgacttaagtccttatgctcccgctggcgggagctgtcgaacgaagtgagactgagggtggtctctgccggtatggcggaccaccctcagaccgcctgcggcggccagctcccgccagcgggagccttctcctcgacttagcgacgctcgatttcgacgccggcggtgttgatgggcaggtgaagcacacgccaatggccggaagcaagctgctccgatgcgatctggtcgatggcttcgcgggcgttgccgtaatgcagcacgagcacgcaggggccggcaccggagactgcggcggcatagcccttggagcggaagagcgcaatgagctcggtggacggcggcatcagggcaccgcgatacggctggtgcagtttgtcctgcgtggcggtgaacagcagcgcgttggactgggcctgagcggccgcaagctcgtcggcgaacgccgattcacgggttccgccagagcaagcgcacgtatcggcatcctgagccggggcagcggcgacgccggacttgccctgctgggcggcctgagccagcaccacgggattcatcgcagcgggcagcagccccacgcgagacacgttgtagacggcgtccttgtatggcagttccctaggcagcgcctgacgggccttctcagtggacagctcatagtcgggcacgaacacggcggcggtgatggacgggtccaccgggtagttgacggcgtggaatccgccgtgcagcggttcaccaccaggaacggcgaccgagccgacgccttctgcggtttcgaagtcccaagagacggtcaggccaccgaacacagccggggccacattgtccgggtgtccttcaatctgggcggccatatcgaagacggccggacggttgaggtcaccggtctgggcgaaggccgcggcggcggcgatgccggccacaatggcctcggcggaagagcccatgccacgagcctgagggatgttgttggtcgcttccagcgtgaagccgagtcggccgaggccgaacgtggcacaggcacggcggaaggtggagaccacgaggtgggtttcgtcgcatgggagggcgtcggcaccctcgccgtggatgatcacgtgggcaatgccgtcgttcgggtcgtcgttgagcgtgaaagtgagctcgtcatggtagtcgagcgccagacccacggtatcgaagccggagccgaggttggcggacgtggcgggcacgcgcacgtgaacgctattgcagattggattcatggttgttccttaaaaaggagctccctcatcagagggagcttgggtattcagctttcaccgttcgaccgcctcatcagagggagcttaggtcttgtcagtccagcacgcgcaggatggacgggtcgccggtgacgaagtcgagcgcctgcacggccttgacggtgttgcgcagggtttcctcgtcggtcaggtgggtcacgacgcgcaactgctgaatctcgccgtcgtagccgggatcggtcatggtgggcttcaggtcctggttcacaccgttgatggagacaccgttcttggcgaactcagcggcgatggcggccagcacgcccggcttgtcgtgaatcaggaagcgcacggcgaatgcagccttggaggcggtaatcggagccttcggcagattcttgtacagcgggatggacgggccggtgcagccagcagcaatgtggcgggcttcggtcaccacgtcgcccacgacggcggaggcggtcggagcgccgccggcgccacggccgtagaacatgaggtcgtcggcggcctcggccttgacgaacacggcgttgaaggagccgtgcacggaggccagcgggtggttctcgtcgatcagggccgggtagacgcgggcggagacgccggcctcgccgttctcgaccacggcgagcagcttgatgaccttgtgttcggcggtggctgcggcgatgtcgtcggcggtgatcttggtgatgccctcaacggacacatcgtcgatggtcacggaggtgtggaagccgagggtggccatgatggcggccttgttggcagcatcgtagccttcgatgtcgccggtcgggtcggcttcggcgtagcccttggcctgggcgtccttgagcacgtcgtcaaactggagacccttggtggtcatctcgtcgaggatgtagttggtggtgccgttgacgatgccgagcatgctggtcaccttgtcgccgaccaaggactcgcgcagcgggcgcaggaacggaatcgcgccacccacagcggcctcgaagtagatgtcgacgcccttggcctcggcggcggagtagatctccgggccgtacttggccagcagcgccttgttggcggtgaccacggaagcaccggattcgatggcggcaagcacgaacttgcgggccacggtggtgccgccgatgagctcgatgacgatgtccgagttggtggccacgctcaaagtatcggtggtgacgatggactggtcgatccacgggaacttctcagtttccttcgggtcgaggcaggcgacgccggtcagttcgaccgggcggccgatacgagcggacagttcgtccttctgctcgacaatcaggcgggcggtctgggagccgacggtgccggcaccaagcaggcctacgcgaatcggggtttcgttgttgcgagccaattcagggtccttccaaaaagttttctatatcccaccgctattttacggattatttccgacagcagaccgaaagtactcatcaaagctgacggtccttttcgtattatgacggatttggccgcacattacagactgtcaggcgctcgcctctgcacgtggatcactcgctgacgtcgaggttgagtaggtcgtctacggtctggcggcggagcatgacgtgcgcaccggactcgctgacagcaaccaccaccggaatcagcgcttggttgtagttgctggccatggtgcggccgtatgcgccggtaaccggcacggcgagaatgtcaccgcgcttcaaatcggcgggcaactgcacctcgtgaaccacgatgtcgccggattcgcagtgcataccgcacacacgggcaagcatcgtttcagcggaaccggtgcgattcgccagacgcgcggtgtagtcggcaccgtagagtgccgggcgaatgttgtcggacatgccgccatccacagacacatacacgcgctcggcaatcgggttgccgtcactgtctttggcatcggacaagtgcacgtgcttgatggtgcccacgcggtacagggttacgccggcgggcgccacgatgtagcggccgggctcgaagctgatggccggggcgggcatgccgagcgcacggttggtgctgttgaccgcatccgccaagcgagtgagttccacgtcaatgtccattgaatcttcgccatcggtgtaggccacggagtagccgccgccgaggtcgatttcgggcaggatgtaggcgtcggtggcccacagggtcttgcgcagcagcatcatgcgcttggccgcgtgaatgaaggcgtccgcatcgtggatgttggagccgatgtgcgagtgggctccgaccagttcgagtacgtcctggttggcgaggatggtcttgagcacggcgatggacggaccgtccgcaatggcttccatcgcggcggccagcgccttgtctgtgtcggagacttcctcgtggctcaggtcgtacgggtacttgacgtcgtagtgcagctcgcgctctgatttctcggtcttttccgcgccattttccggggaatgcgtcgcagagatacgcgcgttggtagcggcaggcgtcacgtctttgaggtcgttcagcacgtcgagcacggcggcgtcggccccggcggccagcagcggcacgccgaacttctggtcctcgtgagcagtggagatgtactcgtggccgccggcgtggacaccgacggtgacgcgcagcatcacacgggcgcgtttgccgagcttgcgggcgatggcagcaacgcgctccggctcgtcgggctcgtcgatcacgattttggcgaagccctgttcgatggccagcgcgatttcctcatcggacttgttgttgccgtgcagcaccagacgacgtccgggaacgccagcggcgagggcgattttcatctcgcccatcgtgcaagtgtccacaaacatgccggcctcggtgaccaatcgcacgacttctttggacaagaacgccttgccggcaaagctcacgtgcgtagtggaggtgttgaatgcttcggcggcagcgcgcacgaagtgcctagcacgtgcgactacttcatcagtgtcgatgagatagagcggcgagccgaactcgtcaagcagcgattcggcggtacgaccatgaaattcgatggagccttcggcattcacagccgtagcggccggccaaattggagaaataggcataatcacatcttttcgggggcggtgacgccgaggaggtcgaggccgttggcgatgacctgctggacggcgtcattgagcttcaggcgggcggcggcacgggccggctccgggttcttggcgatctccaaggccttgcgagcttcgtcgtcgccacgggtttccggatcagtcagggccatcggcaccacgcgctccacgttgtaccacttgtgataggtggcggccagttcttcgaggtaacgggccaccttgtgcggctggcggtcgtcggccgcagtggcgatcacgctcgggaactgggcgagggcggcaagtacctcgccgtcggcctcggtgtcgagcagggccaagtcggcaccctcgtagctgatgccggcaacggctgcgttgcggtccacgttcttggagcgggcgtgcgcatactgcacgtagtacaccgggttgtcgttggtgtgcgaggcgagcagggccaggtcgatgtcgaagttctggttgtagtcggagcgggccagcgagtagcgggcggcgtccacgccgaccacggagaccagatcgtcgatggtcacgacgttgccggcgcgcttggacatgcgcacgggcttgccgtccttcatcacgttgaccagctggccgatgagaatctgcatgttcttgccgggctcgtcgccgaaggccgcgcacatggccatcatgcggccgatgtagccgtggtggtcggcgccaagcatgtagatggccacgtcagccgggttttcggcgcgatggcgcttgtcccagtagtaggcgatgtcggcggcgaagtaggcgaactcaccattggacttgatgatcacacggtccttgtcgtcgccgtgcttggtggattcaaaccaagtggcgccgtccttgtcgaagatgtcgccgcgggacttgagctcttcgatggcggcgtcgaccttgccgtcggcgtacaggctgttctcatggaaccagacgtcgaagttcacgcggaagtccttcatggacttctgaatctcatcgaacatcatcggcacagcgcgcttgcggaattcctcgcgcacttcggtgtcggcctcgccgagcggttcgccgtcgtcgttgaggccttgatcctggtgggccagtgcggtcaggtccacgccgtcggactcggcttcggcctgaacacgggcggcgatctcgttgatgtaggcacccttgtagccgtcgcacggggtttcggtctggtaaccggcctcgccgaggttgttggcctcagcccaagcggcgaccagcgacttggcgaagcggttgatctgctcgccgtggtcgttgaaataatattcgcgcaccaccttggcaccgttggcctcgagcacgcgggccatggcgtcgccgacggcagcccaacgagtgccgccgatgtgaatcggaccggtggggttggcggagacgaactcgagattcagggtctggccgcccagatgggcgttgcggccgtattcgttgaccttgttgagatgcttgtcggtgtcggtcatggcaccggcggcgagtacggtgtccaccacggcggcggccgaggcggagtcgagcgtgatgttgatgaagccggggcctgccacctcgaccttggcgatgccgtcggcttcggcgagcgcggcggcgaacggctcggccagatcgcgcggcttcatgccggccttcttggccagctgcatggcgatgttggaggcccagtcgccatgcgcgcggtccttcgggcgcatcacggcgagcttgtcgacgggcggaatcagctcgtcggtcaacgcgccggcctggccggcggcgacgaggttgtgggcaatgctggaaatcagttcacttaaggcttcaggactcattcttctaaggatactgagaacggcgacacttgcgccctggtatgcctatatgctgcccctgctggcgggggcaagcacacagccgaaagataccaagcgaaaaagggtaggcgacaatcgccggaatcgttggaggctcgccgaaaccgctatacataccgtcggtcggtatctatagtgatctgcaacatcaagcacagtagggaggccaccatggcacgtaacgctcaccccgaggtgacgcgcacccgcatcctcgacgccgcacaacggctgttcatggcccagggctatgagcacacctccatccagaacatcgtggacgagctcggcgacctctccaaaggcgcgatctaccatcacttcaaatccaaggaagccatcctcgaagagctcaccaaccgagacaacaatatgcaggacgacttcaacgaatccgtcatgaatcgcactgaccttaccgccctcgaaaagttccgcgtgctatggcggcattcgatgaccaagcaagaccacgtgcagatcatgcgagccgccatgccgatgctgagcgatccggtttcgttcgccgcgaatatgcaggtatggagcaagcatctgcccgaacgcttcctgccgctgatcgaggcgggcgtcaaggatggctccatccccaccgagtatccgcgcgaggccgcagagctgctttcgttgctgccgaattattggctgatgccgtatttctacccggtgaccctgcccgaaatggagcatcgcatccgctgcttggccaccatgctcgacgcgatcggcgtgccgattttcgatgacgagctcatcacggtcgccgcgaagggcatgatgacgttcgcaggggagccggagaaaggctcagaatgaatagcacagtgaaacccgagaatgacatcgccggcaccgccacccaacgcccgctgctgtcccgcgacttcgtgctgctggtcgccggacaaggcatctcgctgttcggcaatgtgatgctgcgattcgcgatgtcgatgtgggtgctggacgaaaccggctcagccaccatcttcgcctcggtgctggccatctccatcgtgccgaccatcctgctctccccgttcggaggcgtgctggccgatcgcgtcaaccgccgcaccatcatggtggcgctcgacgccatctccgccgtgctcgtgctggcgagcgccatcgtcttcgccaccacgggcttccatatcgtagccatcgccaccatgcaggtgctgctcgccgtgctcggcgccttcgaaaccccgaccgtgcaggccgcactcccccagatgttccggcagtacggcccggccaccatgcgccaaggcatggccgtgatcaatcaggtccaacaactaagcagtctgctgccgagcttcctcggcggcgtgctgtatgcgatgttcggcatccgtctcatgatgatcatcgccatcgcaagcttcgccggcgcagccgcgctcgaatgcttcatccgcctcagtgccccggatcgcggcgacgaggagctgcccaccccacttgaagacctcaaggcaggcgtgcgattcctcatcaaggaccggccgaacgtgttcagactgctgttgttcgcggcggcgctcaactttgtgcttatcggctattccggcgtcggcttcccgtacacgattcgtacagtgctcggcttcgacgccactgtctacggcatcgccgacggcctgatcggtgtttccggcgtggcgggcgcattcatcgccggcctgttcgccgccaagctcacgatgcgctggctgccggggctgatggcgacgcttacgctggccatggtcccacagggtattgtgttcctgctgccggtcgacgcatggaccaaactcgtggtgctgatcgtattcacctgcggcacgatggtcgccagttgcttcacgaatctcatcgccgtgcccgccatccagctcagtacgcccgaggcaatggccggcaaagtgatgtccatggccgcggccgtgagcatgtgcgcccagccgctcggccagatggtgtacggctgggcctacgaccaaatgccggtcgccatcgtgctgttcatcaccaccgccctgttcgccgtgctcaccgtgctgatggttccgctcgccaagcagttcgaggactgacgatcggcgcgcacgccacatcctgccgcccggccataattgaatcaccgcacgaaaaggcacgaaaaggcacgaaagaggtacctatggccacgctcaacccccaatcattggtcacgttgtggcaaatcgaacagtatggttcgttctccgccacggccaaggccacgggttggtcgcagccggccatcagccagcagatcaaaaagctggaggcacagtgcggttcgactctggtgcaacgcacctcgcatggcgtggaactcaccgccaccggttcgatgctcgcccgccacggcgaggccatcgccgatcggctggagcgggcggcccgtgaagtcgaggattatcggcatcatcggtttgatcacctgcatttggtggccccaccgtcaatctgctctactatcgcggcccgtaccgtggtcaagctcagtatgttcacggacatcgagctgagcctgattcagatggagccgccggaggcgatcggtctgatttcccaaggcaaggccgataccgccgccgtgttccgctacagcagcatcccgaacttcctgcacatcggcgacgacctgaccttccattcgctgggttacgatccgatgcgactgctggtgcgccgctccagcggcatcgccaaacgattcgaggagaccggcgaacctgtgccgctgtccgccgccaaagacgagcattggatcgccggctgccccacctgccgcgcaaatttggtgaaactggccacccgtgccggattcaagccggatatccgccactgcacggatgattactgggccacgcagaacctggtcgaggttggtatgggcgtctcgctggtgccggcgctcgatacgcatatcaacttgcagggcgatctggtggcctgtcccattgccgacgattttgcggcgcgcgaggtcggcatcgtgactcgtgccggcgaccatcgccccgcgcttggttcattgctcgaggagctcgagcgcacgtcactcaaatatttgagtgccaagtagtcgcacagcgataagcaagcttgcgagcgccatcacgatttcggggagccagaccgttgagcagcccttctgcaccgggaacaatgacatgttatgagcatgaacaacattccccagtcaacgactttgagcaacacaaccgccggcacctcttgctttgatgccaatcacatcgacgtgacgaccatcgaggatctggagcaggtcggttcggataaatggacccgttaccccggctgcatcggcgcattcatcgccgagatggattacggtctggcaccgtgcgtggccgaagccatcgaagaggctactgaacgtggcgcgctcggctacattcccgacccgtggaagaaggaggtcgcccgctcgtgcgccgcatggcagcgccgctacggctgggaggtggatccaacgtgcatccgcccggtgccggacgtgctggaggcgttcgaagtgttcctgcgcgagatcgtgcgcgccggtaactccatcgtggtaccgactccggcctatatgccgttcctaagtgtgccgcgtctgtatggcgtggaggtccttgagattccgatgctgtgcgcgggcgccggcgagagcagcgggcgcaatgatgaatggctgttcgatttcgacgccattgagcaggcgttcgcgaacggctgccatgccttcgtgctgtgcaacccgcacaacccgatcggcaaggtattgacgcgcgaagaaatgctgcgattgtccgatctggccgccaagtacgacgtgcgtatattctccgatgagattcacgcgccgttcgtctaccaaggccacacgcatgtgccattcgcctcaatcaaccggcagacggccatgcaggctttcacctccacttcagcctcgaagtcgttcaacattcccggcaccaagtgcgcgcaggtgattctcaccaatccggacgatctggaactatggatgaggaacgcggaatggtccgagcaccagacggccaccatcggtgccatagccaccactgcggcctatgacggcggcgcggcatggttcgagggcgtgatggcatatatcgagcgcaatatcgcgctggtcaacgagcagatgcgcacgagattcgccaaggtgcgctatgtggagccgcagggcacgtatatcgcgtggctggatttctcgccactgggcatcggcgacccggccaactatttctttaagaaggccaacgtggcgttgacagacggccgtgaatgcggcgaggtcgggcgcggttgcgtgcgtatgaacttcgccatgccctacccgctactggaggaatgcttcgaccgcatggccgccgcacttgaggcggacgggttgttgtagaacagaattgcggctcccctcaaagaggggagccgaggaacggccgaattagtcgaagtcggcaccgagggcttcgagtttgccgcggaagtcggcatagcctcggtcgatcaggctgatgccgtgcacgtccgaggggcctgacgcggccaaggccgcgatcagatggctgaacccaccacgcaggtccggcacgtcgatgtcgcgtccggtcagcggggtcggtccgaagatcacggcggaatgcttgtagttgcgctgccggaaacggcacggcagcgagcccaggcactcgcggtacaactggatggtggcacccatctcgaccagcggcttggtgaagccgaaacggttctcgtacacggtctcgtgcacgatcgacaggccgttggcctgggtcagggccaccacgagcggctgctgccagtcggtcatgaacccgggatgcacgtccgtctcgatcgccacgggcttcaagtccccgcccggatgccagaaacgaatgcccttgtccgtcacctcgaatttgccgcccaccttgcggaacacgttgaggaacgtgatcatctccggctgggtggcacccttgacgaaaatgtcaccgtgcgtggcgagcgcggcggacgcccaggacgccgcctcgatgcgatccgtcagcgacgtgtgcgtgtacccctgcagttccttgacaccctcgatgcggaaggtgcgatcaacgtccacagaaatgattgcacccatcttctgcagcacgcacaccagatccatgatctccggctcagtggccgcgcccgacagttcggtcttgccctcggccagcacggccgccagtaaagtctgctcggtggcgcccaccgacgggtagggcaggtggatcttcgcgccgtgcaggccgttgggcgcggtgatgtggatgccgtccttgtgttccttgtccaccgtggcgcccagcttgcgcagcgtctccagatggaagtcaatcggacgtccgccaatcgcgcagccgcccaacgcgggaatgaacgcttcacccaaacggtgcacgagcgggccggaaaacaggatcgggatgcgcgacgaaccggacagtgtatccacgtcggccacatcggccagctgcacacgcgaggcgtcgacggtcacaatgccgttcgcaccgtccacatccacgtccacgccgtgcagacgtagcaaatcggacaccacatgcacgtcacgaatctccggcacgttcttcagcaccgacttgcccggtgccagcaacgcggcgaccatcgccttgctcacgaagttcttcgcgccacgcaccttgatcgtgccattcaaaggcttgccgccctcgacatgcaacacgtcatccggattctcagccacgccactctcctcaatcaatcaagattcaaaaaatgctaccgtccagtttgccataagccatgtgccgactccgtgaaatgcaccccagccgaactttgatcaccgtgcacaacggatcccatacccccgtcgaatcaaaccgataacgtgatcttcctcacatttgccgccacggtgttctccatacttctacgctacgattcagggcaatggcatcagacgccatggccacaagcaaaggagcattcatgaccacagtcgccgtcatcggctgcacgcacgccggcacgttcgccaccacctcgattctcgccgagcaccccgattggaccgtccatgttttcgagcgcaacggtacgctgtccttcctctcctgcggcatcgccctgtgggtgggcgaccacgtatccgacccgaagaaaatgttctactcctcccctgccgctctggccgaagccggcgcgaccatgcatatgcgcaccgacgtgacgtccgtggacctcgacgccagaaccctcacctaccgcgcgctggacgaggccggagaccccgccgaacagaccctcgctttcgacaaactggtcgtgaccaccggctcgcgcccggtcatcccgccgatccccggcatcgacagcccgcatgtgctgctgtgcaagaactgggatcacgccatcgccatcaaggaaaaggcgaaaaccgccaagtcggcagtggtgatcgggtcgggctatatcggcgcggaaatcgccgagcagttcagcgtcaccggcgtcaagaccacgctggtcgacggccttgatcgcccgctggccaataatttcgataagaccatcaccgatcaggtggcggccgcgttcgaggagcacggcgtcacgctcgcgctcggccagaaggtggtcgagttccgcgacaatgacgacgacaccgtcactgtggtcaccgaaaagggcgagtacacggccgaaatggcgattctggccgtcggcttcctgccgaacaccgacctgctcaagggcaaggtggacatgctgccgaacggcgcgatcgtggtcgacgactacatgcaggcgtccgcgccgggcgtgtacgccgccggcgactccgccaccgtgttctacaaccccaccggccagcacgattacattccgctggccaccaacgcggtgcgccagggcctgctggtgggccgcaacatcgagacgccgaccgtgaagtacatgggcacgcaggccacgtccgccgtgcagctgtacgatctctcgctcgccgcctccggcctgacccgcgccggtgccgaacgccgcgggctcacggtccgcgagacctcgctcaccgaggattatcgcccggacttcatgctcaccaccaccccagtcacgtcgattctgacctgggacccggaaacccgcaaggtcaagggcggccagttctgttccaaggccgatatctccggcgcggcaaacgtgatttccatggcgattcaggccggcttcaccatcgaccagctcgccaacgtggacttcctgttccagccgaacttcgacaagcccgtctattacgtgggtgccgtggccatgaaggcggcggctgagtaagacggctgtactcaccgcaaaaagaaaccccggcgtgatgggcgccggggagagaaaggagagaagaagaagaagaaagaggttaagttatgcagcttgttcggccgtgattacatataacaacaccagtttcaatgcaacgtgggcactggctgggaattgtctgggaatcacggcccgtacaggctgtttcttgttttggagccgatttaccggctcgccttgatcttgtgggccagctcggcgtcccacatcgcgccggttgcggacatcaccgaatccgcgccggcgtttctgtatgcctgatagtcggccggcgaaaccacgccgcccacgccattgatcttgaaatcaagaccgagcttctcgcggatcgcggccagacgggcgaccatgtcgaggccggcaccacgaatcgcattgccacacacgccggagcgatcacggcctgcaccgggcagggcctgattgccattggcatcgaccagtttggcggaaatcgtattgatggtgctgaatccctgcacagtgccgtggcccacggtggaacgcaccatgagttcaaggtcgccgtcgctggggatgtaggcgagcttgaccatcagcgggatgtcgccgatctcctgcttcacggcctcggtgatgcggcccacgagcagcggattgtggcatagcaggcggttgtggccctcgttggggcagctggtgttcatcaccatgagcttggcaccggtctccttgaccaggcgggcggtagtggcatggtcggcgatgtattcctcctcgctcatgccctccacacgcgagccttggaagctcgggaccagcacttgaccgggaccggcggcctcgatggcggcgcgcatgtccggctgccagacgtcagggctctgcgagggcacaccgaagctgttggagatggaaatcggctgttcatagttggtgtcggccagcacgccttcgtccagttcggcgctgcccggcgtcagtgaaccgtccgccgacttggggtgtacggcgagcacgttcgggaacgggttgcagccccaggcgcgcgaacgcacggttttgtaggtcgccagatcgaagcccatgcggaaggcggccgtggtgaagcggctgttgagcagcgggcctgcgggaatgccgaaaggcaggttgaccggctggcccaggaaggaggccgaggcaccctcgctggtggttccggcggcatcggcaccgttgccatccttcagcgcctcggcgaacgcgccgaacggcccttgctcatagttgtcttcgtagctgcggctgacgtcgtaaaacggctcaaaatcactcatgcttcaacgataagccaacctacatgcgtacacgcacactcaacccaccatcgcgccgtcaaacgaaataatggcgaaagcggcattggctaccacaaagatgatgaacgtcggagctgcccagccaaagtacgtgtctggaatactacgattcgtacggtgatattggcgcaaacttaaatagtgcaaacacaccctagaagagataggagggaatggcactttctcgcgttgttggtggaagtatttgggatgctaagcgagttgccgcattggaaccagacgattgcgtgaagtgaccctatacgtaaaaggtctcactggcgagagccagtgagacctttgtctgatgcgatgcgagcgacccaataatctcaatcagacacagagccaacggccctgggcctgcaattatggactcgcctttcggcgaggctcaatgctggcctcgctgctgtcgcagctcggcaggccgatcgcggctaaataatgccgcgatcggccaacggccctgtccagtctgcgtcctcaggctcgcgggcggactcgattctttcttcggcccagtgtttggcggggatggtcttgggcttgaagggaaacttttcggcgcgcatcttttcgtaggcggcgatgtcgtcctcgtgctgcagcgtcagatcgatatcgtcgtagccgttcatcagacgccaacgcacgtaatcgttgacctcgaacggcagggtcacgtcgccgcaagtgacagtgcgggtctccagcgagacagtcatctcacgaccaggctcttcctccagtagcttccacaggagttcgacggactcctgcggcataatcgcggccagcacgccgttcttggcggtgttgccgtagaagatgtcggcgaagctcggcgcgatgaccacgcggaaaccgtaatcgtgcagcgcccacacggcgtgctcgcgggaggagccgatgccgaattcggggccggcgaccagaatctggcccttaccggcgtattccggcttgttgagcacgaagttcgggtctcggcgccatgcgtagaacagggcgtcatcgaagccggacttggtcacgcgcttcaagaacacagcgggaatgatctggtcggtatcgacgttggagcggcgcagcggcacgcccacgccggtcagtgtggtgagtttttccataacaattttcctttcggggatctctcccccagtcagtcttcgactgacagcccctcgtcagagggggctcacgtgtattgactcagagatcggcgggagacgagattgtgccgcggatggcggtggcggcggctacggccggcgacgccagatgcgtgcgcgagcccttgccttggcggccctcgaagttacggttcgaagtggaaatcgagcgctcgttcggcaccagcttgtccgggttcatgcccaggcacatcgagcagccggcgttacgccattcggcgccaaagtccttgaacaccttatcgaggccttccttctccgcctgcaaacgcacgcgggaggaggccggcaccaccagcacgcggtggatgttctcggccttgcggtggcccttcataatcgcggcggcctggcgcaaatcgtcgatacgaccgttggtgcacgaaccaatgaacacggtgtccacggcgatgtccttgatcggcatgcctggcttcaaacccatgtatgtaatcgcacgttcggcggcggcgcgcttggtggcgtcggcgatcttgcccggctccggcacggcggcggtgatcggcagaccttggccggggttggtgccccacgtcacatatggaccgagcttggtggcgtcgatgtccaccaccttgtcgaatacggcatcgtcatcggtcttcagcgtcttccagtacgccacggcctgatcccacagctcgccttccggcgcgtgcggacggcccttcaggtactcgaacgtggtctcgtccggcgcgatcatgccggcacgcgcaccggcctcgatggacatattgcacacggtcatacgttcgtccatggtgaggttgcgaatcgcctcaccacggtattcgatcacgtaaccctggccgccgccggtgccgatcttggcgatgatcgccagaatgatgtccttggccgtcgcgtccgcgggcagcttgccgttgacgttgacggccatggtcttgaacggcttcagggacagcgtctgtgtggccatcacgtgttcgacttcggaagtgccgatgccgaacgccagcgcgccgaacgcgccgtgcgtcgacgtatgcgaatcaccgcacacgatggtcatgcccggctgggtcaggcccagaatcggggcgaacgcgtggacgatgccctgatcggcgtcgcccagcgggtgcaggcgcacgccgaactccttgcagttcttctccaaagtcgtcaactgcaacgcgctcgtctcatccgggttcgggcgatcgatatcaacggtcggcgtgttgtgatcctcggtggcaatgagctgatccacgtgacgcggcttgcggccggccaagcgcaggccctcaaacgcctgcgggctggtgacctcatgcatgagcatcagatcgatgtacagcaaatcaggggctccgtcgctgcccttgcgcaccagatgatcggcccagaccttctcggccagtgtcgttcccatagtgattcctccaaaaaattccgcgcgaggcattgtgttcgcgccttgttcgtggtattagcctatgtgcttgcgatgggcccggccatgagcatgccggatattgagatacggtcaaatgatggcctcaatatgactcggacccgactcgaacatgacctagtcatgactcggttccgctccagacatgtctcttcggcatccacgaacgccctttcaacttcatggccaccctgtgagacacttccccaatttgccatttcactatgtgagatggcataatcgcccttattatgactgattcccgggaagaaccattgaacaacagcttgaccgagtccgagccggttgaagacaccaccgccaaggacgatggggaaatccattccggcgttggcgtccttgataaaaccgtaaagattcttgacgcactggaatccggcccgtctacgctgggccagcttgtggccgccaccggtctcgctcgaccgaccgcacatcgtttggctattgcactggaacgccaccgtttcgtactgcgcgaccagcatggccgattcgtactcggctcccgtttcgccgaacttgccgccgcagcaggcgaggatcgtctgctgaccgccgccggcccgatcctgcagaccctgctcgatcgcactggcgagtctgcgcagatttaccgccgccaaggcgatcagcgcgtgtgcatcgccgctgtggaacgcacctccggcctacgtgattccattccggtgggtgccatgctgtcgatggaagccggttccgccgcccagattcttctggcttgggaggattccgaccgtctgcaccagggattgcgccacgccaagttcaccgccaccaagctggccgccgtacgcaagcgcggctggtccgagtccgtgaacgaacgcgaagagggcgtgtgctcgatttccgccccgatccgcaacgcctccggccaggtcatcgccgccatctcgatttccggcccgaccggccgcatgggtgccgcccccggacgccgctatgcgccgctggtgatggccgccggcaagtacctcaccgaggcactggtcaaagccgttcgctgaaacataccagtcaatccaaccgatagcccaaccggcagaaatcccgcgtcacaacgaaagagacgcgggatttctgccactaatacacagcggaaggccaccgaaacctcgaatacttcgcgccgctttccgcctctatcaggaacagttacctgaataaaccgggttacctgaataaaccggacagttgactccatagcgacggcttgcgcagcaaatcatcaccctcgccctcgccaggcgcggtttggttcaccgcataggtataggcgcgtttggaactgggcttgcccaccagttcgccaaactccagcaattgcgtacgcggctcgtaagggtgacggatatcaaattcgatcaatcgcgtggcacgtttggccggagccggtccgtacgtattgaatccgcaggttggcgtagcgataagcaacagaccctcatgttcgccgacgaaaccgttgcgatgatcatgaccagctacgacgccgaaatacccctcgcgcagcaattcgaattcgcctgacgtatcagggcaggatatgccttctcccaaatatccgccgggctgggtttgcaattcgtccagcacgtagtaggtatcggcgtgcgaacgatagccctgcatggcaaacgccgcgttggccgccaccggcttcagcacgttgtaatactcgggcatcggcatgtgctggaacaccattgatttcgcaccgatacggtcgggcacggcgttcaggaaggcgagcgctgcgggcgatggtgcgccgaagccgccgccatgcacgtaatcgccggagtcaagaatgaccagacccagcacattgcgcgtatggtcaacgtccataaccggcagcgcgaaggtgcctggttcaccggaaccagtggcaccagacagcgtctgcacagcaccacccgctccacaggtgtatgcaatctggttcggcaaggtctcactcggcggattgacacaaccggggaactcacgatagataccgtccagttccgcattgcttagcccgcattggaaatcatggttgccatacgtcacagcccacggaatgccgcgcgccgccaacggctcagtgaactggccaatggccttgcgcaccagcgctcgggtatggttcagcgcggattcggcaataggttcgtcacaccagcgacgtttacggaatgaatcggcgaacgccggatcgtagccggcgatctggttgccggagaaaatcaccagatcaggccgtgtggcatcaaggctggcctcaatcagggtgatggtgtctttggagactttcggcccatcctgaatgtcggcaatctgcagcacgcggaacttgccggaatagtggaattgcagtcgtccgagacgcgcagagatagagaccggacggccgtcttcggcatcggccggcttgatacgaggtttcgacgacatcccctctggcgtacgctgtgtttccgtcatgccctccactgtacacacaaacgaaaaggcccgccggagcgggccttttctacaagttcaactactggagcagaatctctgcacaacatcatcgttgtaacggtaagtctttccaatgcccgtccaacgtaacagtcctcgtgaccatacactatttgtgggctctgctctgttcagttgttcttgtacctcataatctattcatcactcccgtttctcgcaacctgcagagagtcgttgtgcgttttttatcacaactgttcaatcgcactttctggctatcggaaaacgagctgaaccgttcacatcgaacccgtccgatgttcgatttcgttcgtttcaccgccgctcacggcgtgtcgcgagcgacgctagcacactcaaaaccaaccaacaccgaactaacatgaacacccgttgaattctggcgcgttcagtcgttttccggccacgccaaagcttacgatataagctatggcacagatatttgacgcaccctcgaaggcaattctgcgcagccaaatcgcagagcatattgccgaaaacgacaacaacgaccgccgcgtcgatcaggaaggcgaggcaccgctgcccaaggaccgtttcttcgaccgcgagctcagctggctcaagttcaaccagcgcgtgctcgaatgtgcggagaacgaagacatgcccctgctcgagcgcgccaacttcgccgcgatcttcgcctcgaaccttgacgagttcttcatggtccgcgtcgccggcctgaagcgccgtatcgactcgggcatcgccgtgccgtctgccgccggcctgagcccgcgtcagcagctgcgcgcgatcagcgagaccgcacaccgtctgcaagacgagcacgcacattacacgatcgacaccattctgccggaattggagaaggagcgcatcgtcctgctgacgtgggacaagctcacatcctccgagcaggagcgcctctcgcgctactaccgccagcaggtgttcccggtcctgacgccgctcgccgtcgacccggcccacccgttcccctacatctccggcggctccatcaacctggccgtgattgtggagaacccggcctccggcaagtcgcacttcgcccgcgtcaagatcccgggcaacctgccgcgcctggtgccggtggacgacatgaccgacgaggagtccaaggacgagcgttacggcttcatcgccatggaaaagctcatcgccgcgcatctggaatccctgttcccgggcatgatcatcaaggaagcccgctccttccgcgtgactcgtaacgaggacatcgacgtggaagaggatgacgccgagaacctgctcaacgccatggagaaggagctgctgcgccgccgcttcggaccgccgatccgtctggagatcacggacaccactagcccgttcctctcccagctgctcgccgaccagctcggcgtgagccaggacgaggtataccgtctgcccagcccgctggacctgaccgtgctctttgagctcggcagcgtggaccgcccggacctgaagaaccgtccgttcgtgccgaccacgaaccgtcagatcgccgaggtcgagtcctcccgtgcgcaggacattttcgccgccatccgcgagcgcgacatcctgctgcatcacccctatgactccttctccacttccgtgcaggccttccttgcgcaggccgccgcggacccgaaggtgctggccatcaagcagaccctgtaccgcaccagctccaactcgccgatcatcgacgccctgatcgacgccgctcatgccggcaagcaggtgctggctttggtggaaatcaaggctcgtttcgacgaggacgccaacatcgcgtgggcccgcaagctcgaacgcgccggcgtgcacgtggtgtacggcatcgtgggcttgaagacccactgcaagctcatcgaggtcgtgcgtcaggaagcggacggtctacgccgctactgccacgtaggcaccggtaactacaacccgaagaccgcgcgactgtacaccgatctgggtctgctgacctgcgacccggtggtcggccaggatctgactcgtctgttcaaccagctctccggttacgcgccaaagtccagcttccaccgtctgctggtggccccgcgcaccgtgcgcaccggtctaatccagcgcatccgccgcgaggaggacgccgcccgcgccggcaaggaggcctggatcaagatcaaggtcaactccatcgtggacgagaagaccatcgacgccttgtaccgtgcctctcaggccggcgtgaagatcgacatcgtcgaacgcggcatctgcgctctgaagcccggcgttcccggcctgtccgagaacatccgcgtgcgttcgattctcggccgcttcctggagcactcccgcatctacgccttctgcaacgcggacggcccgcagatcggcgagggtccggcttccggcccggaggtctacatcggttcggctgacctcatgcaccgtaaccttgaccgccgtgtggaggctctggtgcgtgtcaccgccccggagcaggtcgacgggctcatcaagtacgtggacctgcagatggccgactccaccatgagctggcacatgcagcccgacggcacgtatgtgctgcacaccaaggacgacgagggccgcccgctggtcgacagtcaggaatatctgattcgcaagcaccagcgccgccccaattcgcacaactgatttcattcgatgctccctgtcagcacgagctgactgagggtggttacgatgcccggctcctctttcgagaggatgccgggcatcgttgttcagcgcgcaaaaactacgtagcagcggtccaacgtgacctacaatacaagagatgggtacgaacagtatgagacgaatcgtggaagccgccggcggtattctgtaccggtggaaggatgatgccgagccgacgcgggcatcatctccatcagtgaaatccaatattgccaccgatggcaccatcatcgcgaacaccacggattctgacggcgagaccacggcagcacccggcgcatcggacgcggcttccaccccggacccggcgcaggccgacagcccagccacagcggacaacgtactcaaccgcatcgaactgtgcgtcgtgcatcgcccgaaatacgacgactggagctggccgaaaggcaaggtcgacccgaacgaatcgcaccggcatgccgccgtacgcgagatcggcgaggaatcgggcctgcccgtggaacttggcccctatctgggcgacatcgagtacccgctgtccgaagaaggcagcaaacagcgccataccaaggatcggtcggcggataccaagcatatccagttctggatggccacgccgatcagcgccatcgacaacctgcggcgtacccatgcgtttggcccggtgcatcgggcggacatcggcgaaatcgacgaagttttgtggctgacgccggccgaggcccgcaagaagctcagccattccaccgataaggacatcctcgcgctattcgttgatcgggtgcaggagggcgcgcttgacgccgtgccggtgattatcgtgcgccacggcaaagcggaagcgcgcaagctgtggaagggttcggacgcgaaccgtccgatcacgccgcgcggcgcggctgcggcatacgcgctgaaccgcgagctggcgtgtttcaatccgacccgactggccacgtcgccttgggtgcgctgccaggagacgttggagatgttcgcgtggcagaccggacgagacatggttcatctcgatccgctcaccgaagatgcatacgccgctgcgccggacaccgcatgggagtgtctactcagcgaaatcgagttcgcacttgagcgccgtcagcccatagcgatatgcatgcaccggccggtgattggtggtatgttcggacacctgcgcagcatgtgcgttgcgccgtctctgagcaaacgcctgatcgccaagacaccgttcatgccgaccggcacggcggtggcgctgttcgtcactccgacgcctcatggtcccaaaatcatcgatattcagaaggttcaaccgcttgtctactagacccgcattccctgattcatccaactcctcggccgctgccgccgcagctcatgccgcgcacaatggtgccgccggcagtctgggcccaggcttcggctcgttgcgtgcggccggagcggcattcggacctgctcgcatgggttcttcgcgtccttcgcgcccggctcagctcgacccggctgtggccgatggattggccggcggcatggacccgcaagcgttgagcgagatgagccatctgtccgctgccgcattgctggatcgtgtgcgccatagcgaagacccggcggttgtcgagcgggtgctcacgttggtggagacggtcggcgtggatgaaatcgccgaactatggagcgatgctgagccggattcgctgcctggtgtgctgtggcgactgtatatgttgcgtacgtggatgcgatcgaatcgcgactcaatcgcgcatctgtggcgcttgggtgagccggtggccactaccgcctccgccatcgccggcgtggatcaggctcccaatgaagatgacatcgtgcgattggccgattcgattctctccggtgcttttgtgggcgattttgccgtggcgcttgagcgtgcggcggcgtttaccgatgtggtggcgttgggattgcgcgtggaggcgcggcgcatggtgacccgggccgaggccaacggcggcttctcctcggatgtcgatgagaaggccgtgcgcaccaaagccgcccgccttatgcacaccgccggcagcctcatggccaccgccaaggatttccaacacggtgccaacctctggcgtcgcggacggttggagtaaccccgctccaggctccctctgatgagggagccgtcacgggcgatgcccgtgactgagggagaaacccaccgaccgcaccccaacaatcagctaccgcccaacaccaccccttccccggcgcggcgagacctatcgcaagctatactaagtatccgcgtcggaccgtgcttaagccccgggctccattttttgccgccgcgagcggcccttgcgccgacaggcgctttcgcggttcggcgcttcttttttttaccagattcacgccccgagcgttgcgatgggcacgaccagtatgccgtcattgcggcgataggccttcccacctcggccggtaaggaacatcatgaactctggttcgcgaacttgggccatgggattgccgcagattttgttgcggaaggatttgagcttatccgcattgtcatcgttcaccttaaggtcactgagttttatttcgatggcaccccacctgccgtcagacaactcgataatgacatcaacttcaagccccttgtcatcgcggtagtaggcgatgcgattgttcgcgcccggcatggccgacagatatacattcaaatcacgaatgcacagcgtttcaaacagatcgccgagcgtctgtgtatcccgcatcagcgtcttcggcgacgcacctaaaaccgcagcaggcaacgaaggatccacgaaatatcgcttgggcttggttcgcacacgactctttgcgcggagtggcggttcccaaccctccaaatccgtcagcagatacaagtccttgaacatttccaaatagctcttcaccgtctgcgtatccggctcgcgccgctcatcgccatatgccatatccgcagccagcgtcgcatattttggtgcctgcgagatgttcacggcaagagctcgcatcaaagctcgtgcagtttcaggattcttcttcatcttcggcacgctgatatccagcacacttgcgatatattcgcccgggatttccaaggcgaattcatcgtctagctcaagatttgcgggccaaccgccacggcaacaccatctggcgatgtcttcgatactcgtattgcattcggcaggctcgaatttcccctcgaacaaatcggataggctgaccgcgcccgtggattctccggattcagccaagctcatgggccacatgcgcagacgagcaatgcgaccagtgccgctgtgatgaatggcgtcacgatcctttggaatagccgaacctgtaagaatcagctgccccttgcggttcgcattgtcatctatatggcgacgagcggcatcccaaatttgcggtacatcttgccattcgtccaccagatggggctcctcccccatcagcaccaatgcaggatcggtttgggcggccgcgaaaactgccacatcatccagacggtcaacgcttcgagaccgggagagcgcggtccatgtcttgccgcaccatttcggcccaacgatttccaccgcaccgaacgccttgagcagtttgcttaatctgctatctaccacgcgtgaacgataatcaggcctggtcaaggtaccatcgcgaccactcaaatcgttcatattgcagcctttcccagttctatcgttctaacaatatagattttacaccagtttcattcccgattttacacctatctcattcccggttttacaccagtttcattccctgttttacaccgtgttgttttttacgctttaccctctcagaggtatcagaggcagatctcggcacggacagggcattgtcctgctgcaactggcctatcgcagcaaaaagtcgaatcacccacaaatccaatccgataagcaagccgcgccattaccaattcggcaggtcggcaaacttggactaggctgggaatcatggaactccatgttttgaatcatccgctggtcgagcacaagctcaccgtgctgcgcgacaagaacaccccctcctccaccttccgcgagctcgtctccgaactcgtgatgcttgaggcctacgaggccacccgcaacctgtccgtggtggccgcgccgatcgagacgccggtcgccccgatgaccggcaagaagctcgcctccccgcgcccgatcatcgtgccggtgctgcgcgctggcttgggcatgctcgacggcatgacccgcctgattccgactgctgaagtcggcttcctgggcatgaagcgcgacgaggagcaccccacccagcaggtgacgtacgcgaaccgtctgcccgaggacctgtccggccgccagtgcttcctcatcgacccgatgctcgccaccggcggaacgctggtcgccgccacgcactacctggccgagcgcggcgccaaggacgtgaccgcgatcaacatcatcgcggcccccgaaggcatcaagtacgtcgaggagcacatcgacccgtccatcgacttcaaggtcgtggtgtgcgcggtcgacgaacgtcttaacgacaagtgctacatcgtgccgggactcggcgacgccggtgaccgtctctatggcgtaattgactgatttccctggctcccctccccgaggggagccaacataacggaacatctatgcaaatcgacattattgcgccggggcgcgtgaaggagcgttaccttcgcgacgccattgacgagtattccaagcgactttcgcgctactgcaagctcaacatcattgaagtggcagatgagaaaacgcctgaccatgcctccgaaggcgttgaccgacagatcaaggccagagaaggcgaacgcatcgccaagcatctgaaggacggcgcgtttgttattgcccttgccatcaatggcaagcagctgtccagtgaagaattggccgccaaaatcaacgaccttggattgcgtggcaccagccatattcagctggtcatcggcggttcaatcggccttgacgacgcgattctgcgtcgtgctgattttctgctgagtttctcgaagatgacgttcccgcatcagcttatgcgcgtgattctgctggagcagatctatcgcgcttataaaatcaacgctggcgagccgtatcacaagtaaaacgccatacctcatggggcgggaaatcccccatggggcggtaattgccccatgaggcggcaaaatcctcatggggcggtatgccaaaatggcttaattccgcggtttcacatattcttcaaaccgccccatgggcaagttaccgcccgatgagcctgtaaccaccccatgggcgcatcaataacgccctcaacctcacactgcgtcggggacgaacgcttcgaagatgtggcggtcgaagtagggggcgcactgggcgagttcatcgctgctgcgcacggtccatgaaaccggcatcgcacccatcgaacgagcgagcttgacttgcggcgaagcgccaccagtccagtcataagccacgaaatcaggacgagacagccagtcgaacgccagtaagccggcggcccattcagccgcaccattcttgctcagcttcgccggccagctcagctgaccgcggcacacctcagggtgatgctccttgtaccaattcaccgcgcccgggtggaaggattcgatcacgtacgggccgtcatacgcctcaagcaaggcgtggcccttttccatgagctcttcgctacgctcatcccaagccctgttgttgctgaacttgtattccacaatcagcggagcccggccggccaccacgtccagcacatcggagaacagcggcacatgctggtagtaccccttcggcgcggcggacggcgtgaccaccagcggcgggttcgcgtcggcacccggcaacggttcggccttcaaatcgcctgactcgccgttcgggaagagcggaatacgggcgagttcgtcgtaagtcaggtcttcgatgcggcgcggatcgccggccacgcgcaacaaatcggcgtcatggaccacgaccacttggccgtcgagcgtaagctgcacgtcgagttcgatgccatagccagcctcgcaggcggcggcgaacgcggccagcgagttttcgggagcaatcggaccggtcatatccgcactgccgtagccggccttgacagccatgcgacgggcaagcgacacataatcatcgttttcggcgatggatcgctcagtggtatcggcttgggcgctaaccggattatccccaccataatcagcgatatcggtatagccgaccaaaccagaacccgcatcatgcaagccacgatgggcataccatacctccggaatggagggcacgaaattacgacgcttgtcattgaacgtgcgcggggccacggcccacacggcagcaccggcggcggccacgcctgccagcgccacgtttctccagagcttcgacgacattggaatccttcctgttgggctgcctctagcctaacgcttctgccagccattgtggagtggttggatcatccggtttcagcgcgcggtccaggtggttggcgcgcagtggctcccagctgaaatctgccagcagatcggcgggtttgcaaggaattggagtgggttgcagacgcagcagccaggcgcagtatccgatgatttgctcgggggttacgttgcgggcgcgcaaggctcccatatccagcgaacgttcgcgcttggctaaacgccggccggccgcattgtcgataagcggcaggtgcgcatactcggggtgctcggcgagaggcttttccgtgttgccgcattccggctcaaagccgccagccaacagacactggcgaatccacatttgcagcgcggtggagcgcagcagatcacggccgcgcacgatatcatcaacacccatatcgaggtcatccacgaccacgaccagttgatagccgaacagtccatcggctcggcgaatcacggaatcgcctacctcgcgggccaaatcgtagtgctgtggactatagacacggtcgttaaagcatgcgacaccatcaacgattccggcatcgccctgctgttccggcggcacggctcccgacagcgcagcggaatcgtcaggcactgtacgttgcttttctcccgctgccgattccggcatggcgatacggatggaatgctggtcgccgcgaaccaaacgggcacggacctcgtcgggatggtcgtgcagcaggcggcggcacgtgccggggtacaccatgaagccgtcgccctcgttgggggccgaggcggcgcgaatgtcggcacgcgagcagaaacaggggtacagcacaccttgcgagcgcaggcattcgagagcgtattcgtatcgttcagtgcgctgggattggaacatcggttcgccatcccagtcgaggccgagccaatgcaggtcatccatcatgagctggtccgcaccggcgaccacacgcggcttgtccacgtcctcgatacgcatcagcatgcggtcgccacgcgagcgggccgaaagccatgcacccaacatggcgtacacgttgccgatatgcatgcgccccgacggcgtcggcgcgaatcgtccagtcactggccctcctcgtatgaagttcagcaccatggtagcgaaaaggctctcctcctcagaggagagccaatatagtgaagctcgccagcccgaactcccctcagtcagcttcgctgacagctttgctcagagaggggagccagtgattgtcacttgtcttcggtgacgttgtccacgctcacgtccggattgtcggagacaatctggtcgctcgcccaagcggagagctccagatgttcgccgccggtctggtcgacgagcacggtgtcaccgtcgtggaccttgccggccagcagcatacgggccagctggtcgcccacttcggtctgtaccaggcggcgcagcggacgagcgccataagccgggtcgtaaccggtgttggccagccattcgcgagccgagtcggtgacgtccagcgtgatgcggcgatcggtcagacgctgggacacgccagccacctggatatccacgatgccgccaagctcctcgcgcgtaagcgggtggaacatgacgatgtcgtccagacggttcaggaactccggcttgaagttcatgtggacagcgtccatcacggcctttttcttggcgtcggcgtccatgtcctcgttcacgaggaactgcgagccgaggttagaggtcataatcaggatcgtgttcttgaagtccacggtccttccctggccatcggtcaggcgaccatcgtcaagtacctgcagcagcacgtcgaagatctccgggttggccttctcgacctcgtcgaacagcaccacggaatacgggcgacggcgcacggcctcggtcagctggccgccctgctcgtagcccacgtagcccggcgccgcgccaatcaggcgcgagaccgaagccttctccatgtattcggacatgtcgatgcggaccatggccttctcgtcgtcgaacaggaagtcggcgagcgccttggccagttcggtcttgcccacaccggtggggccgaggaacaggaacgatccggtcggacggttcgggtcggagatgccggcacgcgaacggcgcaccgcgtcggacacggcggcgatggcttccttctggccgatcacacgcttgccgaggtagtcctccatgtgcagcagcttctcgttttcgccctgcatcaggcggccgacgggaatgccggtccagtcggagacgatctcagccaccgagtcggcgtccacacggtccgggaccatcggctcatcggccgggttggccgcgctggcatcggcagattcggcatccgcgctctccgcggcggcaagctccttctgaatggacggaatctcgccgtacagaatcttcgaggcctccgccaagttgccttcacgggtatacttatccgcctgcacgcgcaggtcgtcgagcttggcacgcaggtcgccgaccttgttgtggccagcctgttccgcatcccaacgcgccttgagaccgctgagcttctcacgggtgtccgcaagttcggcttgcagcttgcccagacgctccttggacgcaggatcctcggccttcttgagctgcatttcctccatttcaagacgggtcaccttgcgctgcagctcatcgatctcctcaggcgaggagtcgagctccatacgcaggtgagcggccgcctcatcgaccagatcgatggccttgtccggcagctgacgacccgaaatgtaacggttcgagagggtcgcggcggcaaccagcgcgtcgtcgccgatcgttaccttatggtgcgcctcgtaacgctgcttcagaccacgcagaatggcgatggtgtcttccacgctcggctcacccacgaacacctgctggaaacgacgctccagcgccggatccttctcgatgttctcgcggtactcgtccagcgtggtcgcgccgatcaggcgcagctcgccacgggccagcatgggcttcaacatattgccggcatccatcgagccttcggccgcacccgcgccgacgatggtgtggatctcatcgatgaaggtgatgatctgaccatccgcattcttgatttcgttcaggacgctcttcaggcgctcctcgaactcgccacggtacttcgaaccggccaccatggagcccaagtcaagggagatgagcttcttgccttgcagggtggtgggcacgtcgcccgccacgatacgctgggccaaaccctccacgacggcggtcttgccgacgccgggctcgccaatcagcaccgggttgttcttggtacgacgggagaggatctgaatcacgcggcggatttcctggtcacgtccgatgaccgggtccagcttgccttccttggcggcggccgtcaggtcggtggagtacttctctagggccttgtacgagccttccgcgtccgggctggtgaccttcgcgccaccacgcacgccgggtacggccttgcgcagggaggctgcggtgacgccgttcttctccaagatttcggccgactggttcggcttgctggccgcgatgccgataagcagatgttcggtggagacgtattcgtcgcccatctgctgcatttccttctcagcctgggcgatggcggcggtcagctggcggctggcctgtggctgcgaggtgctggatccggatgcgctcggcagcgcgaccaaagcgttgcgcaccgccgcgccgatggcctgcgggtccccgcccgcggcctcgatcagagagcgcgccacgccgttttcctggcgcagcagcgcatccatgacgtgcagggtctcgacctgcgcgtttcctgcggcggacgcactctgaatcgcgtcgccgacggcttcttgggccatagtggtgaacttctgttccatatcgtattcctccatatcatgcggtctgcgcagtgcggctcgcgggcttcgaaagccctgcgagcgttgcgacagaccgcagcttgtcgttgtctgatatggtcaaccgacctggaacccattctattcccaaaacttgagtgcatatgactcaagttttggattttggtggggagggtgactagtagccccctctgatgaggaagcttgggcagccgctacttcagtgcgccgacggcggattcggcggcggcgaggacttcgccggagagaatcgcctcggccacgccctcaatctgcggggtggtccaggtatcgcgtacgtcggggccgatttcgttggcgtactggcgcaccacgcggtatacggcggcgcccgccgcacccggacggtacggcttgcggaagtcgaaggagcggcaggagcacagcagttccacggccagcacgcgcgcaaaggccggaatcgaccggcgcagcttgcgggcggcggcccaacccatcgacacgtgatcttcctgcatggcggagcttggaatcgaatcgaccgaggcaggcacggcgttacgcttcatttcggagacgatgccggcagcggtgtattgggcgatcatgaaaccggagtccacgcccgggtcaccagccaggaacgccggcaggccgcggttgcgcgccacgtcaaggaagcggtcggtacgacgctcggagatagaggctacgtcggcggtcggaatcgccaggaaatcgagcacataggccagcggcgcgccatggaagttgccgttggactccacacggccgtccagcgtgacgcacgggttatcgatggcggaggcgagttccacgcccgccacggaggccgcgtattccacggtgtcgcgggcggcgccgtgcacctgcggggtgcagcgcagcgagtaggcgtcctgcacacgcacggtggagcccgggcggccggcctcaatcagaccagagtccttgagcatgcgggcgatgttcgcggcggaatcgccttggccgcgatgcgggcgcagcgcctgcaagtcggcggcgaatacgcggtcgttgccgagcatgccttccacgctcatcgcggcggcgacatccgcggtcttgagcagcaggcgcagatcggtgatggccatacacaacatgccgagcatgccgtcggtgccgttgaccagcgccagtccttccttctctttcaaatcgacgggcgtgatgccggccgcacgcagcgcttcgccgccgccgatcttgaggccgtcagcgttgcgggcctcgccttcacccatcgccaccaaagcacaggctgcgagcggcgccagatcaccggagcatccgagtgaaccgtattcgtagaccaccggggtgatgccggcgttcagcatatcggcgtagacctgcgcggtttccgggcgcacaccggtgcgtccggtgcacagggtgctcaggcgcagcaccagcaggccgcgcaccacctcacgctccacttccggtccggcaccggcggcatgcgagcggatcagacttttctgcagctgcgcgcgctgttccttggggatggaggtggaggcgagcgcgccgaatccggtggagatgccgtaatgcggcacggtgtcgtcggccaaatgatcgataaccgcgcgactcagcgccatctcatgcttcgattcgtccgaaatcgccactttggcgccgccgcgcgctacggcgataacgtcctcgatgctcagcgctccaacacctacggtgaccgtctgctctgccatgctcatacctttctatatacgtgccgcattccgcatatacggcatatgcggcacatgcttcgccggggatccgcgactgcccgcattcgctcaccgcacctgcccaccaacagcaggcgacgcaaacgcgaccaatcgctccccgagtaatcaaaccttggccatttcacctcagtcggatgcccgccataagccacttcgtccatcttgtgtctgaaatctcagacatgtaaggtgatggaaatatgagccatgcctcgcagcaatacgccttcaccgagccacgtaccgtcaagcgggcgcaggtgaagccatcagaacgggaacatcagacatcatcatccgcgccacgtgtctcgctggctccggcggccgaccgtacgctcgacatcctcgagttcatcgcgagcaatggtcagacgcaagccgccacgctcgctcgcgaactcggcattccgcgctccacggtgtaccaattgttggagattttggagcgtcacggactggtcacccgccttgccgagcagcgcgcgtacggcatcggactcaagactttcgagctgggatcggcctattctcgccaacatcgtgtatcgcaggtcgcgcatccggtgttggcgcgtcttgttgacgagaccggcgaaaacggacatctggccgtgctgcacggcaacgaaatcatttatgtgattgaggagcgcgccgcgcatcgcccgccgctagtgtcaggcgtgggcgtgcgcctacccagtcacctgaccgccaccgggcgggccattctgtccgcactcccccgcaatcaggtccgcgcgctatatcccaatcgtcaggcgttcaccgaccgcaccggcatcggccccaaatcgcccaaggagctggaggcgacgctcgccgaaacccggcgcaccggttttgccgaggaacacggcgacgtgacgcccggcttcgattcatacgccgtcgctgtgcgcgactacaacgatttccccatcgccgggctggctctcactttcgtgagcggatcgctgcgctccgaacaggagcggtctcttaagaccaagctgcggcttgccggcgcggaactgtcccggcgtctcggcgcggtcggcagtttgacatgaggattcgcgagatcatcgtgttgggctccttcgccccgatcacgattttctcaactaagttcaccgattcgctgaccggcaacgccaagctcgccggcttctcgctgacagtgacggccatcatcagcctggtggtgatgaccgccctgcacgcacttctgccgggagcgtaaggcgcgttcttgttctccgcctggacggttcccctcagagaggggaaccagaacgagtcacgcccgaacgattacgttgcgcagatcaccgatgccttcgacgtgcacgatggtctcgtcgcctgggtcgaggtggccagaggcgttcggggtgccggtcatgatgacgtcgccaggcagcagcgtggagaacgacgaaatcgcggcaatctgctcggggatgccgtgaatcaggttcgcggtggtgccagacgccatcggcacatcctcgccgttcagcgtgaaggaaatcttggcgtccttccagtcgaggtcgtcacgcatcacgatccacgggccaagcgggcaggaggtgtcgaagcccttggctcgcgtccacgtggggtcgatgccctgcagatcgcgcaacgtcacgtcgttcacgcaggtgaagccgagcacgtaatccatcgcgttttcaacggacacgttcttggcgatgcgtcccatcaccacggccacttccggctcgaagttcatgtccttggagcaggccgggtacacaatcgggtcgtcggggccgattaccgaggtggacggcttggtgaagatcaccatgtcctccggcgcgtgggcgatttcggagtggccggcctcgtgcatgaactgggcgtgggcctcgtagttcttggccagaccgtaaaccttggaggggatcaccggggaaagcaggcggatgccgtcgccgtcgaccgggtaacgagtgccggtgggcttgacctggtcgccggccagcggatgaccgtcgagttcgatgaggtagtccttgccgtccgtttcgtccttttgtacgaaggcgtagcgcggcgaatcattcaaagaaaaacgtgcgagtctcatgcctgtaagcctactccttggcggttccttccgcagaagcatccgtccaaggagcaagcagaccggccttcaatcgaccaaaacgcacgttcgctgggattgctacttttcggtccaggttttgtcatacagcgactggccgctttgcgtgtgcatgatgacgcgcaatgatgccttgccgctggaggtcttgcacatcgagcccagcagattcgcggtggattgataggtgctgtccatagcatccagtgaggaagcgaaggtatcgcctagcgaggcgtagctgtcgtcgagcacgtactcgtacaccaaggtgtcaccgtcgacacggtagttgaaggtgatgccggtgtctgcaaacgtatccgcttcggattcaatggagtccttgaattccaaagagtcgacgaaatcctgaatcgaatcgtacagcccataatcgccgtcggttagatcgtcatgggtttcgcccaacgtgtcgtccagcacatcgtcaagattatcttgagctttgctcttatcgctgctatcaccgttgcccgaagaggactgactatagaaggaatcggttttcgcctcatctatagccttgctggcatacgaggcaccgccgacgatcagcgcgatgaccagtattacctgtatcaccatgcccgccgcactgatgatgatgccggcgatggccaagcccttgcccttgccgccctgtttcttaatctggttgaggcccacgatgctcaggatcagaccgaggagtgagacaaggaacgagcagataaaaccggcaatagccagaccgttgtacttctggttcgcttcaggcggcacactgccgtaagaaccagaccatcccggctggccgttcggttggccgccttgcatatacgggttatagggcgtttgcggaggcacggccccgccgcccggatataccggagcactgacgctgccgtagaccggaggaaccgatccgcctgccggagccgcccccggatagggcgcgggcgctgccggtgcgggcgcgggcgcagcggcaggagtcactggtggcaaagcctgcgtaggcggtaccggctgattggccggtgcaaaaggctgggtgggctgctcggcaggtgtaaacgcctgtgtaggctgctcaacaggagtgaacgcttgagtggactgttcgcccgctgcgattgcttgggttggagcattgttggcggcggttcccgtttccgccgtcatcgcatttaacggctcagtcggattggcgtcagcttgctgccacggcacctggccgttcggattgacattcggatcagtcatgacatgcactccttcaactgcatcgcaccccacttgcgagatgcgcccctcgtcttacgcgccacattgtgcgttacagacaactgtactcctcgtggcgagccttaagtaccccaggaaatttgtccccgtcatcgacgcgacgtggcactttaccaattcagtcaaataattgcttcacgaacaccaatcacgctcaaactttgtgcatttggcgcggtctccaaaccagctgttcaaaccactctctgcggagcgattcttgcgtcagaagacgggcagcccctcgactggctcgtagcgcgtggcgcggccacgaccacgagattgcgcaaagccgtcttcaacgagacttttcagcagtgcccgagcacgcgagacccctaattccatatgctccgctaattcggaagttgatatgctgccttgactcacaagatactgtagcgcttctgattccgatttggagaggtgtcccacggaagtccaggatttcatggactcgctatttgctggcgtcataacagatccgccaaggtttgtgtaccgtactacaagttttacgcgatcaggacgagttagcacttccagcagtggatgcggcgcgccaacagaatcacaaccagctcgcatcacatcaaagccacttcctgctttttcaccgataccgatgagaaaaaacattttcatgaggataggattgcgtgcatcagatattccaccttgctccgcctcggcctttgtaacacggagccgcccaggattggtgaactcgatggttgattggcgcctaataatcacagtgcctcttctacccatatagtccgcatgaacgatagcgttggttaacgcctcgcgaatagtgatttccatgggattttcatccatacgtcgcgcttctccgtccaaacggaatgggcgcggcaccgcctgccgcagcctaccatatactgactgccaaaaatcgtataagttgccggaccaaattccgtcagtagaggtaatgcgatcatcccaacgatcgagtccaatttcttcacgatagtcaaggaaataatttgcgaattcccgcacgatatcatattcgcgcccaaacatcagcaatccagcaatagttggatgcaactgattatctttggtagaacgagcgagcgcctgcagacgcacgagaaaatcttcgtcattgaggttacgccacggatggttcgggcgaatcctttgaaaataagaacggtacgaggcaatcgtgcctgaatccaatgcggcactacccaaatcttccacgatacgaagatcctgaggagtgtcactgccatcgcgaaacattgctttgacttcatcccggtcgcaatggtagtcaccctcgttattccttctgaaggtgcccctatgctgttcccggctaaaaggatcagcgcccacatatataggcatgatctcccgccctgcacgagggacatgaatcacgatgaaatcaccggacgatccatgtcgaatcacaacatcttggtcggaaagtactgtggcgttgaccttggaacggtcattgacagtattccaaaaatcccgtttgagcttttctgcatccgttacccctgttacattcaattctcgtcgcgagttctctgaaacaccaagaagaataagaccgccatcagagttggcaaatgcactatacgtatcccatagactgtctggtaatttgtctttggcctttttcgcctcaatacaattatcttctcgaagtagcctcacatccgactcggaaaggctggcaagagaaatcaactcaataacgtcagaattcgccactttatacgcctttccgccagtctaccgccactttatacgcctttccgccagtctaccgccactttatacgcctttccgccagtttttcattctggggaagccgagccatgttcaagcagcgtcatcccccacttgcaacgttaaaaacacaaaagcctgaaaccggctattgcctcagcaatattcagtcggtttcaggctcaatcgttaatcctctggcgaaacgacggtctacttcttcagtagcggtgcgacttgctcctcgtaagcggtcagggcggtgtcgatcacgttgtgcatgtcgtagtacttgtacgtgcccagacgaccgccgaacacggtgttcggctcggccttggccttggcctcgtactgggcgtacagtgccttgtccgcatccgtgttgaccgggtagtacggctcgtcgccgcgttcggcgaaacggctgtattcctcccacaccacggtcttgttcgggttctgggcatcgcggcgctccgggttgaagttcttgaactcgatggcgcgcgtgtacggcacgtccgcgtcggagaagttcatcaccgggcagccgaagtggtcgccctcatcgtagcggacctccttgaagtccaccgtgcgccacttgaggtcgccgagctcatagtcgaagtaacggtccaccgggcccgtgtacacgacgggcacgccagccgcctgcagcgccttcttgttgtacggctgggactcgtcgaagaagtccacgccgagctccacggtgatgcgcgggtcgtcgatcatcttctccatccacgcggtgtagccgtcggcgggcaggccctcccacgtgtccttgaagtagcggttgtcgtagttaaagcgcacgggcaggcgcttgatgatgtcggccggcagctcggaggggtcggtctgccactgcttgccggtgtagttcttgatgaacgcctcgtacagcgggcggccgatgagctgaatgcccttgtcgttcaggttggccggatcggtgccggccagctcgcccgcctgctctgcgatgagcttctgcgcctcggacggcgtgtaatgcgcgtggaagaactggttgatggtgccgaggttgatgggcagcgggtagacctcgccgtcatgcgtggcgtacacgcggtgcacgtagttcgtgaacgaggtgaaacggttcacgtagtcccacacgcgcttgttggaggtgtggaacaagtgcgcgccgtacttgtggatctccgcgccggtctcctcgtccatatacgagtaggcgttgccgccgatgtggtcacggatatcgatgatgtgcacgcgggcgccggtgtgctccaccgcctgctgcgccaccgtcaggccaaacaggcccgcgccgacgatgaccaaatccgggtactgcgcgccctccgacgggccgtgctgcgtattctccgccgcatttgccatgactcaaaacctttcaaccggcatgtgcgattccacacgcgtttcattgtccaccagtgtagcgagaagcacctatgtacacatgcgattccgaattcagcggctcctataggcttcgggcttccggcttgcgcaggctgggtttcggctttacttggttcacgcgcgacgtgcgcctaccctgtgacatactgttcatgtccgcataaacagggcggcctgccggctacgaccgcagggcgcagacacgtgaagaaggattcgccatgacgcaggtttcgccgcttgtctcgatcatcgtgccggtgtacaacgccgagagatacctgcgttactgcgtggactcgattcttcagcagtcgtatgagcatctggagatcatcctcgtggacgacggcgccaccgattccagcccgatgattctggacgaataccagcggcgagacaatcgcgtgcgcgttatccaccagacgaatggtggcatcgcgaaggcgcagaacgccggattggatgcggcgcacggcgattacatcgcgttcgccgacaacgacgacatcctcgaccgccgcaacatcgaactgctgctgcacgcgctgatttcgaccggcgcggacatgagcaaggcccgctggaggcagttcggcgtctcccaaatcgaggaagtcgcgatgaaagcccgtgaaggcgccgccgaacctgaacatgtgagcgtgttcacgaatccgctgaacgcctaccagaccgtattctgcaagagcctgcgcctgatcggcgacaagcttggccacaacacggaggcccgctatttcaacgaggcgaactggtgccgcctgtacaagcgcgaactatgggacggcgtgcgattcccggaaggcatgtacgcgcaggacacagctatcgcaggacacctgtacgtgcgtatgaacaaagtggcggatattgacgtgaacctgtacaactggcttcagcgcccggaatccgtaacacaccaaaagcgtgacttcgcgttccaccacgaccacatcactgcggcatcagataatttccgtctctgtcttgaccgaggcgtcctcccatgcgtagctactacacgttgatcggcgaactggaagccgagagggaatctcctaacttccatattccagaaaaccagcagcagtacgaaaccgaccgtcaggaaattaataccctactagccaatctcacccgcgcacagcgcatacggtgcgccgtcatccagcgcattcgtctgtttgagaagtatatctacgaccgcagaatcaaaaatatgcgataaacattctttactgtacagtcctcctcgtccaataaaacagagcccgttgtctagatggaagtgcgataccctttaaattggagattgtccagataaccagtgaaagggtgtcgcaccttgggtcaagtgcattcgcaccttgggtcaagtgcattcgcatctgtcggaagaggaggtagtggggtgcgcacagatatcaagtcgggaagaacggttcgtcaatcaggtatcgaattgcttcgtatcatcgccatgtatcttatcgtcgcccaccatatggtcaatcacaacagtttcgattttctcggacaggacaattcgttcagaaaagtaattctctccttatttgagtatattccgggaaaaatcggcattgcattgttctttatagcttcggcatggttcctttcctcaggcaatcaaagtttgaagaaatcctgcaggaaaatatggaaactggaacgcgctatcgtattctggagtcttaccgcgttgatcctgcaataccatcttgacccggggaccatacatcttcaacagatcatcagcgctttattccctactgtcacacaattatggtggtacacaacctgctacgtcctgtttctcattttcttaccgttccttaatctcagttttaaaaaataggacaacatgatcacaaaatcctggcatttgtcatgatcatggtctggggcgcatcatcgttaattccctacgaggcgttgaatatcggcctgaacatcattggattcatctacgtatatacgttgatcacctactatcgctggtatatgcaaccgctatcgacaaaaaccgccctgattatcgcgactgcctgcactctgctgttgctcgcatggaacgtttcgtttgagctgttatacaccgataagcacgccggagagtatcaggctctgatgtacatcatggacagagagtggtcgctgccgatactcggcttgagcttgggtatgttcatcatattttcccgcatgcagttccgctcccggataatcaacacgatcgcttcatggacgttaggtgtatatctaatcacagaccacagttacatacgagacttactgtggacccagtggttcgccttcgacaagtactaccaatcacacttcccggttgttattatgctggcaatatccatgctggtattcacagcaggactggcccttgaggctgttcgcaagatgatgtttcaacttataccgatgggagacggagtatttaactggttgtggaatagatgcagactattcgtcgcccattccaccggacagaacgattcctctcttgactagcactgcattcatctggagaacgatacggtccagcgatacggcaaagatgacaacaaaaatgggaaggaaggaatacaggtagcgcgccctagtctcgaatagcatcaggaagcatgtcaatccgataaaggataggcgaagaaacaccgcataatcatcagtatttttccttggtagcagtaaagcggcgcacaacaacagaatcatccacagcagctgctgcagtgacccaaaaacggaaggcgtattgttttccatgtagtacagctttttcagcgaattaggcagattcctctcactgggcacctcagggaatcccttaccctcatgtccgatgccaaatgttccatcaccatatgtagtgacgagttttacggcataaaaatggattgcggaatcagcgttcattgcctgcaaacgccgtaatgctacatcaagatctttcgcttgacgatcggttttatctggaatgcccgcagaaatcttcacatcgttcaaattgaacgcaccatatgactgcgggttcgcccccatcatcaaataatgatgataggaaaacgccatttctggatttggattgacatgaaggtgtttctttaacagaggagaagcaacaccgtagataagggtagccgacacaagaatcgaaaggaatatgcagagaatgtctttcaggacgccttcccttctggcataacggagtatgcaatcaatgactaacgcaactacaagaaccaataccgtcggcttgaacaagctgccgacgaaagcggaaaacaccattaccacaagcacaatataggtaataggtgcggcagaattccgataaataagatatagcgatatgacggtggctacgaaggggaacaggaacgtatccgtataaggtgttccgatccaaaacgaaagagaacctaatattgttgcaataatccaagatgcatagactatgcatgccttgccgatagcactgcctatccctaaagccaggataagacatcccaagttgacacccagtgctcccacagacgctgtaaacatcgctggatccagcttaaggacgaagctcacgcgcacaagaaactgcatcaggacagccagcccataattgttggggaacatatcaaaatacggttgaaatgcccctaaatcccctccccttacggcggctacagcataattgaatatcgtgtcaggatcccaattggcaacatatggcgtatatctgataaccgcattttggaataccaataccgcgacactcaacaggggaagcacatagcagtagctattgccacctttacaggaatacttcagcaatgcatatgtcagcaatacaacaaaaagcaacgcgacaacgaaaaacacgggcataggcaaggcatacttcggtcgcaatccatagggattttccagcgatgagtacccgaacgacaccaggaacaatatcataacggcaataacgctgtagatagcatatactgtgtaggtcagatagacgcccaatcgagccaaacccatatctatggtgtcacgcatcgtttccctatcaatccgaattcttcattcatcccatgctgatctgtgcatgctgcaatgcagttcgcaccccatgcattgcagcatactcaccgctcagctttcgtgcttctgctgttcgctgctttccagcgactgcgcagcaatcgcctgttcgtcctccaaattgacggcgatggcggcacgaacgcctttccatttctcgataacgaacaacggattgagagcaagccaatacaacttgcgcttccatgtatattgccggtcacgcaggatgaacaacgaacccaacgtgaaggcacgcacgacctgcttgacaacgaacgcgatggaaatcggatccatggttttgcctacgcgacgaactcccacgatctcgtcgaacatacgcttcctgtagtcacgtagcttaatctcgttggtgtgccacacatttgcacgaggggcataggccttcacgtacccatgccggatgaggtcctcgccgaacttctggtcctcggcatagggaatatcctgataggggacgtcgcacaacagcacggatttgcgcgcggccgagttcacgtccgagtagaacgtgacgaggtcgaagagctgttgcgagtcaataaagtcatcatcatagaacagtgtggtaccgaagtccgggccgaactgcttgaacgtgcggatgatctcctccttcagcagcggtagcgcggtggcacgcggatcctgcttacccatcacgcccacgacctgtgggaaacgctccagcggctgaatgatctcgtacagccaacgatcatgggcgggagtggcatcctgcgtgaggtagatgacatattcgccacgcgccttctccgcagcctgctgacgcaccctgccgtgggaaaattccggtttggtgatggtttcgtaccggaaatgccggaatttcggcgcccaggatctgatgatctcgggcgtgcgatccttggagctggtgtcaatgacgagaatctcgtattcgaagtccaccttctgcttatgcaatgcagtgaacaactcatccagattatcctcgccgtaataggtgggaatgaagacggtggctttgatgtcagtcatgattctgtacggtggcctctctaagaatgatacgttcgaacttctcataggaggcatcccaggaagagctttccgctctcttggagatgcgttggcagcgcgcttcgatgtccgaatcgttgacgaccttgtcaagcccgtgggcaagttcgatcggagaattgagcgtgtacacgatgtccgggttctctccgatgaccatgcggttgttgtcgccgtcattcatcaccggaacgcaaccggcggcaagcagctcaagcggcaacagggacgcattggtgagagagagcacgagacacgcctcggactcatgatagatttcggcgagctgcgcggggttgacgatgccgcggttctcgtacgggaaggggatgtcgtagtcagacacgtcccatccgaaaaacacgatcttgtagtcagggtgcatctggtggaatttcgccaaggcgagcacaccgatctcgaaagcccggcgttcggtaacggggcggccgtagaagcaaatctgcttcttcttggttacatcacctttcggcttgtagatgtcgaggtcggcaccgaagtcgaagtagtcggcgggcatatcgaattcaccgaccttcttggtgagccaacggccggcggtgatgccgtagaaaccgaacctatacgtgttttcggcgagcaccgacttggaccccataccgtagaagagcggctcgtaatcctgcacaaaatacatcttgtgtgcattggtcttcatgttgaagaccggatatgcagtctcccatcccgtggcgaaaagcacgtcaagatcgatgttgctgatgtccttgaccggcacgcaagtcacatcgatatcgaaatgctccttgagcagctggtgggagtattcggccggctgtttggcgatactctcatatataaagaacgtaacgttatgcccgcgttcctgcaaggatttggcgaagcgtgcgatggtatgttgtcctccactgccgacgctgatgggagacagcacccaaccaatattgagcttgctcttctccaccttcaccggagcgtgatatggatgcgccacgaaatccgccgccacgacatcttcggcagaagtcataacatccaacggacgcttagcaaccagatttcctgaagccgcttgctgttgcagcctacggttcaggtaatccaacgagcgaagtagcgtgactcgaataccactcttcctgagatactgtgcaaaagcaccgatttttgacatcatttcgccttccctagcagacgacgcatataacgaactggagcgaggatagcaccacctatcttccactggagagaagcatacacagattccctgaaagcaatcgattcccggacggtccgttccttctcttcgagagagtgaatagtgttcagcagcaaatcgatttccgcgctgaagtaccggaattcatcaggatactgagcgttatacttctgccagatatgatgacgcactagcaacagctttaacaaatcagcttcctgttgatcgttgcgcgaatcggcattctcatgtttccggtagtagtacaacggctcatcaagcagaacaggcgacgcacctgtcaggcatagtcccaatgcaaaatcccaatcttcatatccaacaccgttaagatacgagtcatatttcacaccggattgacgcaaatatggtacggaaatcattgcatacgcaccgatgtagttttcatgtttcaacttttcgagattgtactgagggtacaacgagtcgaaattcactcgtccgaaatacttgacctgacagtagacaatattagctcgactttcggtcgcagcattaactgccttccgtacatagtcagcatcaagataatcatccgcatcaagctgaatgagataatcgccttcggctagcccaagtaccttgttgcgcgtggcgacaacacccatattcttctgggtgacgagttcgacggaatctccatatgtgttcctgataaggtccaccgacccgtccgtggagccatcatctacaacgagaacctcgatgttgcggtaggtctggttcaggacgctgtcaatcgcctcgcacacatactgcgagtagttgtggttgattaccgcaaccgatacgagcggctcagcggtcactggaccgggttcctttggatacatggcttgaggcttctctggcatcacaaacggctatcctaacagaaccaacacctagactggcaccggtgaatgtcgtgaaaagacagtagcatgtccccaagtgcggcaaacggcgaatactacgctgccgcagggcaacatgtagtttgagcgataggataggttctcgtgtcagagctcattcgtcggttccaagcacggtaccgttatggcctcatcgtgctgaaggaactcgtcaagaccgatttcaagcttcgctatcagggatcgattctcggcatggcttggtctgtggtcaagccgttgatgcttttcggcgtcatgtacatggtgttcgtccggttccttaagttctccgacggcacgccgacattcaccatctcgctgctgtgtggcacctgcctgtggagtttcttctccgaagccacttctgtcggcatgcagtccattgtcggccgcggcgatctgctgagaaaggtacacttccccaattacatcatcgttgcttccaccacgatggggtcgctgatttctctgggtatcaacctgattgtggtcatcgtgtttggcttcttctccaacgcgcaatacacatggcatgtcctgctcgttccgttcaatgtcgcccagttgtacctgctggcactagcgtgcgcgctgattctttccacgatgtacgtctacttccatgatgtcgcgcacatctgggaggtcgtgctgcaggcaatgttctactccatcccgattatctatccgctcagcatggtttcgaatcgttacccggttatcgccaagttgatgctgatgaatcccgccgcccaggccatcatggacattcgccataaccttgtggcacctgattatgttcccacggtttggacgatgattgccaatccgttcatcgcactgttgccgtatctgatgacggtggttctgctcgtcatcggtattcacgttttccgtaagcacagtcgtaagttcgcggaggtcatgtaatggtcgatcacaccaacactactcacggggaagttgccgacgcctcgttgaacgaagacaagccggtcgtactgtccgtcgaacatgtctccaagtcgttccgtcttccaaccgaacaggccagcggtttaaagcaggcattcatcaactggaccaagggtatcaaaggctacactgaacaatctgtgctccgcgatatcaatttcgaggttcatcagggtgatttcttcggcatcgtcgggcgcaacggatccggtaaatccacgcttctgaaaatcatttccggcatctatgttcctgaaacaggcaaggtatcgatcaacggcaagctggttccgttcatcgagcttggtgtcggattcaatccagaactcaccggtcgtgagaacgtttacctcaatggtgcgctgttgggcttctcacgtgacgagatcgatgccatgtacgacgacatcgtcgagttcgcagagctgggcgattttatggaccagaagctgaagaactactcctctggcatgcaggtgcgtctcgccttttccgtcgccatcaaagcgcagggtgacattctcgttctcgatgaggtgctggcagtcggcgacgaggcgttccaaacgaaatgcaacgacttcttcacggagattaagaaggatcccacgaagacggtcattctcgtcacgcacgccatggattcggtgaagaagtactgcaacaaggctattcttatccgtgatggtgaggtcatcgtcaacggcgacaagaacgatgccgcgaacacgtacaccgaagagaatctgaagagtctgcagaagaaagccgccgaaacagtcgaggaaggcgagtatcccaccggtctgaatggaacggtaccaatgctgcggtgtgtccctacatcgaagatggtgctgaccagcaaagatacgtttgaatttgacgttgaattcgaatacaccaagactgacgagtatttcttggctgtctccatgctcgacacccgtcgtggtggcattccctatgattccggctccattaagatgggcgtaggcgggaatggcaaacaatccgttcacttctctctaccgcttaatatattcaacaacggtacttataagattaccgcgtccttgcgcaagcaggatcccgcagatccacaccacactttgttggcaggtttctccaatgatgagaattcatgtctgttctccatcaatgaggatgccaagggcacggattatgcgttgctcaaatatgacgctgttgatttgaggagaagctaatgttctcgaagaacgaagatattcgcgatatccagaaaaccgccctgtctatctttaaagagttccggcgaatctgcgaagagaataatcttcgtttctatacttcgggaggcaccactattggtgccctgctgtacaaaggattcatcccctttgatgatgacatcgacatcaatatgccgaggccggattatgagcggttcaaacagctcgctccggccgtcctgcctcgccacttagccgtattcgatggtttagaaagcactcatgcggatttccattttttaaagctgcacgatacacgaaccatgttcaccgcaaatctactattgccgtaccctgactgttatacaggtgcgttcattgatatcgaacctattgacggagttccgagtaatcaagaggaacgtgagcaatggtattttcagatagataagctgtactgttatgacttgctccgcaagttcggcaagaaatacctgtatccggataccatcgcatggctgtacccgaatcgtctgattcgcgccattgcgtatgcttggattcaacttcatccactgcgttattacgcagaaaagtatgaacaactgcagcggcattatgctgaacaatatccttttgatgagtccgaatacatttcttatccacgttatggcatgtatcgaaccaagtccatgtggaatacaaaacgcgccagctgggattcttatattgagattccgttcgaggataccaccatacgagttcccaaaggctacgaaaatgtcctgactaaccagtacggcttcatgcccacatgggagactcagaagcgctacgaacaagacaccgactcccaccacatcaccacagctctggtagatttggtaaaaccattgcacagttacaggacttcaaaatcacttgatagagaataagttgattatcaactctgcatttctcataatactactcgttatattagcagcagtcacggcgctgactgtcatttgctatgctttttgtaacatcagcacaagcaaagaaacaacggatttcacgtatgaaataccgacaaaaaaacggtagtacaatacatcacgtaatcaaatctcagacaaacaatagaggagcaaaaagattaatatcactaggaattaaaaacttaggatatttagtcacccttatcactgctctcattactgcattgactgtcatcaatggcgcaaatcaaactttaatcgacgcaaaggaaactcgaatgcggtcagaatctgactccgcggtgagcaaactggccaacgagagcgcagcagaaagaatggcgggagttaattcgctggtcgccctggctgatgattggggaagtgattcagaccttcaatcacatgaatatcatcaaaaaacatgtgcatatgcactccttacatacctaaaaacaaaaccgacgatgaagaatgcctcatcaatgacggatgacgaggccataatacgcgatagcatccaaaagggtttctccgaccatcttcaagtcgataaagctgccacttcatgggatgaaattcctctcagcttttccggatcatacttttacaatttcaacttatctgacgtttcgtttaaagaaacggcattatttgacaattgcactttttatggaaatgaaacaagttttaatcataccaagtttctacaggatggcattttcactgggagcacattttacaataatgttgatttcacgggtagcttatgaagattccgctctgttttcgataaggccaaattcattgattcacatgattattctaaattctccgagttctctcaggcatcatttgaagatgcacgtatgaaacaagggcttcttttcaacaatgtaaccatcgagaatagaatggattttggcatgctcttcaacgaccagcactattcttctgcccatattgatggagaaatactagctaatgatattaccatcaataatacaacggttgacttagacggagcagtagctcaggattatcaggggagcattttatcagcacaaaatggttcattgaccataggaggaaccacctattcaactgcaggagcgaccttcaagggaagtctaaagtaggatgtcacccattgtgtttcaaattgaggctcttcgggtgtttgtgcggatgtgaatcacctgtctggcttactgcctattagcgtccggggaggcggaggttgagtccgccgcatttgagcatgacgaaaccgatgaggttgtcgaggttcctgtatccgtagccgattggaaaataatccggcttggtaatggggtctcctgaaaatggtaccgggtgtagcgtctggctggtactggtgtgctgtttcccgtagcgtctttcagtgaagcggtccgatggcgggccgccttatcgaaaggaggccgatgatggccgtgaattggaaacagatcatgatcatgcgtctcaaggggtgagccaggaccgggtggcaggcgcggcacggtgcagcaagcgcgacgtggcgcgtgcgtccagggtcatccgcgagcatggcgtgaccatggagacgctcatgggcatgggcgacgcgcaggtgcgtgagcgttggttccccgccaagccgcgcgaggcggacggttcttacgcgcaaccagacatggactcgtacgtggagcgcaagggcacgtaccgcaagctgccggtcaagttcctgtggtacgactaccggcgcaaggccgagacgaccggtctgaggacgtattcgtaccaggcgttctgccgcatgttcgccctgcgctgcgagcaattggacgccaccgcccgtctggagcaccaacccggggagaaggtggattggcaacggtgtgttggactgtttctagagggtttttccttgttgtgtgaactccacggggctcaggtacccgagggtcgagtggagccgttggtggttgtaccaccacacgtaccggttgacgtccgagcgcagttgctccacgttcgtgtagacgttcctgtggatgagctccttcctgacgagccggttggtggattcgaccaccgcgctgtcgtacgggttgcccggcctggaaagggaacgcgtgacgccgaacacgtcgagcacgcgttcgacgcgttccccggcgaacccgccgccgcgatccgtgtggaacacctcgatctcatccagcgggaagcgcagcgcggcgaacgcggccaacacgagatcggcgtcgtgcccgacgccgaccgaatggccggcgatctgccggctggccaggtcgccgggcaggcagacgtacgcccacgaactgccgaccctcacgtaggccgggtcggaggccagatgggtgcgctgtatgtgttcaatagggagttgaggttttagtcacgtagttttttcgggtttaggcagaaaggcatgccgaccacccgtgggccttagcctgatggtgcttcgaatccattcgggaaagggccggaaaggcaaatgatcagcatgcccaaaatacagtctatccgtcagaggcgcaggaatggggagtccgtcgcctcgatcgcgcgcggcgagaaggtcagcgagccgaccgtgcgcaagtatctcaaggccgacgacctgtcggccaggcctccggtaaggagacgccgtggctcggtgctcgacgagtggattcccgtgatcgagggcatgctcgccgaggaccgggagacctggcacaagcaacgtcacacggcgacgcgcatccacgagcggttgcgtgacgagtacggggtggaggcgtcgttgtcgacggtgacccggacggtggcccggttgaagcgtgagttcatggcggagcgcgagatgggtttcctggacctgtcgtggcatccgggcgaatgccaggcggacttcggccaggtcgacgtgcgctaccggggcgtcgtgacgcggatgcggcatttcgtgttggatttcccgtactcgaacatctcgccgtgccagctgatgcccggggagaacgcggaatgcacgtgtcaggctttgcttaacctgttcgaatggctgggcggggtgccccggcgcatcgtgtacgacaatgccgccggcgtgggccgccgacggttcgacgagatccgcctgacccgcctgttccaggcgttccaggcccattacgggttcgaatactcgttctgcaacccgtactcgggccacgagaagggcgcggtcgaggccagggtcggggccgtgcgccgaaggctgttcgtgccggtgcccagcgtgtggagcctcgacaacttcaacctgcgccttcccgaccgctgtctcgagctggggacaaggaccattacaggaagggcgagagccaggccggcctgttcgaggatgatcgcaaggcgctgctgcccctgcccgccaagccgttcgacgtggtcacgtggacgaggatgaaggccgacaaatacggaaacgtcaccgtccagggccgccaccggtacgcggccggacccgaacacgccggccatgagatgatcgtcggcctgagggccctggaggtggagatcctcgatgccgaaggcaaacgcgtgatcacgcatccgaggtcctacggggacaagccgaccgacagcggcgacccgtcgagccagctcgggctgttgtgcgaccggccggcggcctggcgcaacagccgggtgcgcgacgcgatgcccgacccgcttcgcgaatggatcgacgcgcaggacgaggccacgcggcgcgacagcctgcgtgccctgctgcacgccgacggcgagagcggctggcgggcggccgtggccggcatgctcgagatcctcgaatccaccggaggcacggaccgggccggggtatgtctggccgcggcacgccacgcctcgggcctgggacccgtggcctacgacgaccccgtggacctgagcgaatacgacatcgcctacaccaaggaggacgagtgaaccagaagaacggacggaccgaccccggcccgctgcgcgagcgggcgaggagcctgttcatctcgcaggccaccatcgacgaaacgctcgaatgggccacgccccgccaactggacgccatcgaccgcatgctcgccacggaactggccaacagggaggcctccaaacgggcaaggctcatgcgccaggcccggttcccggtgcccaaaagcctcgacggctacgacttcgcgaacgtgcgcctgcccgacggatacaccaaggagcagctgaccggcctcgatttcgtggccaaggcgcaggacctcgtgttctacggcaagacgggacgcggcaagacccacctggccaccgccctgggcatgctcgccatcgagcaaggcaggagcgtgaggttccggcagaccgcggagctcgtgctccagctcggcaaggccaaacgcgacggcgccctcgacaacctgctcaaagacctcgcccgtgccgacctgatcatcctcgacgagttcggctacgtgcccttcgacatcgacggggcccgcctcctctaccagatcatcgccggcagctacgagcggcgcagcatcatcttcaccacgaacatcgagttcagcaaatgggggacgatcttcgccgacgacaaactcgccgccgcgatcatcgaccgcatcgtccaccacggacgcctcatcgaattcaccggccccagccgacgcgtcagccaggccctcatgttcggcaagacggacaaccagtaaaacaaaccaccggccggcactcctcatgccgaaaaccgaaaaaaattagtgacgaaacacgaaacaccgacttgactaaatacagggtgcgcggcgcatagccattgaactcgcgggcgaggatgttgggagccgggtcgtcgtccggcctggccgggcgtggcctataggcggccttggaataggagccggccatgccgttccccttcatgatccggttgatgcggcggcgggacagcgtcacgccctcgtgccccagggcgtgcctgatcttcctggccccgtacaccttgccgctgtccctccacacgcgctccacatccttctcgtaagggtcggcgcgctcggcctcggggtgttcgagcatccagtggcaggtcgacttggcaacgcccaggatcccgcactgcgccgataccgggcagcggccggcgtcggaccgtatcacgcctgctttcgtgcgaataccggcgccgcttgttctgaaacatcgacctccatctccagctgcctgtcgcgtttccgcaattcgatcagctcgttctcctcgggagtgcggttgtcgaccgctttcgtggagccgctgttacgtatcccctgcacccaacgccgcagcgtggaacgcgggatgccgtactccgccctgatctgcgacgacggcttgccgttcccgttacgactgcacgatctgcctcttgaactcctcctcgtaatgacggggacgattcggatcggccatgatgatcaactccttcgttgtcatgtcccgcatgaaccagtccaatacattgtagccaatccagtgccgcgccggccggtggcgagtgggaggccgacggcgtcatcggcgtgggatgtagcccgcacaccgaggtcgaaaggcgcacgcgtttccttatggcgcgcatcgtgcccgacaagaccgcccgcgaaagcatcggagcgcggttcctcatgttctccgcgctgccggctggggccgggaccggcgtcacgcacgacgacggcaccgagtccgcccgccacgcggaactgcgcgaacggctcggcatggccacctacttcgccgacccgtactcgtcgtaccggcgcggcggcaacgagaaccgcaacggcgcgatccaccgccacctgcccaaacgcacgcgcatcgacccgtccatgaccgacgagatacaggccatcgtggacagatcaacaaccgtcccatgcgcgtgctcggctaccgcaccccggccgaggcattcgccgacgaactgctaccattaaccaaacaacaaggatgttgcacttctaaatagacaacggggggcgaaaccccgcaagccgacgaggactaggatttcgcgctcaccaccggtgaggcaccactccgggcttcgcgctcattttcaaatgaggcacctcgggcattcttctgtttcaagataatcttgtcgtcggacacatccttaaggtgcttgccgtacgggctcttgccgtacttctcggcggcctcaagcagctgctcgcgggtaatccagccgttctcataggcgatttcctcggccacggcgatgggcaggccctgcgcgcgctgcacggtgcgcacgaactcgcccgcctcgtacagggagtccatcgtgcccgtgtccagccacgcgtagccgcggcccaacgtgcgcacgttcaacgcgcccgcctccaggtacatcttgttcaggtcggtgatctccaactcgcctcgcgcggacggtttcacctgcttggcgaactccaccacgcgctcgtcataaaagtacaggcccgtcaccgcgtagttcgacttcggacgcttgggtttctcctcgatggacacggccttcttgtccgcgtcgaactcgaccacgccgtaacgctccggatcgtccacgtagtagccgaacacggacgcgccctcaccgttctccgccttcgccttcgccttgcgcaacgtggcgcccagaccgttgccgtagaagatgttgtcgcccagcacgagcgcacacggctcacccgcgatgaactcctcgcccaacaggaacgcctgcgccagaccatccggggacggctgcaccacataggagaatttcacgccatactggctgccgtcgccaagcagtcgctcgaagttcggcaggtccttcggcgtggagatgataaggatgtcacggatgccggccatcatgagcacgctcagcggatagtagatcatcggcttgtcgtacaccggaagcagctgcttcgatgtcaccgtcgtcaacggatacagcctcgtacccgagccaccggcgagaatgatacctttcataaggacctgctttcttcacagtcgtaatcagctcacaccagcttagccaagacagtggcgaaacagaaaaccgcgcaggtcattctgcgcggttttcacactgacatcaggccgtcggaatgggctgacagacctttccggtttgtcctatctgtcctacttgccgagttccttgttcacgtatgcttcgagggtttcctcccagtcggcgggcgtgtagccggcggccttgatcttggacaggtcgagcgcggaatgctcgggacgcgggctgaccggcgccttcgcgttcgcgaagtactcggccgtgctgatcggcttgaccttctccccgttgccgttcgtcagttcgaacacgcgggacgcgatctgcgcccagttcctcaccgcgccggaaccggtcaagttgtacgtaccgtacggggcatgcgagtccagcaggtggaagatcgcctcggccatgtccttcgtgaacgtgaggcgcccgtactggtcgtccaccaccgtcacctgctccagctggtcgtccgggttcgcgacacggtccgacagcatcatcatcgtcttcacgaagttgcggccctcgccgatcacccagctggaacgcaggatgtagtgctccggcgcgttcgccaccgcgatgtcgcccgcagccttcgtctgcccgtacacgcccaacggcgcgaacgcctcatcctccgaatgcaggtccgcggtgccgtcgaacacgtagtcggagctcacatgcaccagcgtgatgtgatggtccttcgcgaccctcgcgagcagggccgggccctgcgcgttcgccttccacgccaccggacggccctccgcggtctccgccctgtccacggccgtgtacgcgcccgcgttgatgatcgtgccgtacaggctccaatcgtacttgtcgtacgcggtcggatcggagaagtcgaactcgtcgatgtccgtgtactcgaaaccacgcagaccatgcgcctccgcgtacgcgcggaccgcacggcccaactggccgttgcagcccgtcaccagcgtgcgcttcggctccatcggcttcgcatccctgagcatcggatgatgcaggtccgcctcggagcgttcggactcctccaacgggatcggccactcgatgcccagctccgggtccgcgaggttcacgaacgtgtacgtcttcttctgttccagcgaccaatgcgcgttcaccagatacgtgtacacggtcccgtcctgcaaggcctggaagctgttgcccacgccgcgaggcacgtagatcgccttggacgggtccaaacgggtcgtgtacacctggccgaagctctcgcccgggcgcaggtccacccacgcgccgaagatctcacccgccgcgatcgagatgtacttgtcccacggctccgcatggatgccgcgcgtcacgcccttcgtcgcgttgaagctgatgttgttctgcaccggaccgaaatccggcaggcccaacgcggtcatcttcgcccgctgccagttctccttgaaccagccacgattgtcaccatgtaccggcaggtcgaacaccaacaggcccgggatgttcgtctcctcgaccttcaagtccttctcgaattcgaacgacatacgttccctactttctatcttcagaatcgttttgccacgttgctatgcagcgtgcaggattaagcgttttcaaggcctcccctttatcggggaaagcccaattcgggcattcggggcccaaggcatcgaggatgaagaacatgtcgtatctcagtttcgcgaactcgacccgcagaaggttctcatcatgaccgatacggttgcggatggtacgaaccgatttgaggcggtccaccagttccttgcgcagcctgtcctcaaacgggtcgccgtcgttgccgggaagccttcccttcggcatacgacgcagttccgacgcccatgcatccgcgatgttggggaacgcgcccatgaggacatgggcgagttcagggtccttgccggaacgggacaacatgccatcccacgtgcccaacgtcaattgggagaacacgtcgtcgcgggtgatcgcatccccgtgccttggatgcgtctggtcggaacgccaatgccgttgcttgcgcaatgccgtgttccgggcctccgcgatatagtcgcgctcggggctgttgatcaaagcccgtatcctcccgatcggatcgcttttgccggcttcaagccagtccgggatgcccgttatctgctgcccggacacccattcgcaaagccggtaatcgattgcatttctgacgaatatctcgatatagccgatataaccgattgtgatggcggatgcctccacgttccagcggtacagcctcaccgccagatcaaccagccgttcccgatcgaccgtatccacatgccgtcttgcataatcgagatacacctggaaccgcgcgtcagcaagaaaacgactcgccatcacggcattgtccgcttgctttttcacattcatatgtgtatctttcatagtgctataggggccacaccttcgaggtgtggccattttcatattccgctcactgaccctgctgcttgtatttggcttcggtggcggccttggccggctcccaccaggcgcggttgtccgtgtaccacttgatggtctgctccaggcccttctggaagtccgtgtgcgtcggcttccagccgagctcggtctgcagcttggtggaatcgatcgcgtagcggcggtcgtggccgggacggtccttcacccagtcgaagtcgtccgggctcttgcccatcacggtcaggatgtcgcgcagcaccgtgatgttgttgcgttcgccgttcgcgccgatcagatacgtctcgcccaagcgtcccttggtcaggatggtccacacgcccgtggagtggtcgtccgtgtggatccagtcacgcacgttcaggccgttgccgtacagcttcgggcgcaggccctcgaggatgttcgtgatctgacgggggatgaacttctccacatgctggaaggggccgtagttgttcgagcagttggagatggtggcgcggatgccgaacgtgcggtgccaggcgcgcaccagcaggtcggagctcgccttagtggagctgtacgggctggacggatggtacggggtctgctccgtgaacttggccggatcatccagggccagatcgccgtacacctcgtccgtgctcacgtggtggtagcgcacgtcgtacttgcgggccgcctccagcaggcggaacgtgccctccacgttggtcttcaggaacggctccgggttcgcgatcgagttgtcgttgtgggattccgccgcgtagtgcacgatcgcgtcatggcccggcacgattttgtcgagcagctcgtcgtcgcagatgttgccgtgcacgaactccacgcggtcgcccaggatcggacggatgttctccaagttgcccgcatacgtcaacgcatccaacaccgtcacatgaacatcgggatgattgttgtacacgtaatgcacgaaattcgacccgatgaaaccacagccaccggtcacaatgatgttatgaggagtaaacacttcatcagccatacgggcaatcataccgtcgcggccgtacggccactgagaccccgggttctagatagaagtgcaacgcctgtctacggttggaagtgttcaggttcataaccgaagagaaagcgttgcactcatcatgaaagcttattcccacctgtcggcacaggaatatgtccggatcgacgagttgaggaaccgtgacgggctcggggtccgtcaaatcgccctgaggatcggccacgacaagtccgccgtcagccacgaatgcctctaccagtggatccacgtgaaaccgcagaaggcattggacctcaggcggtacctgccgcggggcaaacgacatcgcacgcgggcgaagggacgccggtcgaaggggccgcgcatcgggatgcgcgtgccgatcaccgaacgtcccaaacgcgtgggctcgcgccgcgagttcggccattatgagtccgacacggtcgtcggcgcgtccccgtcgagacggtgcgtcgacacgcaggtcgaacgcaagagccgccgcctgttcgccaggttcatcgacgacaagagcgcgctggccaccgcgcgccgaatacgacatccacaaggacatccccgcgccggcgaggatcgaccggacctgggacaacggcaccgaatcctcctgccacctgctcgtggacgaggcgctgggcatgctcacctatctcgcggacccgtactcctcccaccagcgcgggtcgaacgagaaccgcaacgggcgcatccccgctacctgcccaagaggaccggcttcgacgacctcacggacgcggacctgcaggccatcgtccaggagatcaacgacacccccatgaaggtcctggctgagaaacgcccaacgaggtttggtaccgcgaactcggcaaggtaatgtcgagggcaagccacccaaggacgagcgttgcacttacaaattgaatctggggacacttgcgccgcaggaatccatgtttaccgcttcgctccagtgactgagtcaaagtagtacaaccttccattgatgtattgagtaccatacagcatcttcccatcggcaccgtagtacaccgtcttaccgccattcgagttcagacgctgccagccggacttccgcgcaccagtcaccggatccaagtagtaccaagcgccatcaatatgctgctcgccatacagcataacgcccaatccctgctggtaatacacccacttgccgccgctcgatgacaaatacttccagccgtataccacttgcccattcgacgaagacgaatcgtcatcaaagaaataccaatgtcctctcacctgcgactcaccatgcaccattgctccgttcgcaccatagtaaacccatttgccgccgctaggctcgttcgtgatctttgtgcgtcgccaacccgataaacgcgcccccgtcatcgaatccaagaaatactgcttcccgtcgatagttttctcgccgtactgcatcttcccatcggcaccgtagtacaccgtcttaccgccattcgagttcagacgctgccagccctgcttgcgagcgccggtcaccggattcaggtaataccaagcaccattaatcttctgctcgccatacagcatgtacggcgcataatacacgttcctgtcatccggcaaaacgacccagccggtcatcctcgctccgctatcgggattcaggtaataccatttaccagcaatgttttgttcgccgtacagcattgcaccgtccgaaccatagtagacccacttattcgcaccgactttgagatatacccaacccgttgcgcgcgcgcctgtacccggattcaggtaataccatttaccgccaatttgctgctctccgtacagcatatgcccatcggaaagatcgtaatacacccacttgccgccgctcgacgaaagccgctgccaaccggtagcctttttgccggttgcagtatcgacgtagtaccactttccgtccttttccacctcaacatattgcgttacaggggtcttattaccgaacgcgttcatatccacgcggccggaaatgccgctgatggagccgccgctcgtgtactgccagccgcggtcgttggtggggaacgcggtgtactgcatggtggagccatactgcgccacccagcgggtcttgccgtggatgttgccgctgttgagcgcactgttcaggtagcttgtgtacgagtagacgctcagattgttgtaaccggccgcctgcagtttgccgtaccaggagttgacgatgccgtcgtacacgctcggactcgtcgggctcctatgccccgtgtacgtccagttctctagatcgtagaacaccgggtagctcaggtcgcccgggttcacgcccgcctggcgcagcaggttcaccacgtccgcgccctcggacgcaccgtcggccgcactttccgcatacgagaagacgtacacgccgaacgggatgccgagacgcttgcattcgctgatgttgcgcttcgcctgcgcgtcgaaaccattgccccagccgtagctcagacggatgatcgcgccctcgacgcccgcgttcttcaccgcctgccagtcaatcgtgttctgccacacggacacgtcgatcacgcccttcgcctgctgggcgaacaggttgttgcgcgcgtcgaagaacgcctgcgtaccgttgtacgtgccccagtgcgcaccgtactcattgttctgcaacgcggcgagcttcaccgacgcgttggtcgcgcgcgtcttcgaggagaccgcgttcacgtcaccgccgttcgcagcgaccttctccttcacatccgcggcactcaccggaatgaacgactcaccatccgtcttcgccaacggatcgggctgcttgctctccgtgcccacgatcttcggatcggtgaccgtctcgcccgtcttgatgtccttcaactcgccttccggcgtagccgcatattgctcggacaccaccgtcgcgtcatcggagatctcggcggacaccttgtccggcagctcggcatccggattgtccggcatcgcgtcggcagccgtctcatcggcgaccatcacaccgttcgcgaccggacgcgtcgcggaagtcgcggaccgcgcctgcgagcgcgcgtcggatgaggttccgtccgaggcggccgcggaggccgtcacggaggccgcggaccggacgccggacgcgtccgcgtcggcgttcacatccgcgagcgcgctggccggagtgacgcacaccgcgcccaacatcgccatcgccgcgacggacgccatcgccgcagtcacaccgcgcaccgcgccggatgccgttgcacgcgcacgcaacgcacgcagcatgcccgtcgcacccttcgcatccgcgccgtcgaaccgcttcttttccaccatgcgtaactccttgacgcacccatcccgcgcacccgcacaccgccacgcgttccgatggtcgaccggactctcacacgcgggaacaggcaggcgcaaacaggcgcaatcacaacgttttcaaccgtgctccagtctaatgagcaaggcggataagacagacggagcgaagcgggcaaaatcggcggagctccgccatacattccggcgacggcatcatcctatcttttgagaagatacttcctgtttctactgcgcggcggcgcagtggcgagaacgagtccacgtttaacgagccggctcaacgccttacgcgtcgtaggaaggcccctccccgagcgacggccgatttcgtggacatcaagtggcttatccgccgacaatacggacagtatcgcggattccgatgccgtaagacccttacggcccccactcggctcctcaccatcgaccttctccgctagtgcgtaccgatcagggccgatttcatcggccagcctcgcttggaccaatctatgcaaaatcaccctgatgtcgtcggaatccagatacagcgcgacatgcaactgcggaaccgtcatatcgccatgcctcttcaacaagagcaacgccatacgttcatgacgagtcaaggggacgcccacatgatcaagccagtcacggttctcctgctgctccacgccgtagcgtccaagaacgaccgtgaaccgatcgggagttgcgcggaacacaggttcccccagtgcacgggatttcatctcgcgaatcaccagagggatgccggagccaccgccttccacggtcacatcattcgcatcgtcatacggtatctgatgaagcagctgcatcaacgtcgcattgcggcagcatgacacgccgctgccgatcgtggccagcgtgaccccaccccataatccgccaggattcgacacctccacccgatcggggtagatgtccacggtcacggattctccgaggaattgcgcatcatattccctgtgaaccacggcattggcgacgacctcgcgcagcacctcctttggaatctcgctatcggtacgggctccgacccccacgacgaacgtgggagcccgcaggtttttggcgatggcctccaccgcctgttcgattgcctccggcatattgccgtcgcattgcacacgatccacgaaacgcggaccctcaaccgccgatttctcgacacccggatgtgcgacgacgtcaatgatcagcttgggatagtactgctgcgggtactgtccggcggccaacagtcccgcaagacgcacctctccaaccttgttcaccatattcaatctggtcatgcgctcaagacgagtatcagtcccgcgcaacgccttggaattacgatgctcggcaagcaccctgtccaccgcctcggcattcagatcggagacgtcggcttcagggacaaccatacgatccgcggaactgggcgtcagggcatgggtcatttcgaacacttcggttggcgacaatctcaaatccttgtcgtccatacggcggtacccaccggtttgcggccctctcgccgtaagatagcagggtttgtgctgaatgccgttttcatggatgtcgatgaccaggaacgacaagccgttctgctcgcatcgggaaacgtcatactccggaggattcgtcaaccgtgctccttgcggattgccatctcccataccatccatgaactgcgatgcaatatggttggcgtcgaatcccggaacaggcgagaaatccccgtcctcgctgattcccaacaacagcacgccgcccttggtgttggcgaacgcgctcacactctcccacacgctggtgccgatggtccgcgcacaggatttcgcctcgaaacgggcgtcatcgttgccttggacacgtagatgttccagcacctcggcgatatcgtcattcgtccacatcatcatcccccttgatcagcttatttgtcttacttgttgcgaccacatggatccaagcagtcgcctccaatcgaccccaaacccacgtctgaaatctcatgataacgtgaagataaatactctgtcatgagcttatcatgattgcatcatgataagctcatgacatcaagaaccggtttatgacaagcgacacgaatacgcatgccgaacagcaacaggaacctgaacgcaagcatcaacatgtaaatatcgaaattgaccgaaccgagaaaatcacgcacgacattacgcaaacagctaaactatctatagcacatgagcatgggccggaaccgggatgagacggcttcgaactgagtatgaggatgggaagatgatcttcgagacaaacacgcagaaagcgggcatcacgagcgccggtggcgatggttccggcgagcgcgccgaccgccgcgaccagccggtcgtgtattttgtgcttccctgctacaacgaggcggaagggctcgtgcacacggccgacgtgctggccgccaaagtcgcacatcttaccgaaaccggacggatcagcaaacaaagccgcatcctgttcgtcgacgacggttccaaagacgacacctggagcatcatccgcaatctgcacgaacgcgacgcacacttgttcggcggcgtaaagctctcccacaaccgtggccatcagaacgcgctcctcgccgggctcatgaccgcgcgcgcctacggctgtgacgccgccatctccatggacgccgacctgcaggacgatgtgaacgcggtcgacgagttcatcgacggattctgcaacggcaacgagattgtctacggagtgcgttccgcacgcaagaaggacacatggttcaagcgcaccaccgccgaagccttctacaaggtgttcgagtggatgggtgccgagacggtacccgatcacgccgattaccgtctcatgagccgcgagacgctcgacgcgctcagcgaataccacgaagtcaacctgttcctgcgtggcatcgtgcccacactcggctaccagaccagcaaagtctactacgagcgcggcgaacgcgaggcgggcgaatccaaatacccgttgaagaagatgatcgccttcgcgattcagggcatcacctcgttctccacgaagccgctgagcttcgtcaccggcgccggactgctgtctatcctggtagcgattggcatgttcgtgtacgtgctcgtctcgctcgggttcggccacgccatcgccggctgggggtccatgatgatctccatctggctcatcggcggactcatcatgctctccctcggcatcgtcggcgaatacgtcggcaagatttatatggaatccaaacatcgcccccgttaccgcatcgaaaccacgctgtaggagggaccggcggccagcgtgacggcccctcctacagtgcttggattgtatctattttgtcctcatcatacgagtcaacgcgtatagcaatgccccttgcttgaggcgaaaatgagaccgtcgccgttctcctgccttgttataacgaagaggtgaccatcggcaaggtggtgcgcgacttccgtgcggcgctgcccgacgcggccatctacgtgtacgacaacaactccaccgaccgcacggccgaaatcgccgccgcgcccgacatagtcgccaaggtgctcgaaggctatgacatggtgatcggcgaccgcctctcatccacttatttccaagagaacaagcgcccgttccacaacttcggcaaccgacttgtgcgcggctccatcaaccacctgttccgcgcgcacgtcaccgacatcatgaccggataccgcgcgttcagcttcaccttcgtcaaaacctaccccgtgctctcgcgcggcttcgaggtcgagaccgagatgaccatccactcgctgaacaacaacctgcgactctacgagatgccaatccagtaccgtgaccgccccgaaggctcagtgtccaagctggacaccgtaggtgacggcatcaaggtcatgagcaccatcttccgcatgatccgcgaatacaagccccttcccttcttcggagggttgggcctgatcattggcatcgtcggcatcgtgctgtgcggcacagttaccttcgaattcgccaaaaccggcgtggtcacgcacttccccacgctgatcggcgcggtgatgctggtcatcacggggcttctgttcatcatcgccggtattatcctggatgtcatggccaagaatgaccgcaagaccttcgtcattgacaccaacaaaatcgcatacaacaagaggcactgacagcgacgtactaaaagatggggcgcaaccgtgagtcgcaccccatcttttagtgtcagcccaaaccgcaaaatatgaaggtgggcaaatcatttacctggtatctgccatgctttcttgaacgtcaacaatgacacccccactcatcttcagctggttcgaccacacactcaatacgcgcaccaacctcaagcgcataatcggtatccgtccacatacgacaagccgattgaatcgatataccgttctccctcccctaccattaagcatcctttcggagtccctcattatccttttccagccacaggtaccacaaatctctcataccttggataagcaaggatatttcccctctgatttggcacgcatcaaaatgcctttccagtgggaggattcgcgcatgctgtacgggctacagatgattgacatggctcttttcatgtgtggacgtgcgagcggcatcgatagcgccaagaaattaaatgacggagacaaagccgtgctaaaaatcgttgatgttattcgccctccatcataaatgtggacacgggttcaaggcttctcatcagatgaagtcatgctcatcaaacctacttacgcaacatccaacgccgggcattagtaccgttgctggaatagagctgaacgttggcaccattaatggtggaaccgttctccaaatcatacgtctaggacccttccagaactgccttcaaatatcgctcaatcaccaccaacacctcatatatatagtgggacatatgtctgatgcttccgatgcctctgatgctgtttctactccttcgaccgtgttctcacgagtggcggcgagcgctgcgtggaagcggctgaaccgtttgatgccggccttggcatgtcgaaattcacgttcaccccgcttctgctgctgggattcctggctttgataccgtggcatagcgccgtatccgaatctacagccgtaccttccgcagcagacgctgcacgggcttaagcaccacggtatcggctatcaccgcgaataccagcgccgccagcaacgtagcgccaaacatcagcacactgatacccgcatacgaccatccgttcgtcggcgtgggcatcctcgggccaatcagcaccttggacagcggcgagtgcaccaagtaaatcgtgtaggaatatccggcaagccaaataatcgccttacgcaaccgtgctgacgtaatgtgcacgtcgtagcggaaaaacaggaacaccgtcatcaccactatcgcaaaggcaaccgtaagcgtgcggccgacctgaacctgctgaccggtgaacagatgcggcgtggcgacggtccaggccaaggcgaatggtgccaacgcatacaaaccataccgtgcgcgtgcggaaggtgggtagtattccagcacaaagcccagcagatagtaaaccagcagtccacgccatgggaatgactgcaagaacaccagcggatatccggcaagattacagatttgttcggcagcggccacggcggcggccagcccgaccagcaaccaggcgcccgatcggcctatcgtacgcatcatcgcggccaggaacggcgttgccagcacgaaaccggcgagcatgaacacgaaccaatagacggaatcgtcatacccggagaacagatcgaacaacgttccagacacagcgccgccaaccgaacgatgatcaatcaccaggtaggcgacgaatcccatgccacccgcatacagcagatacggcacaatcagcgagacaaagcgtttgtagtagtagcgcgcgtacggcgcgaggctgctgggatcggcttggcccgcaccgccgcctgcccgggcatcagagccagagcccggcagacggcccgctgagtgggtgctcaccggccggtcggcatcgaatgtcaggttgaaccggcccgataccataatgaacagcggattgcagaccatgaacagcgcgaacagcacggatcgcgtcacttccgcgctgccggcgagggtcatcttgacgggcatgtagttgttgatcacgtggacgccgatgaccaggcacatcgccaccacgcgcagcagatcgtagttcacgtcgcgcggcttgccggcgacgccggaaacggaatcgggcatggtcatcacatggatcccgccagggacttcagatcgaccgggcagctgatctgactcttcaacttgtccaaggcgtccaggccggccgagggatcggaggacgcgtccttatgcgcgtcgttcttgccgccgtccgcgccgccgttcgcgccatcggcaccgttcgcaccatcggcgccgttcgtatcggccgggcactcatcggtcacattaccgttggagcccgtctcgacgccatccgcattcaccaccggcgtggttaccacgttcagtggatgtgtggcatcgctgctgacccgaacggtataagcaatcgtcaattcttttccgggctcgatccactgctggttgaacataatgtactgacggtcatacaggctcgcggtgttggtaccccatgaatctatatcagcctgcacagcggtgatctcgccaccgtacggagcggtaagcaccacgcggtacaacatgccgccgagcactggattctccgagccgccattaacgaaatcaggcaacgattcggccttagccttagtcagcgtgttcttcatggtgaaggtgaccgtgtattcgtcaccgagctgatcttccgtaaactgacccagatgcgtgttacgcacggctgtcgtgatgcgcttatccagcacgccagaatacagggcgttctggctggctgaggcgtcgccgcaggtttttgtgaccgtggtggaggtcttcagataccaatcctgcttgccttgctgcagctccgaaagatagatgccggcttcgggcacctgactgtcagcagacaactcgccactggccttatcgtcgataagtccggtggcaatcagcgcctcctgctcatccggatcagccatccatagcttgaaatgaccgctagcgctggtatctctaattgccttcaacagcggggatgcggtagaggcattcgcgttgccaagcacatggttcataattgcttgagccgcttcggaaacgaagttgttctgctgctcgaagtccgggtaatccgtgtacaggtctgaagcgaagaacggcaccgtggtggtgctatccagcactcggccgtccgaaagtttgacctcgcctgtggctcccagcaatgcctggagaaatacgggatcgagtgacaatacacccgctacgttctcgtcttcgttgcctttctgatacagccacatgtatttgttcatctgtgccacacgctggaattcggggtcgatggtcgtggtggccgggtactggtcaaaagtgccaccaaatacctggcgctccttcagcaccgtatcatccattggctcctcaggaatgtcccaaccagaagtggtggcgaaatcaccgatggtaatcgtgcccttatctgccgtgattgcggcgatggtgcctaccatgccgcccgccgaacgtagctcggccgggttctgcaccatcaccaaatacgtgcgcttgccgtcctcgccaagcagttgcggtagcaagttaatgaggccatcgtattcgccgatcatcgaatccacggtcttgagcgcagccttttcggtttcgagcacggtggccaccttggcgacgctcggagtcggcaccttgttgagcttggtgagctgctgcgagatatccttatgcgcctgcttgacgatatccggcatatccatcagggcgctgacgtccaccgagccattcttcagggagaagccctgcaatcgtttggacaggttcagcagatcagtgaacggaccgttgaccagcgtatccacggaagccagcatttcgcgggcggcggtgatgtcgcttccgaatcgcgaatggtcgcggaagaagtcccactgtgggccgttcagctccgcattgagatcattggtggcattgaccagctcttgggagatgtccgacagactcttatcgctgccacagccaagtgccgaattggccagactttcggcggatgtcagcacgcgctgcgcatccgtggccattctcgagacggatgccgcgtagagcgtgcccacacaggtgacgctggccagcaacgtcagcagcagtacaaccaccactcgcgcccatatcggcgtacggctgatcagcgaacggccgttaccacccacgtgctggggagtcttcaggtttacgggacccgtctgctgattcacagcgctattcgtagatgcggagcgattgaattttccgttaccggcatgacgtcttctcctacgccccacagccttatggctcgaatgccctgaagtgaatcgcatacttaccctgcccgaaaatctgctcagctcatactcttatccagcggcgcgaggccacgcttccggatgccggactccgggcaaatccggaatcgcagacatgccggagcacacgtgacgccacgcatatctcatgccagtgtaccgatgccaccgaaatagaccgaggatttatcccatactgggtgcaaatccccgcatgaccaccacatcgctgtcagaatgttctcagacttcattgaggggtataacagtattgcgcaagaaaacggtcactaaacgcaacaatagttagagccgtattgatttgttcggcttaggagaacgggagaggtaattacatgttcgtcctcagcaacgcctggcgggccctgacacgttctaaaggacgtacggccctgaccgcgttcatcaccttggcggtcaccttcggcacagtcgccggactggccatcattcaagaagataccaacgcacacaccaccgcgtacgatcagcagaaggccacgttggccattcgcccgactgcggctacgtggaagaaggtctccgctacggactcggcttccaccaagcattacatgacgtggacctcatacaccgaatacgccacgctcgtccagtcggccaccaactcgttgaacttcacggttaccgaaaccgtgccggcccgcgtgagcggtgatttgaaggccctggacggcggatcgctgggctcggcctccgatgacgagaccggcggccagctcatttggcgagccttctggaccaaggattccgccaaggccagcgacctcggcaccttcgaaatcgtggacggcaaggacctgagctacaacaaccagtcctccaacccgaacaccaccggcgcactggtctctgaagcgtttgcctccgccaacaacctgaaggtgggcgatacgctcgaggtggcggccgcctcggacgccaagaccacggccaaactcaaggtgcgcggcatctacaagtacacatccgaatccgccgtcgccaatccggtgacggccgcccgcaaccgcgagaacgcgatcttcaccaactatcagaccttcgccaaggccggactcgacccacagtccaccgacaagaccgtctccggctgggcagtcccggatctggacgtggtgttcgacgccggtgattccgctacatacaagtccttggtatccaccctcaagaagtccaagctgcccgccaagggttacgagttctcttccccctcgctggaatcctacaacgcttctctggagccgctggatacgctatcctcgcgcgcgaagaccggcaccattgtgttggttgccgtgggcggcgtgctgttgctcatcctcgtgctgtcgggcgtgtgggcgtccaagcgtgacgacgagatcggcatggcactggtgtccggcgtcactcgcgggcgtttgggatggcagttcatgctggaagtgttcatcgtcaccctgcccttctacgtgattggtctggtcggaggcgcgttcgccgccaagccgatcggacctgctctggcatccggccatgccatcccggtgacatcggacctgatttggaccatggtctggtatggactgggttcaatcctgatcctggcgattcttgccgccctgcgccttgcgttcttcagcgcgaacaaactgttcgccgccgatggcgactggggcaccgtgagcgagaccaacaagacgaccaccacaaccgacgatgcggaggcacaggcatgagcgacaggaacaacgatcaggaactcgagaagaccactgacgcaacggctgacgaagtgacttctgagactgagacgaacgacaccattgaatccgttccagctgactccgtgcagttcagcgtgaccttcgatgacgttgatgacgaaggcactgttgacgatggtatttacagcgcactggcatctgccgaaaccggagaaaccgacgagaccagcgaggccgaagcagacgccatcgcttcggtcaacgcatccgccgaagtgaccgagcgcaatgccgcccgcgtcaacgaaacactccgactggccaaaaccgatcacaaagacgcattggccgagcatgcggagcctcagggcaaagcgtccgaacccaccatgacgctggcctcgcgtatcgatcgcgtgttggtgggcggcggttccgacgacattctgctcaagacctacccgacctttgccctgaacaaggtgacggtcgccggccccaagggcaaggtcaacatcctcgatggcgcgaatttcttctgctattccggacacgcatacgcgctgctgatcagcgacgaccccgattcgggcatcaccgccgacgccaaacgtcgcgcgctgatgggcgtgatgagcggtttggccacgccggcgtctggcacggtgatgaacaagagcgccaacattgttgagctcgagcccgtggaactgcgcggccaccgtctgggcatcgtaccgcagctgcacgccgtgcagccgaagctcgacgccgaacaaaacgtgctgtacgccatgaatgcgtccaaccgcaacttcctgaagcccaagccggtgatcgcccgcgaactgctggccaaggtcggcttctctgaggccaccagcggcgtggctgtcggcacattgcctttggtgcagcagcgtttggtggccatcgcccgtgcaatcagcaccgaggccgaggtgctgatcctcgacgagccgacacgagggctgaacgcggatgacgaggtgaccgtgttcgccgcgctggccaagctggcgcacaccggtgacccgaagcactgcgttatcgtgctcactgcgtcgcgcgagatcgccgaagcagccgacacactcttcgaaatctgatgttcagaccatagagccccctgtgattcgtattgccgaatcgcaggggtttttcaatgctgcggctcattgccgcgctaatctgaggataaatctgaccgtacgaggcgaaacctgataattatgaccggatatattcccacactggagcagatcgacgagttgcaccgcaaaatcgcgccgtccaaggcggcgtacgagctggtgcacacgcattgcgtgattgtagcgaccatcggctgccagatcgtgcgccggcagaacgcgctgttcacgcgccgctgcacattaccgaaggacgcggaggtaccgcccaccgcaggcgtcaccggcggccatgtgccgccgcgtctgctcgacgagcatttggtactcatcggcggactgctgcatgacatcggcacctaccgcgtgttcaagcatgacggctctgacggcgaaccgctcaaattcagcaagaaacgctacattctgcacggtcttaagggctacgagtatctgctcgacgagggcgtggacgagtccatcgcccagttctgccgcaaccataccggcgtgggacttacgcgcgaggatgtggtgcgccaggagctgccgttgccaccagccgactatgtgccgatgaatctcgagcaggaagtggtgatgtacgccgacaagttccatagcaagtcagtgccgccgaagttcctgcaggtcgaggcgtatacggcccgagccgagcgatttggcggagagaacaaacagcgatggctggatctggtagccaagtatggcgtgccggatattccggcgttggcggagaagtatgggatgcggatgatttgaggctctaggggtctcccccaagtcagcctgtcggctgacagccccctcgtcagagggggcttatgaaggtatttcagatggaacggagacggtaggtgccgttgcggttggagacgatgatcatctggtcgttctccagcacgttccagccttcctgcttgtagccggaagaggagaccacgacaccggcggagtcgccgttgtcgtcgcgcagctcacggtagcgcatcacacggtagtcggcggcctgctcgccacggccgtactcatcgtagatttccacgatgcgcgggctggtcttctcacgaccggcggcgcacagggcgatgagctggtcctcggactgaatcatgcagttgtagctggacttcgggtaggcttggcgcagttcgcgcacggcctgggccacggcctcgtcgagcgagaagccgaagccgatgtattccagaatcaccgcgaagaagatggcggagtcggaacggccgccggtggagaggaacacgctgtggttcaccgggtatgagcggttggtgacgatgttgcggccattggcgtccgagatatcgccgttgtggatgaagctcaggccgttcgcatagaacgggtgctggttctccatgatgagcggcagattggaacttgccaagcgcaggtgccagatggcaccgcgagacggttcgtcggccagcgcctcaaacgtgctgtcatgacgggccgcgatggtcgacttgtagattcgggtgccggtttccggggtgggtgcgccaccgtcgcgcacgtgcggtgcttcggcaggatcggaaagctgggctacaccccagccatcattgtggatttcagacagttcacggaaatcctcgacattgtcttgccccaacacagcgttgagactcaggttgaagcctgccgtcgcgtatcccagtaatctgcacatggtatttcaacttaccgaaaccgtgtggcgacgtgcggcgaccgttataggcattctttatagagcgcatcagcgccgctgcaaactggtatgttatcgcttctgtttggcggagcgctgaggcttggcggcggatttgccgttctcggccttgcccttatcgcccttatcgccctgctcagcgggcgcatcggcggcagcggcctcagcggtcttccgcgcctcggccgatacggcggcatcgagctcctgtaccaatcgcccaagcccggacgtggtgtccatcgggtcagggacggcggccgggtcggccactgcacgagtcggcgtgggcgtcgggatggtcttggccgtatcggtgcgcttcagacgcggtgggcggcgggtggagacgaacagcggctgcacctcgaccaacgggttgtaaggtgccagaccgaaccacttaaccggcgagccggccatgtggcggattgcgtacttggcttgcaacgacagggcaccgcgtgcggaaaccttggattccggcatcagggccttgtgaatcagcacgtaacggatggtgccgatgtccggatcggcgtcgaccttggggtaaatcgacttctgcttaggcagttcgccggttttggacaggtcgtgcatgatctggtggatgtacgccgggatggactgcgaaaccttgaatcccagacggaagcgcacgcggtagatgtagttcgtgccgaagtcctccaccgagtattcacgggtgaacggctcgtcggtggtttccacgctgactgcccaccaagcacgggcgcgcttggggtggtcggcgaagatggagaagaagatgtccgtgtcgagtcgcttggtctccgagtcggaggtcaggtacacgatgttgtccgcaaaatacgggatgcggaaatcactgtgcagcttgtcgagcgcgggtaggaagtcgttgggccgcatgtgacggcgttgcgcacgttcgagcttggtgccctcattccacgtgtacatgacgaacagaatcgcggcggtcagcaacatggtgaaccaaccaccatgcaggaatttggccatagacgcgatgaagaacatagcctgaatcgccaagaacagcacggtgaacacgatggcaccgacccgcttgccggaatgccataggtggacgccgagcaacacggtggtggtgatcatcgtaatggtcaacgccagtccatatgcggcagagatgtgttccgaatccttgaagatggcgagtacggccagcgtggagatgcacagcacgccgttgaccaccggaatgtacagctggccacgcgtgcgggccgggtaccgcacctgcagatgaggcatccaattgaggcgggtggcttcggagaccatggtgaacgcgccggtaatcagggcctgggaagcgatcacgccggccgaaacagacagaatcacggccagataacgtacgttcggagacatcatctggaagaacgggttgagtgactccatcgcagtgtattgcgggttatcgctattggccagcatccacgcgccttggccgaagtagttgagcaccagcgcaaccttgatgaatggccaagtgaagtagatgttgccgcgccccacgtggcccatgtcggagtacagcgcctcggcaccggtggtcgagaggaacacggtgcccataagggcgatgccggcagcattgttcgggctgaacaggaatttgatgccgtacaccgggttcagggcctcgaacacagaccagtcgttagagagattcgtgacgcccacgatggcgaggaagccgaaccagaccagcaccatcgagccgaatactttgccgatgctttcggtgccgcgcgactgcacggagaagagaatcacgatgatcacgacggtgatcatcagggtcaggcttgggttttcgtcgaacaacccttccaatggcggcagggtctgcaagccttcgactgcggaactgatggaaaccgccggggtaagtaccgaatccgcgaggaatgccgcgccgccgagcatggcgggaatcgcgagccatgcgccgtacttgcgaatcaacgagtacagtgcgaagatgccgccttcgccattgttgtcgatgcgcatggcgatgagcacatatttgacggtagtgatcagcgtaatcgaccagaagaccagcgacagcatgccgagcacggcctctcggtctacgctgccaagccctccctgaccggcaaggaaggtctgcgcggtgtacaagggcgaggtgccgatgtcgccgtacaccacgccgagcgccacgattgccatgccccaggtgaccttgtctgggctggattgcaggcgggcccaccatcgaccgaggccgcctttcgaccatgcgctggcgattttctcggcttctttggtttcagcttccctctgcttggcgagtgcctcgcgctcctccttggtgagagtgcggcgggacaccttgggagcgttggtaaaggtgtcggccctcagcagtgcttcttcttcctgtcgggccttggctttggcggcaccagactgggctttctgggcctttgaggctttttgggcacgtgcggtcctttggttcgactcagccatacgttcagtcctccattgaggtggagatcatcccctcgcttatgtcaaacacatcatgatagacctcgttcacaattctgacaaattttacaagtcaacacatcgtctctacacgcgccgcgacggccgcacacccggccctcacagtccgtatacggcgcgggcggtatcgcgggtgccgcgcgccacatccgcgatgggcaagtcgagcgtatcggccatggcccgcaaggtgtagggaatcatgtacggcgcgttggtgcggccacgatacggcatgggcgtcagatacggcgcgtcggtttcgaccatcgcatggtccagccccacaatccgtagcgattcgcggataccgtcattgcctttgtagctcacggtgccggagaagctcagataccagccatgttcgcgcgcgatctcggccatctcacggtcgccggaatacgagtggaatacggtgcgttcgggcgcgccgtcggccagcagggtttcgatgacctcgcgatgggagtcgcggtcgtgaatctgcatgggcaggcccagttccttggccagggcaatatgcgcgcggaaagcctcgcgctgcagttccttggcaccttcgccggtgcggaagaggtccatgccggtctcgccgatagccaccacttgctcggggtatgtggtggcgaggcgatgtacttcggcgagcgcgtcctcgaaagacgtgtcatggtaaggcttgtatttgaggggcagaccatccggccccggcacaccgcgatgcccgtggagcacggactcattggggtgtattgcgagcgccgcgtgcacattacccggatgatcgagggccatctggacggcggtcatcaggtgcggcagctcgcaaccgcagtcgataataccccaatgccgacagattgcgcctgcgccagcaattggtcgacgtcgtacaccgggacttcgggctgtcccttctcctgcgcctcatggctcatagcgcgcgcgaaagggattacggaggccacgtgagtgtggttgtcgatggtctgggcatcgtccggcaatgcttcaggtgccggagcccagctacggtcgcgatggtggtgcttgctcatggtttctcagtgtaggctgtttctcagtgtaggctaccgccagcaacgctcgtaaggcagtccggtaagacgttcgactacacgacgggtatcgtcggtcacgcccgcctgaacttgccgtttcttgccacgagcgcaacattcccgggagagtagcgcaaccggcaagcgagacggtcgccatcctgccgcctttttctgcatcatcagcccattttctgcctcattttgataaaatatgatgcagaaaagttcgtatgatgcagaaaatgaggcagtatgagatcatttgactacatcgaatcaggtaagacgttgctcaccccgcacaccacgagtttgcttgccgctattcacgaggcaaaagggcgtcaaagcatacagacaacgatcagaccggatatattggggacgctggttgccgtcgcgcgcatccaaagcacagatgcctcaaaccgcatcgaaggtatttctaccagcgatagcaggctcaacgatctcgtctcggagaaagtcacaccgcgcaatcgcaatgaagaagaaattgccggttaccgtgacgcgctatcggttattcacgaaagccacgactatattccgattaccccgaacgtcattcttcaactgcaccgcgacctcttccgacacacaccactgacctttgcggggcatttcaaggacagtgacaacgtcatcatcgaacgagatgcacacgggaccagcaccgtgcgattcgccccaccgtccgcacttgtcacaccggaactgatcgaacgcgcgtgttccgcctacacgcaagcaatccgagatggacataccgatccattgcttgccatcgccatgttcattctcgatttcacctgcatacatccgttcaatgacggcaacggccgcatgagtcggctactcacgctcctgatgttgtaccgcaatggctatatggtcggcaaatacatcagtatcgaacaccttatcgagcaaagtaaacgcacttattatgaggcgatgaccgcaagcacccaaggatgggacgacaacgccaatgattatgcgccattcacgaactacctgcttggcatcatactgtccgcgtgcaaggaattcgacgaacgcatcaatctcgcggcaggcggcagagcgcagggagcaccgcgagtagccaccaagggaacgcggattgaagcactgcttgatcaatccctagtgccactctccaaggccgatattctcgctcgcatgcccgataccagcaccaccaccattgagcgcacgctgaaatcactgttggactccggtacgatcatcaaaatcggtgctggtcgcagcacccgctatgtgaaacgccgctaaacgcatccttgtgcgcaacatctcgtcactcttccggcgctccgctggccacgcgaatcatcgcgtactgggactcgtagaggcggtagtacgcgcccttggcggcgagcagctgcgcgtgcgagccgtgctcgacgatctggccgtgatcgatgtagaagatctcgtccgcgttctcgatcgtcgacaggcggtgcgcgatgatgaagctcgtgcgccccttgagcagatgctgcaggccggcctgcagcgcctcctcggtgcgcgtgtcgatgttgctcgtcgcctcgtccaggatcaggatacgcgggtcggcgagcagcacgcgcgcgaaggcgatgagctggcgctggccggccgacagggtcgatccgcgctcctccaccaccgtgtcgtacccgtcgggcagttccatgatgaactcgtgcgcgtgcacggccttcgccgccgcctcgatttcctcgtcggtggcgtcgagcttgccgtagcggatgttctcgcgcacgttgccggagaagatgaaggtgtcctgcagcatcacgcccatctgccggcgcagcgatgcgagcgtcacgtcgcgcacgtcgtagccgtcgatcgtcaccgagccctcggacacgtcgtagaagcgcgacagcaggttgatgatcgtcgtcttgccggcgcccgtcgggccgaccagcgcgattgtgcgccccggttcgacgtggaagtccacgaggttgaggatgttgcggccgtccttctcgtagcggaacaccacgtcgttgaagtcgacgcgcccgcggatctgcggcaggtccgccgcgtcgggcttgttgcggatctccggcgtgacgtcgagcgtctcgaagatgcgctcgaggtacgccgagcaggtgatgagctggttgtagaagttgccgatgttgatcaccggattccagaagttgttcgcgtagccgacgaacgcgatgagcacgccggtggtcacgttcacgccccgaagcccatcacgccgacgaagtagatgaacgagatggtcatcacggagatggtctgcacgcccggccacatgaggaactggatgtgcacggcgtgcatccacgcggaacgcacctcgccctgctgttcctggaaggtcctgaactgggcctgctcctgtgcgaaggtctgcgtggtcttcacgccggcgatcgactcgtggatgtaggcgttcaggttgctctgcttgttggagagcttctggaaggcgcgccgctggaagatctgcagcacgcgcacccagatgatgagcaccgggaacaggatcaggctccacagggccagctgccagtcgatcacgaacatcacgatcagcgtgatcacgaaggtgaacacgtcggagatcacgttgatcagaccggagctcagcgtgtccgaaagcgtgttcacatagttgaccacgcggatcaggatcttgccgtgcgggcgcgaatcgaagtagctgaagggcagcgtctggatatgcgtgaagatatcgcggcgcatgtccttgagcatgagctggccgacgcgcgtgatcgccaccgtgcggtagcgcagcccgaactcgtacagcacgatcagcgcggcgaggatcacggcgaggatgccgagcttgccgaggtccttgttcgggatcgcctcgtcgatcatgatcttggtcaggtacggcacggcgacgacgatgcagctcatcgagatgacgacgacgagaatgcgcgccacctgtgccatatacggtttgagatatttgccgacgcgcaggatgtcccggaagttgatctgctcctcgagttcctcatcctcgcggtatgtattgcgttgtgccataagtcctcttctaaaaaccttgtgcgacgccggactggagtccgagctgcttgtggtagatgtcccagtagcggccgtgtgcggccacgagttcggcgtgggtgccgcgttcgacgatacgtccgtgctcgagcaccagaatcaggtcggaatccttgaccgacgagatgcggtgggcgatggcgacgatggtcttgccgccgtccatctccttgaggtgcttctggatctccgcctcggtctccatatcgacggccgaggtcgtatcgtccataatcaggatcgacggattgtccgcgagcgcgcgggccagcgacaggcgctgcttctgcccgccggacaggcccacgccgcgttcgcccacgacggtgtcataaccctgtggcatcgacctgatgaaattgtccgcgccggcgatctgggccattttctggatatatcggtcgtcgctatcaccgctggcaccaaaaccgatgttgccgccgatggtgtcggagaacaggaaggtatcctgcgccacgatgcacacctgcgagcgcaaggtggccagcggccagtcgcgtgcgtcgatgccgtcgatgagcacatggccaacggtcgggtcgtagaagcgggagatgaggctgacgagcgtggacttgcccgcgccggtttcgccgaggatgccgagcttggagccggcgggcacggtgaagtcgaggtccttgaggatcggggtctccgggtcgtccgggaaggcgaagctgacgtggtcgaagcggatgtcgcccttgatgtgcagcgggcaggacttgcgttcggtggactgctgggcaccggatgttccggaagccacgggcgctccggtagccccggtagcctcatcatcgtgcttgacttgctcgacgatcgtgaccgcctgcttgacggtttcgaccgcgtcgggcttctccacgatgcgcggctgttcggtgagcagcttgcggattttgatgcagctggcgttgaatcgctgccagtcgttgatcagccagccggactggcgcaccgggccgtcgatcatccacaggaaggagttgaaactcaccagattgccgagggtcatgtagcccttgatgaccagaaagccgccgaggccgagggtgatgagctgcagcgagaagccgaggccgtccagccacggcatgtacttgcgcgagttgtaggccaaggccatgttgcactgcatgtaatcgtcgttgtgctcgtcgaacttttcggtctcgtacggttcgcgcacgaatgccttgaccacacggttgccctcgatgttctcttcgaccatggagttgagggaggccagcgagttgcggatggcgaagaacagcgggtgggcgtgcgtggacaggccgcgcgtgagcacaaaaatgaacggcgtgacgcaggccaggacgagcgcgagtcgccaatcgatggcgaacatcacgcacagggcgcccacgaacatgaccacgcagtcggcaatctgatagctcacccaactcaggcagtggcggatcgcgtcggtgtcggaggtcaggcggctcatgatgtcgccggtgcgtgtgtggttgaaatacgtgaagtcgagctcgtgcagcttctcgtattcgtcggagacgaggcggtagaccgagttctggccgaaacgctccatccacatctggtagccgtatcgcgcgcccacgcggatgatggtcatgaggatcatcagtccacacagacgtggcagttcgtcggcatgtccgccgacgatgacgcggtccacgatgataccggacagaatcggaatggtcagggccatcgtgttatttgcgatgaacagtagaagcgcgcctaccacgcggggcaggtctggtttgcagtatggcagcacccatttgagattgcttgcgctggtattgattcccggatcgacgtacatgtgaggagatcaccgtttcttggggattgtttgcttgtggtatggtgcggcatgctcctgcgccgcacgcggcaatcgctgccgccgcgattcacgatcagccgtgcttcgcactgcgcctgtcattggccgcatgaccgaagctctccttcatcggtcgaagcacgttcgactttcgcaaacgcgtactagtctagacggcctgcgtctaatcgcaacggcccgcaactctgcgtgttccccgcattagcggcgatacgcggctctctaagcgcaacattccccggaatgcgtcgctgcacacctccgaacaggtccaattcgcaacgcattcccgggaaagtggcgcatgtcatatcacgctcaaacaacccagcatagtgagtggttcattcacgttttacgtattgtgcgacggaatcggcatctcccgcaacacgtgagatatgcaaaagtgccgcacgctgaatggtgatcagcgtgcggcactgcgcgaaacgcgtgaaatccgcagaacgcacgaaactcacgaaacagataaaacgtacaaaacgcaagcaaggcgaagcaacgaacagacagagacagtccacctacaggtcagaacgccagcgaacgcacgtaggaaccaacttgcgggcggaacagctaccggggattgttcgtttgcgatgttcgcattcatggcaggtttctccatacgattcgggcggtcggttcaggaggttggttggcggaggcaggttcggtttcagcgtcggtccagggccacccagagcacgccgtgcggcggaatcgtgccggtgatgacgcggtcggcacccacgccttcaagacgcacgtcggcgggctcgcccggcgcgtcggcatacagatcggcgagtgtccaatcgtcattgcgggcgtcaagccccacgatggattggagctggatgttgcggccgatctcgtatgtgtcgctgccggtccagaacagcgcggcgtaatggccgccgtgatgcgcggaacgtgtgccatcggcccaatcggctgcgtcggcggaccagacgatgaactcgccacggcaggtgctctcatcccaccatttgccaaaaatccgttcgcgcacggtctcgcggttattggtggagccggcaagcacctcacgcaacgcgggattctgcagcagcgcgatggcgtcgctgttgctggtgggcagatcgccgccgaccataagcgggctacgccccatgcaccatagggccagcagtgtcttctgctcgtccagcgtaaggcgggattggcggtcgtcgccgcgttcggcgcgcaggcctatgtgcccgaacggcaccatgtcggcgtcggcccagtggccggtggtctggaacggcgcccagcgggccaggcgggcgaactgctggtagatgtcttcccaacggtcccacagatcgtcggaaatacgccacatttgggcgttctcgcgcaggaagtcgacgtagctcgtcgccacccagccgccgggcgagagagacaggtcaatcgaacggccgtatttggcttcggctttggcgatggcgcgatgataggcggcgatttcgtcggagtggaacggggtctgcatgtcgtcgaccttgaggaagtcgaggccccaggaggcgaacaggtcgagctgcgcgtcataccaggcctgcgcgcccgggtgggattggttcaggccgtagttgtccggattccacttgcacacgtggtcgaggtcggccacgtccttggcggtgtagttggtgccgtatacgggcaggttcttgtccacggcgatacgcgggatgccgcgcatcatgtgcatgccaagcttcaagcccagttcgtggacggcggcggcgagcgggccgaatcccttgccgccggcagcactcgggaaacgcaccgggtcaggcagctgacggccgtattcgtcgagaatcagcggcgcgttgtcgttgtaaccatgtgcgcgggcggtcgggtcgtaccagtcgatgtcgatgaccagcgtatcccagccggcgtttttcaggtgttcagccatgaaccgcgcgttggccagcagctcgtcttcggtgagggtcgtgccataggaatcccagctgttccagcccatcggcggacgccatgcctgaggaaggctctgcggaagatccgtcatcgtatcctgctttcgttgatattcgcataagttgccctacggcggtatgccagccgcaaaccaatcggcatcgcgcacgtacggataggtgaagagtgacgccactccccggagagtcccatcccaacgtacgacgaacttcatggcctcttggcacaccgacgtatgtaccgttacatattcttccaccggaacgatatcaagcaagcgcatgttacgctcggcgcgtcatcgcctaagcgcagcattttcagcgattccggcacacagccaccatttgccaaaacacgatgttgtgaataccgttacaaccattggaagcattacgggcatgatccaatgcccatcacaggcgaaacatgaggtgacgttatgccgagcggcaaaccaacattgcgcgacgtagcgaaagccgccggggtctcccccatgaccgcctcgaatgcgctgcacggcaagccgggtgttaaggattccacgcgcgccaaagtgctggcagtggccgaaaagcttgattaccgcatcaatctgacggccagcatgctgaagtccggccgcagcaacatcatccacatcatcgtcaacgaattcgattcgccgttctactccaaactcgtcgaatcgctcgtcaccgaaaccaccgagcgcgggctgacgccgttcgtggagcaaacccggtactctccggatgccgccaaacacgcgctggccaacaacccgttctccgggcagttgttcgacggcgagattatccacgcttcgggcctgaatgccggtgtgccgctttccgcgatcaaccacggccgaccgctggttctgattgacgcctgcgaggaaacgcccacgttcgatacagtgaatttcccgaacgaggacggtgcgcgggcggcagtgcagcatctcatcgaatgcggatgccaccgcatcgccatcgtcggcgacgggtattcgccacgaaccgaactggcgcacgtggaaagttccagcggtttgcgcctgcgcggggccagcggcgcgttgctcgatgccgggctgccgtatgacgaatcgacgaacttcattggttacggtagcgacagcggcatcgaagccggtcatgccatcgccgaggcgatgctcgaggctcgtgcgcaatcggctgatgacactgctgagtcccgttccccgggcaccacgcgggcaacgggaagcaccccggccatcgatggcatcttctgcattaacgactatgccgcattcggagtaatccgaggccttgccgactacggcatccgcgtgcccgacgatgtgagagtcatcggcttcgacggcgccacggccggctcgtacaccacaccgacgctgagcaccgtccaagtggatctcgatcagctcgcccaattcgcgcttgatatgatcacccgccgcgtggagcagcgcgaccagggcgacggcaggtccgacgaatccgctggcatgccggccacgcgcgccaccattggatacacactggttccgcgcgagtccactgtcggttcggcaaacaggtaacgctgaaacgccgaaatagggcggcgattcccgactgccgcgcccactgcccaagtgccgtgcagcgtgacgtgcgaggtttcggcatgcgtcaaaccgttcccagcgctcccacgtggtagtggcgcccatgcgcacttttcctagggttaggaccatgaccttccctaatcacacggtgttgtagaggcgggcggggaaagcgtcgcggtattggccgggggtcaggccagtgcggcgcttgaagacgcgcatgaagtacttgggatcggcgtagcccacttctcgcgcaatatccgccacgctggaagcggtagaactcagcagttcgcgcgcacggtcgatgcgatattcgatgatctgctcggccacacccacgccgaacacgcgccggtacatcgcggtcagatagctgggtgaatagtggaagcgcgcggccactttggccacggtgatgtcgtcgaaggcattggccataatccacgagcggatggccagcatcggcgccaggccggacgaatcgccagcggcaccggccgaatcgacatgcatggcccattcctgttgctgccggacgcggtcggcactggtgatgggcttgccgtcgccccggtagccggcgagcgtacgatgggtggcgaagtccgccttcagccgctcctgcgcgctgacctccagcagcaggccggtggcgaagtaatcgcagtaagcgttggaatacgggccgaatcgcgcatagatgtcgatgagctgcccacacatcaccgccagccggtcggggtcaggcagggtgcgttcatcgggcagcagcaggcaatggtcatcctgcggcagacccgcgtcatcggggagcatgcgcgcatccggcaatttgaaatgcatccagtagaagtccacgtcagacgtgatgatgtcggcgcccgcatgctccacattcggcggcaagagtgcgatttggccggcctcgatatgcagggtctgctcccccacccgcatcggcaggacgccccgacgcacgaacatcagctcgaaggtgtcgatggtgcgccgcagatggcgccagcccggtccggacacaaactgcccgaccgagtaaaagtccaccggcccttcgagccgacatgtcgtgatgcccatggctaccagagtagccgagagcaaatatcagccgcgcagccagacggtcatttcgttttcgccgcggttggcccaggcgaagtacgggatgagcgtggcggtggcgggctcgcgcttgaccggcgcgtacacggcgtagagcggtgcgaacgccggaacctcggccgcgccctcacccgcggcggccacagcagccggcaacggctcgcgccaagccggcacctcaagcttcaccatgcggcgggtcacatcttccacctcgccctggcccttgtcgtcgatgcccttggcgccggcgtggaagtcgaactcctcgaccttggccacgctcggatcggccagcagtgcctccgtatccgcgtgcagcaggtgcaggttcgcaccattatccttttcttcagcgcagaaagtaatcgggccgcgcacgaacgccaccttgccggcgtcctcgcgcaccagcgggttggcggccagcatacgtaccggcatcgggaagtcgaacgtcacggtgtcgccgtcgcgccattcgccggtcaggtacaggtagccgtcgcggatttcgcgggtcacgcgggaactatcggccccagactcagactcgcccgtggccgtaatcgcggcggcagcagcggactcatcgcccacccaaccgggcagacggaaggccagcgtaaagcgagcaggagcctgagccgaggtgccagcagcgtcaccgcccaagcgcacgacagccttgccatcgccctgccacggcaggttcgccgtaacatccagctccacagccgtaccattcaactcagctttggccacgccgcccatatacaagtgcgtgaacagcgtaccgccatcctcggcaaccgtgtaggcatattcctgcaccgactcaacgatgcgggcgatgttcggcgggcagcatgcgcagccgaaccacttctgacgcaccggcttgacgtggcgcaggcggctgtctttatggcaggcatacggattgacttccagcgggttcacgtagaagaagctcttgccgtccagcgccatgccggccagcgtggtgttgtacagcgccgactccataacgtccgcgtactcggcctttggcgcgagctcgagcatgcgacgggcgaagaacgccagcgaaatcgcggcgcaggtctcagagtaggcggagtcgttgggcaggtcgtagttgtaggagaatgcctcgccgtccaccgtgccgccgatgccgccggtaacgtacagtttcttatcgacgatattgcgccagagccgctcggccgcatcggcgaggtcctggtcgtcggccagtcgggccacgtccgccagaccggagtagaagtagccggcgcgcacggcatggcctacggcttcgtcttgttcggtgaccggcttgttcgcctggtgataggcgtaccggttggggtccgtgttgggtttgtagttggcgtcggcgtcgcgctttgcgttctcgtctgcctgaatatcgaagatgtacggctgccggccgcgctcggtcacgaaatattcggccagatcaaggtaccgctgttcgccggtgacctcgtacagcctcaccaaagccatctcggcaatctcgtgaccggggtaaccacgcagctggcccggcttgcgaccgaagcgctcgtctacgtaatcggcgaaacggcaggcggccttgagcaacttgtctttgccggtgccctggtagtaggccaccgcaccttcaacgaggtggccgaggcagtacagttcgtgatggtcacgcagattggtgaacgcgcgatccatgtcgttcagaatgtagcaggtgtccagatagccgttgtcgagttgggcggcacacacgacgtcgatggcttggtcggcggtctgttccagtgcggggtccgggtaatgggcgagggaatagccgactgcctccacccacttggagaagtcggtgtcttggaacacgaagccgtagaacttgtctgggtcgggattggccgggtcttcggggagcgcctcaaatccgcggaacgtgtacttcggcggcacgaacgccttgccctgggtatccttacgcttgttttgcgcggcagcggccttgaagttgtgcatgcagtagctgggggccgcgccggggacgttatcgttcagggcgttccactgatagggaatcacagccgtgcgcacgagttcctgctcggtgcgccagaacgaatcggtgacggtgacgtttttcagggccagcggcttgctatgcagcgaagtcatgacgtactcctttggactatgcgacattcgtcaacaatatgtatcggtacatatgatacgtgcgcccgcgcgagcagcaaggtggacaaatcgttggcggggtggaatcgccggcgcatatccgcccgtacgatttcgcccggtgaatcgcccgacgaatacacggcgacttatactaccgacggaccacaaacgtcgcctacatgaatggaagatcaatcatcatgacagcaaacgccagcgcacgggccatcaaacccgaacttctgcgtacgtacaccgaagacttcaacaaagaccgcgccaacctgatcgcggcggacgcggcggtttcggccggcgtgctcaaggcggccaccgactatcgcggcgtacgtgcgctgccgcgcgacttctccatcgaactcaagcagggttcgatcaccaatcaggagcgttccggccgttgctggatgttcgcctccctgaacacgctgcgttacgaactcatgcatcgctggaatcttgaggatttcgagttctccgagacctacctgttcttctgggacgcgatggagaagtcgaacacttatctggagaacgtgctgcgcacgctcgacgaggcgaccgattcgcgtctgttcgaggccatcaatgagtcgcctgcagacgatggtggctggtggcagatgttcgccgcactggtgaacaagtacggcctagtgcccaagagcgcctatccggagtccgagaactcccgcaattccgacgatttcaagcagtacctcaactccaagctgcgcgagttcgcggccgagctgcgccgccgttcggctgccggggcgtctgaggacgagctgcgtgcgttgaaggacgagtacatgggcaccgtgtaccgcatctgcgccgtggcgctcggcgaaccgccggagaagttcgacttcttcgcgcgccccaaggatgatgatgaggataagaagggcgaggctcgcaagtgcaaggccgaggccgacgcagacggcaaggccgaatcctgcaagtgcggcgaatcctgcaagtgcgagggcaaatccgacgccaaggcctgcaagtgcgataaggacaagtccgacaagccgaaaaccggcaaggacgagcgcccgcagattcgcgagatcggcatcaccccgcttgagttctacaagaagtacgtgccggtggacgtcaacgatttcgtgacgctggccaacgccccgctcaagaaccgcccgttcaaccagcgctaccgcatccgcttcagcgcgaacgtggccgaggctggcgatatggaattcgtcaacgtgccgctggacgtgttcaagaaggccgcgcttgaccagctcaccgccggccacccgatctggttcgcctgcgactgcacgcagttcgccctgcgcaaggacggtttcttcgaccagtccgtggtgcgcgtcgaccagctgttcggcaccgaattcaccggcgacaaggcccacggcctcgaatacggcgacagcccgagcaaccacgctatgaccttcaccggcgtgaacctcgacgaggacggcaagccgaaccgctggaaggtggagaacagctggggcaaggacgccggcaaggacggctactacgtcatgtccgacgcctggttcgaccgctacgttaccgagctcatcatccgcaaggaatacctcgacgacgccacccgcgccctgctcaccaccgaaccagtcgagctcgatccctggcagcccctcacccgtcgctgccgctgacatattccgcccattggccgcggctgaagtgctcctatgttttgccgacttctcacagagtgagcaaaacataggagcactttagttatccacagagttatccacatcctcagcaagctagaaccacataccccgtttttcatggcgaacaagcgaccgctacgctacggtggcgttatgaacagcggatttcccaccccgccacccggcgtattcgacgatgaaccacccggctggaccaacaatgccgcggcaccgagtgctgcgtccacgcacgccgtcaagcccgagccatactcaccaccgcgtatggcaacccccactgcgcccgctatgagcgaagccctcacccaacgtaagcgggaaatgcttaaacgatgcacggacgccgcgcaacagctcggaaagccggtgctcttcggcatgaccacatcgctgatactgcaatccgtgccgcttcccaaggattgcgatctcaatgccaccgagctccataccgtctctgactcgcatcgcacccggatacgcgccgtcgttccgccaacaacaccgcacatctggaaaccgctaagcgccgcgcacaatgcacgtatcaacaagcatgtgcacgcgctgaatctggtacatacttgggcgcagctcgccgctcacatgtcattggaatcattggtcatacttggcgacgcaacccttacggcaatagcgcgcaagccgagcctatcgggcggccgcaccgccgacgaaatttatcaggactttgtgcggcaggtcagcgaacttccgaaattcaacgcgaaagccacatgcatgatcgcacttgaatttattgcaccgcgcgtggattctccgatggaatcagagacccgtatcacaaccacgcaatacgggcttccacgagccgtgacaaattacacagtgcccggcgcgacgttcagcaatggtgagccgataacactcgatctcgcttggcccgaattccgcgtcgccatcgaatatgacggcgatcatcatcgcacagacaaggcccagtggcggcgagacaacgacaagcgcgaactgttacggcatcatcattggatcgtcctcatcgccaccgccgcgaatatggctgatgaaccgtctcaagccgaactcgcctaccgagccgggcgacagctggcgttgcgaggtgccatattcgatttcaccttgacagcgacgccgctcaatgaacttgcccggcggaaacgacggaaatccaccggggcgcactgagctgacatcgatacgattgcgcgcgcttgctgcaacgcatatgccattcatcgcaccccatttggtcgcgtggccccgaccgcatggcactgttgtgtgtcacacgccatgttacgtccggcgaatccgcacatcatctgcgttgcgtactgccatattatgcggttcgcgatatacgtcacggtgtccgatgtcctggtaacgacgtcaatcgatttatgtgtgtaccgggccagattttgttgtcccggttctccatttcgcctctttttgagcaaccgggacagaaacaccctcgaaaaatcgccaattcggccctaccgcacaatatccgccatcacacatcggcggaattccgggcttctggatttgcatacattgagcgctcacgggatggtctgtcccggttccccaaaagaggccaaaatcacgaaccgggacaacgaaatctggcccggttcgcacgtcaatcggttgccgtcaccaccgggacaccgactgcgcatagataagatgcttcaatgcttaacaggcatgcgaccataccgcgatagcaacgtttcgctggaagtagaggaatcaagcagcaccccccaaaccggaagcatggagggaatcctgcaatgctccgaatcaccgcgccccgtgcttggtgtggcggatcacggcttcgagcggcgtggatgtagctggacagcagcgtaacttgcgttgcatgatgcggcccaaaacgaagaaacccggcggaggggccgccgggtgagagagaagagagaagaagggttcagttatggggttcggaagaacctcgccaccggtatgaacttcattccgttgacatcttctatataaccgtctctttcttggggattcgatgtgcttgtctgggaaaagtcttggcaaactgtgacgggcttgtaacgccgcccgacaaccggcctcgctctgtcggggcttggccgcacatacggcaacaggccaccccgcagcacttcatgtgcgaggtggcccgtcagctacgagctagcaatgccgaatcactcggcggcgagcttggccttctcggcggccagacgttcggcttcggcggcacggcgagcagccaacgcttcatcgaagcgagccagctcctcttccacggcctcggtcggaatcttggcgaagatcggtgcgggcttaggcaccatggcgccgacctcgattgcctcgctcttccacgggtgcacgttcacaccgagctcgtaatcgccggtgataatcgggtacgtgaagccgggcttgtcgagatcctcgacttccttgagctcaggcagcggcgagaaggtgccggtgccgccgagcgcctcccacaccttctgtgcggagtgcggcaggaacggcgcgagcaggtggttcgcgtcagacacggcctgagcggccacgtgcagcacggtgccgagacgagcctggtcgtccttaatcttccacggttcggtggcggaaatgtacttgttgatgtcgccgaccacacgcatcgcctcggacagggcgtgcttctggtggtgggtttcgatggaggagccgaccacgtcgaacgcggcggaactctcttccagaaggccacggtcttcgttggtcatcgaatcctcgtccagcggcggaatctcgccgaagttcttgttgatgaggttggccacgcggttcaccaggttgccccacgaggaggcgagctcctcgttgttgtggcgcacgaactcggcccacgtgaagtcggaatccgaggattcggggccggccacggaaatgtagtagcgcacggcgtccacggggtagcgggcgaggatgtccttgacgtagatcacgatgccgcgggaggagctgaacttcttgccttccatggtcatgaactcgctggccaccacctgctcaggcaggttgagcggacccatcgggccggtttcgccgcccttggagcccttgccgttgtacgccagcatttcggacggccagatctgggagtggaaggtgatgttgtcctttcccatgaagtagtaggccgggcagctcgggtcgttccaccattcgcgccacttctccgggtcgccctggcggcgggcccattcgatggaggccgacaggtagccgatcacggcgtcgaaccacacgtacagcttcttgttcgggttgtcaatccagcccttcaccggcaccgggataccccagtcgatgtcacgggtgatggcgcgcggcttgacttccttgaacaggccgagcgagaagttgatgacgttggtacgccagcccttgcgggtctccagccatgccttgttggcttcggcgagcgccggcaggtcgaggaagtagtgctcggtctgctcgaagcgcggggtttcgccgttaatcttggagacggggttgatgagctcgtccgggtcgagctcgttgccgcaggcgtcgcactggtcgccacgcgcaccttcggcgtggcaaatcgggcactcgccctcgatgtagcggtcgggcagagtgcggccggtggacgggctaatcgccacctgctgggtgcccttgtagatgtagccgttctccaagcactgcttgaacatctcctgcaccacgtgctcgtggttaccggtggtggtgcgggtgaacaggtcgtagctcaggccgaggtcgcacagatccttggcgatcacgcggttgtaacggttggccagttcctgggcagtgagaccttccttctccgcctcgacgagaatcggggtgccgtgctcgtcggtgccggacaccatgagcacatcattgcccttcatgcgctcgtagcgcgcgtagacgtcggagggcacaccaaatcccgcgacgtggccgatatgacgggggccgtttgcatacggccaagcaacattcaccaaaacatgactcataaggcttgattatccggcgcggcggggacacgcccggatagctgccgcgccgccatcctcatcccactcacctatccacccgcaacttccccacatacttatccgtacacctcttgcgcgcttatccacatacgcattcgcacacgtatccgcgcacccatccgtacgcacgcccacgcacatccgcacacacttccgcctgccaatatccaccgagttatccacatcatttgcgcacctagtaaagttatgcacttatccaccgttttcgcctatccggtggcgcgcaagccgcatttctgcatattgttcggtcatggatatcacagcaggtccgatgacggacatcacaacagtcgcctcgccggcaaccgcgcaacctgcggtgccgccgatactgtttaccaaggatctgccgggaccgctcagccttaaccgtctggccgccttcggcacgttacataagctcgacgattccgccggctactggatcgagcattcgggcacactgtatggtcgcgcgaaaatcgtcgcggaggtcgccccgtttggcactgtggtgtgttcgatgaccgccgcttgggtatggctgggaggccccgactttccgagtaccatagacgtgatttccacatcgcacttccgctcggcatccgtcagccgccgtatccgcgtattcaaaagattgacgttgccggagcaaatcatcaagctcggcgggctgcctgtcaccacgccagcccgtacggcttgcgacctggtgatgagtcctgaagacatccccgatccttccaccgtcaacgcactggtgtgccagctgatgtccgcgtaccagtttcggccaaacgactgtctgcaaatcgtcaaggagcatcggcatcacaagtacgccggacgcgcacgcatgttttttgaatcggtgcagcaggagatggacgaaccggctttggagcaatgcgcatgacgagggggttcattgtcagaggccatcgcagaggccgccatgccgctcaccgtttacggcatttgcggcaggcgcaacggttgcctcgccacgcggcggcggcacactcatccgaatccgcatcgcgcgcaatctcggatatgaccgcgccgcctgaaccgcccatcagacttacgcccgcggtggcatgttcgcccgatacggatgttgccgtgctctggcacatcgcatatcacgtgcccgaactgcgtaaatggctggttgccaatcccaaagccgacgcgcctttgctggaattggtctcgcagcgtggtgggcccggggtccggcaggcgttggaaatattgttcgagtcgatggaagcgtaacggggagataatcgccggctgctgcgctatcccttgattttcagcacagccgcatacacctgcttgcgattggccaacgatccgtcagccagtggatgctcctgcaccacttgcgcgatggcgtccttgatacgcaggccgtcctccaaagcacggtcgatggagagcacggccatgtcatccacgctcaacgtgctgggcgcggccgcttcggcctcctcgttggacgcgccgccgatgaccagcaccatctcgccacggggcggatcatcaatcacactttggcgaatctcgtcaatcgggccgcgacgaatctgctcataatccttggtgagttcgcggcacagggccatcgggcgattcgggccgaacgcgtccagcagatcgtccatcgaatcggcaatgcgatgaggcgtctcgtagaacacgatggtgcggcgttcgggcaacagcgtgcgcagatactgcacgcgctcggaatgctttcgcggtaggaagccttcgtagcagaagcggtcggtgggcaggccggagagggcgagcgcatcgagcacagcggaggggccgggcgcgcaggtgacgggcagaccgcgttcaatggcacggcgcacgatggccaagccggggtcgttgatggtgggcatgccggcgtcggatacgacgagcacggtggcgccggtttcgacctggtcgagcaggccgtcggccttgtcgcgctcattgtggtcgtgataggcgatgacgcgaccgttcacatagacgccgaggcgacgggcgagatcgtagaggcggcgcgtgtcttcggcggccacgatatcggcccgttccaagagggccaccagacgggctgaagcgtcgccgacattgccgatcggggtggcggcgagcaccacggtgccggcggggatggtcacggccgattcgcgggattgggcgacggcggattcgccggcatgaacttcatcattgcgttcaggcacttgcgtcacgctaccgtcagcgtcatactgctcattcaactcatctgcgcttgtcatactcccagtattgcccatgccacagagcaatccacgacaatccatggcgaaatcgaggcattctccctttgcaggggctgatttcacatgttccggaggtctacttccgtttcaaggggctcctcatccggtgaagcaccgatacaaacggctttgacgcaacgctattccgccattttggcggcgtatctacttgaccatcagcccctcgaaacgcaagtagacctccggcaaaccccaaatcagccccttgaaacgcgagatggcagaatttcaacgaaaacaaatgaaaagaccctctgcggtggaatgaatgcagagggtctcgtggagctgacggtagtcgaaaccgcgacctcttcgatgcgaacgaagcgctctaccaactgagctacagccccttggatgttactttgctccgcaaagcaactcgcaacaatatagtacggagtacggtcaaacgcaatttgacgccgaagtgtcgcacgcgtgtcgacacggtaacgtttcggtgtcgcagacggggcaagtcacccacaccgctccgtatggataccgcggcggcacccggcaacgccatcacgtctccagcacgcccaacaccttcttctcgttgtagaacgcgaacacgatgccgcccaagccgcacagcacggccgcgcacacggcggcgatgcggtagcccgcgccggacgccatgccgatggtggagacgccggtgaacagcagcatggccacggactggcccatcttcatcgcaaaggtgcgggccgcgtagaacatgccctgacggtcctggccggtggtcttggaactggcgtcggcgatattcgccacgatggcctgcggcaggatgccgaacgcggccatcggaatcgcgccgaccaccgagagcaccaaaccctgggccatcgccggaatgaagccgagcacggccgaaccaagggcgccggcaaatgcgaacgcacaggtgaagatcacgaaggcaaccagcagcagcctcttcttgccgaccttattggccagaatattgaccggcagatagaacagcacagagacgccggtcatgagcacgaagtagatggtcgtggtggtttccggcagcttgagcaggctggtcacgaagaacggcagaccggtctggaaggtggtgatggccacccagtagaccacgtcggagcatacgaacttgcggaattcgccgtcgccgaacgtctgcttcagggattcgatggtcgattcggaggtgggctgggagttgacgtagtccttctcgcggatggccagcggcggcaccagcatgcacacgaacgccacggcggccatgatggtgaaggtcacgcggatggcggtgatgcggcccatcatcggcacgaacgcgccccaaatcaccggcgccacgtacgcgatggccgtgccggccacccaagtgaaggagatggcggtggagatggtgagttgctgcttggagtcgtggccgagttcggcgatgagcgcgttgtacggcgtgcagtagaacgtgagggcgatgtagtagccgatcacggtgacgaacaggaacgccgcgttcacccagctggtgccgttgatcgggctccagaacacgagcacggtgaccaccgcgagcggcagggcggcaaatttcaggaacggcatacgtcgtccggatttggcgtcgcaacggtcggagagggacgccacggccgggtccacgaaggcgtcgaagaatcgggcgaaggcggtgatgccgcccaccacggtcacgatgccgagcacaaccaggccttgcggcacgaacacggtctggccttgggagatggcctcctggtcgggctgatagaaatacacgagccagttggagataatgccggaaagcagtgcccagccgaactggccgaccgcaaacgcccacactttggcgatggggagatctctgatggctgacttcgccggtgcaacttgcgcacccgttacacttgctgtagtcgtattgcccattctcacaacctccgaatcaacattgacacagtgtcaaaatccagtatacaccggcacaccatgcgttctacgatagtgggcatgacaagtctgaccgagcaactgccatacgtatacgcttttcctgatgcgttggggaccggattactggtgcacaccgagagcgtattggacgatgagatacgcgatcgtattggctcgttcatccatgaatatgaggttgtattatctcgattccgcgatgattccatcgtcggccggatgcgcacggccgcacatggcggcacgttcgattttcccgactgggcatcgggtctgtttggcctgtacgaccgcctgcttgcggcaaccgatggggcgatcgacccgtgcgtgggcgaggatttgattcggcttggctacgacgagtcgtattcgtttgcggctacgcccgatgccgccgaacatgcaggcgcgatccacggacgagccgtttggtcagccgacgttgagcggcacggcaccacacttatcacccacagcccagtcgcgctcgatttcggtgcgtgcggtaaggggtatttggtggatttgcttgcggggatgttgggtgatggcgcgggccaccctcaacccattcaatacgtcatcgacgccgggggtgatttgctagtgcacacggacgaaccaatcaccatcgcccttgaagatcctgccgatccggccaacgccgtaggcgcggtcgaaatcagccaaggtgcattctgcgcgagctcccccagccgccgccactggtctgacgccgcaggtcaccaacttcaccatctgctcaacgccatcgacggactaccggttgacgatgtagccgccacatgggtggccgtcacgccgccatcgagcaccataaccacgaagacatcgacgcatggcagcaatgcctcgacaacggcaaaccgcgataccgacgattcgtcgaacaccgttgcagcacacgtccctgtcacactggccgacggactcgccacagccctgttcactacctcggccgcccagttacgcgctcacttcgatttcgaatgcgccatcctcaacgccaatcgtgccgccgcacaatcccccaattttccgggcggttttttcacacactaatgtacgaaatcatcagtatcacatccagtggagcattccctcgggtggaccgatgggttgctcccctcagtcagctacgctgacagctcccctcggagaggggagccgagtatagctaatccgctaatccgctaacgcaggaaacaatccgtcagtcagcgagcgcgaactggctgttgtagaggtcggcgtaaaaaccgcccgccgccagcagttcgtcgtgcgtgccgcgctcgatcacgtcgccgtggttcatgacgaggatcatgtcggcgtcgcgaatcgtggagaggcgatgcgcgatcacaaagctcgtacggcccacggtcagcgcatccatggccttctgaatcagctcttcagtacgggtatcgaccgaggaggtggcctcgtcgagaatcagaatcggcgcgtcctgcaccatcgcgcgggcgatggtcagcagctgcttctggccctgggagagcgacgacttgtcgtcgagcacggtgtcatagccgtccggcagcgagcggatgaagtggtcgaggcccacggccttgcacgcatcctcgatctgcttgtcggtcacgccgggcttggagtaggcgatgttctcgcgcacagtgccgcggaacacccacgtatcctgcagcaccatggagaactggtcgtgcacgttccagcgcggcacggacttggtgtccacgccgtcgatcgcgatcgagccgccggaaatctcatagaagcgcatgagcaggttgaccatggtggtcttgccggcaccggtcgggccgacgatggcaaccttctgcccggccttgacggaggcggagaagtcgtggatgatcggcttgcccggttcgtagccgaactgtacgtggctgaattccacgtcgcccttcacttcgtggccgttggtcccaagcaaagcggacttgccggattcgtcctccatctccggctcctcaaggaagccgaacacgcgttcggcggccgccgcgcaacgctgcaggttctggaaggcctgggcgaactgcgccaacggctgggtgaacaggcggacatacatcatgaacgccacgatcacgccgaactcgatctgcccgtcgagcgcgagcgccgcgcccaccacgcacaccaccacgtagccgaagttgcccacgaaattcatgagcggcatcatcaggccggagaggaactgcgacttccagccggactcgtagaggtccgagttgtacttctcgaagcgacgaatcgaatcggcctcgccgttgtatgccttgacgatgaggtgaccggcgtacatctcctccacgtggccgttgacgtcacccagcgccatctgctgccgggcgaagtacttctgggaggacttcatgatggccatcatgatgatcaggccgatgaggctggcaccgatggcgcacagggtcatgatcacgttgttgtagaacatcatcaccagcgcgcccacgaacagcgtcaccgaggtaatcagcgagccgagcgactggcccagcgtctggccgatggcgtccacatcgttggttatgcgcgacagcacgtcgccgtagctaaccttgtcgaagtatttgagcggcagtttgttgattttgaccgagatggactcgcgcagtcgctgggcggtgcgctgggtgacgttggccatcatccagctttgcacgtagccgagcacggcgtagcccacgtacagggccaccaaagtccaggcgatgtggcccaccgtgccgaaatctaccgagttcatcaccggtctgccgttaacgatggcgggcagacctttgacgatctcgttggtcatgtccttgagcttgtccgggccgacgatctggcagacggtgccggccgcgcccaggatgagcgcgatgatgatgacgggaagatagttgcggcagtagttcacgagtttgcccatgactttgccgaaatcatggggcttttcgacggcacgcctgccgcccattggtcctcttggcatttgttttactccttaaaagtccgtattgacctccctctgatgagggaggtggcgcgaagcgccggagggagagaagccgtacgcgactacccctcagtcagctgtgctgttttattcgctcgcttatcagctcgtcttcgcctgggaacagcccactgggctgttccctttacggctcagcccctgacatggggagctaccgctgccgcccccctatgccgtaagctccgactggctgagctgggattcggcgatctggcggtatacgtcgcagttgtcgagcagttccttgtgcgtgccctgacccacgaccttgccgtcgtcgagcacgacgatgcggtcggcgttcatgatggtgccgatgcgctgggccacgatgagcttggtggaatccttggcctcgcgggcgagcgcgtcgcgcacttcgcggtcggtcttgaagtcgagcgcggagaacgagtcgtcgaaaatcaggatttccgggtgacggtacaccgcgcgcgcaatcgacaggcgctgcttctggccgccggacacgttcgatccgccttgggcgatcgcggcggaatacccgccgtccatgcgcgccacgaactcgctggcctgcgccacgtcggcggcggccttgacgcgattcagctgctcggccggtatatcggcaccttccgcggcctcgccagcggcgatcaacgcggcctcgcgcttgcgcccggccggggtggaggtatcggccatctcgacctccgccgggtcgcccggctgatcgccgtagctcacgttggaggccacggtgcccttgaacagcacggactgctgcggcacgtagccgatcttgtcgcgcagggccttcaggtcgtagtcgcgcacgtccacgccgtcgaccaacacctggccttggctggtgtcatagaagcgcggcacgagattgataagagacgacttgccggagccggtggagccgatgaacgccaccgtctggccctgctcggcggtgaagttgatgccttccagcatcgcctcgcgcgaatccgggtaggtgaagctgacgttgcggaattccacggtgcccctctggccggttttggccacgtcggcggcggttttggtgccgttctcgacgattggctcagtgtcgagtacctccatgatgcgctgcgcggacacgtcggcgcgcggccagagcacgaacaccatgctcatgagcaggaagctcatgatgacctgcacggagtagttggagaacaccaccatgttggagaacacggtgagcttgtccttgagcccggcggcatcgatcaggtaggtaccgatccagtagacggcaagcatcagaccgttcatgatggtgttcatcagcggcatcatgaacgccatgacgcggttggtgaacagctgggtgtcggtgaggtccttgttggccttggtgaatttggcttcctggtagtcctcggcgttgtaggcgcgcaccacacgcaggccggtgaggttctcgcgggccacgaggttgatgttgtcggtcagggcctgcatggccttgaatttcggcatgaccatggccatcatgatgacgatggccgccagcagaatcactacggcgattccggtggcgagcgtccattcgaagccttcgccggcgatcttgcacacggcccatactgccataatcggcgatttgacgatgagctgcagacccatggtgatgaacatctgcacctgcgtgacgtcgttggtggagcgggtgatgaggctggcggtggagaacttgctcatttcggccgggccgaaggactcgaccttgcggaattcgagcgagcgcagacgctgggtgaacgaggccgccacgcgcgcagcgatgtagccggtgatgatggcacacgccgcggatccgagcgagatgagcagcatcttgccgccggcaatccaaatgtccttcatgtggctgcccggcgtttcgaccagcgtggtgatgtctgacatatagtcgggcagtttcaggtcgaagtagacctgcccgacgatggtcaccagagcgatgagcatctgaccgatctccgctttggagaggtatttcatgatgcgaagcattggtttccccttgtgttggttgggttggttattggttattgacgattggttcttaagttggctgggttatcggcgattatcggttcacgatgtcttaatagtttctattgtttgattacttacactgtgagatattacgcgcacttctgcatgttcgctgtgagcgtcctcaattagccttgccgattagttctccgcgcgcttagctgccatgtgttcagccacgcgcttgccccgctccacgaatgcctcacgcacctgttcagcagtcggccgaggctgtcccggatggcaaatcgacatatatgtggtgaactcagacaccaggtcaacgaattcgcgcgtgcgccgctcccccatttgcgagaaaatccagcaaatcgcggaacgcatttcctctatcatccgatgagactgctcgcgcccggaatcagtaagattcacgcgaatgatgcgccgatctttggggtcaatgtcacgcgtgacccagcccttcttctccagagacgacagcacggtggagatacgtccggagcttgcttgcagcgccgatgccaattgcgatggcgtttgcgtccccttcatggacagctcccggagcacgaactgctcaccatgggctccacgagtgaattccctctgcattgtcgaacgattgccccacacgctggcatacagttcactaactgcttcctgctcaaatcccataagagcaccatccattcccattcgccacacggcagagcaccgcaaacaccccaagaatatctcacaccgtaaacaattcattactagaaactatttttggaacgcataatgcacacactccacgctctttgatattctgaaagccgcatagatattcacttcggggcgtcgtctaagaatatttgctgggccaacggtagcgacgttggcattgtgctccatgaggtatctggtcgaaaaggcggacgaagacagaccagttgggcggagcgcgcccatacctcaaaaccattgcaattattggctttgaccattttcgtggagtcacgaaaatggtcatgaaaaacataaggacacacccatgaaccgcgacgaaatcacacgcaaaaccagcgaactcagcactatcgcacacaccaccgaggactccaaagttgagtattggtatgcacgcgagctaatgacctatatggggtacgacagatgggaaaacttcagcaaagctattacacgagccaagcaagcttgcgacaattccggcgtatccgttgaatcccatttccgtgacactacgcgagacgtgactctcggcagcggtgccacccgctccatcgcggacgtcaagctcacccgatacgcctgctatctcattgctcaaaacggtgatccaaagaaagaagaagtggcacttctccagagctattttgccgttcagactcgcaaaacggaaatcattgagcaacgcatgggagaaatcagccggctcgccggccgagaggcccttgccactgcagagaagaaactctatccgtatacccaaatcacacacaacaaaaccgcacaagagcacatgtacacgcccaaccacgccgcagaacgccggcaaggatgtgatacaggccacagaaagcgttgtaccgcccaggcaatgcaacaattgtccgctatgctctgaaggcagatggcggcacggatgccatcccaaagagggggtatgaccatgattcggggtatgaacctatgcagcatcgccggctgcacgcacgaagcagaagaagcgggcatgtgcaacatgcatttcacatcagcgctggttcacggagcgctgcactacactgcgggcggacgtccgtcgcactgctgagcgcaacaacaaagcaaaacaaccagtaacgctcaacggcttccacatgttcatgctctaattgcatgtacttgcagacacaatggccggtctgagccagctgccctcgcatggagcagctggctcagaccggccattattgttgctttgtactgtttgcactgtattgcgcctgcattgcgcaagctcgggcgcactcgctgagtggcgtgaatcgcagattgctcaatagcaacgcaatccacgctactcagcagttgccatggttatgcgcggcgtttgcggatgacgagcaaggcaccagccgcagctgccagcgccacaaccacgaccgcaatggcagccacggcagcacccgtattcgaaaggggcgcagcgccattagcagccggctcattcgtggcagtgttaccgggcttagcagtgttgccaggattgttggtatcgccgggcttctgctctccagggccgggagtgacctccgtggctgtgaccgtgacttcgaacgtcgcgttcacgccacgataagagacggtgatggtcttcgtgcctgcggtggcagaatcaaagccagtgaacttcagatcaccatcagttggatcaatcagcttgcgcagcgtttcggtatcgccgactttgtaaatggcggataccttcacatcggcagcgttgaacttatcgcctacctgataggaatccttggtcacttccacagcaagctcggccaactgaggcagttcgccgaatgtcactgtgtaggtttccgccgtgccatcctcagcagtcacagtcaccgtggccacgccactgttctcggtcgaagcctgctccacctgcaccgtagccttcgcgtcagcagcagtcgcctccaccgtcgggtaagaagcagcgtctccggccagcgcaccggcatattcggtgatatccgcggagaatccgtcaaccgtcttgccatccacagtcagatcagcaagattggcgttactagacggctgcggctctggcgttgcttcaccttcggcgatgcgtacttcagcgatcttggcatagtcattgccatcggcataggtgaagttgaggcgaatgcccttggtggcgggcagagcgctcacatcggcttccgtcacggctccagcagcaccattcacagtgactgccggcagcgtggcatcagtccacgtggcgttgtcttcagctaggtacgatacagtgaagctcttcggagcggcctcgcccttggccttatccaccgcaacgctgagcttgcccagctgatatgccttatcgaaggtgtagctgagccacggcgaggtgtcgccggtgccccagttcgaccagttggtgctcagattgttgtcgcaagtcaggtcggccgtagaagcggaggcccagctgctggccggctcatacttcgaggctgcggcggacgagcagaacaaccgggcaaggttgctttccacagtcacggtgagcgtggcagttactgaagaatcagtgacaaggcgtaccgtcacggtttgctcgcccaatttggtggtgtcgaagccttccaacgtgtattcatctggctccagtacacgcgtcttgccattggtgagcgtagcggtaaccgtcacgtccttatgcgcgagcgtctgcctcttggcgatagtggtttcagggcccttggccgcgatggactccacagcagcagtctgcgaaccgaacgcagtgccgttgaaggccacggtgaatgcgccggcattgctgttcgacgtggcgaaagcaccggcatcgagcccggttacgtccgcaccggtcagcgttaccgtagcgacatcctgccattcatcgttcgcggaagcacgccagtagcctttcagagtatcggttgagatgcgctccagcttgagctgcacttggtcgccgaagccggtaccaacatgcgatgtttccttatcgatgtagccatcggcattggaatcgtactgcatgtaaacgccgcttaggctggcaagtaacgtggcatatcccttgccgccgttagcgtcagcaagaccgttacggaccaccagaccggcgcgcggatcgccattaccgcccaagtcgagcggcttgaccgtggtttccagcgtttcgttcacgtccagagcatcaggctggtacaccgcactgccctcgttgcgatccgtccagacgccacgattggcgttgtccgtaatcgtgaagtcataagcaccgccggacgcagaaacctggcacgcgctgccgcccttccaatgagcttccttccaacttccggaaatcgggttggagcaggaaacatcgatggttctacggaatgtacggcccggattgaagttactgctctcggcaagagtgcccgtaatggtgtaggctcccggcacattgaatgcgtaggtgttaccagcagccttggtcgacttgctgactgccgtaccgccttccacattccatgtcaccttggtagcaatggtatcgtcgccttccttgacgttgacggtgtccggcagagtaacggttccgcccgtgttcacggtcttcgggagatcatcgccggtttccacagtccagttgaccagcttgcccttggcgctaccatggttgccccaatagctcagatcccaaccgtcgggctcgccttcttgagcaggattgtgcatttcgatggtgccgttctcaccgatggtcagcggcagccaaacataggtggaatcggctttaccggaatcccaacggtcaccaaggtagatgaagtgacctttctcctggtctactgcgagcacactagccgactgcgaaccgaatgtggtgccgcgggtatcgcccacggacaacagaccatccgcgccttccggcatgttgttgtaccacgtgttctcgttgacatcgtccttttccacgccacgggtccagtttcccagcatggagtcggcggtgtagtaggtctgcttgttcggggcccagccggttgcaccagatgcgatgatgttgtaacgcccgtcatattggaatacggcaggagcttccagcgaaccattttgtttgacgatttggaaatcttcgccacgcaccggggcatccgtagtagcgtctgcaagaatgtatgggtactgcccgtcagcagagtactgcttttgtccctcggactggtccacattcgtggtcttgactacattggtgtaatcatcgttgagcttggcgatgtacagcgtggcattggcttcggaagaatacagtacataggcactgtcgtccttcgggtccacgaacacagtcatatcgcggctgtcaccgttctcaccccagctggggttacctgcggcttctttccaattgttctggttaggcaaacgataggcacccaccatagtgaacgggcccgccggattgtcggaaacagccacgcccgcaagtgcacgtgcatagttggaaccgcccggcgtggtgcttccatcggaatgccaccacagcacgtattgcttgttcttcttgttgtagatgatcttcggacgctcgaaaatgccctgtacggaatcaaccgcgccatcaccatcctgatcggggttggtgttgaggtacgggaagattgcgtcggccttggcagcgtccacactgccgtcggacttggtcaggttgtaggccttgtcgaagtaggcgtaatcggcattgctcttatccgtcaactgagatttgctggtcaccgcacgcagcgccacaccaaggtcagtccagttgtatagatctgtcgacatataagcatgaacaccggggctgttgtcgtaaccgttagaacggtcttcgccataccagtagtaggcgtcgccaaccttgaccacttggccaccgtgcgcttggatgtgtgtgccgccattatcattggcgttcttggcataccaatatggctggaagtaatcgctagcgttcttgcccggatcggctgtgggctggaacttggtgtatgtcggcacttggccgatggtaggcaggtaatccacacctgccgcactggcacttgcagcggccagcccgcatgacaatagcgttgccgcggcggtaattgccgcgataagagcgcccttgcccttattgtttatcttcattgatttggttccttgattgatgataacggttttttgaacaaacagttatgtcgctatccgcgaagccagaaaaggttcgacaaatcaatataccgatactgaaaactcagtattcaacttgtcggaccaattatggtcaaagagcggaggaaccggccggcaatagtcaatattgccggcttgttccttcacccattactgcgcgagggtgctatgcacgcttgcgcagcatgaacagtgcacccgcggcagcggccagcagagcgacagcgccagcgatggcggcaacactggaaccggtgttggccaccgtgttcttgttgccgttgccggtggcaccgggcttgttggtgttgccgggcttctgttcttcagggccaggggcgactgcgttggccttgaccgtgacgttgaaggtcgcggtcacaccacggtaggagacggtaatcgccttcttgcctgcggtggtggagtcgaacgagccaatcgcaagctgcgggtcgtcaagagcgaccggcacttccttggtcttgtcgccactctggtagacggcagtcaccttcagaccggcggtatcgagcttgtcgccgatggcgtactcggtcttcgtgggtccgatcaccttgagcgaagccaaagtgaaggcgttgaaggtcaccgtgtaggtcttcgtctcagactcgtcggctgaggtcaccgtaatggcggccttgccgccaagcttgccgttctcaaccgcgtcgccagtcaccttgacggcggcggcattgtcggtggcgaaggcctgcagcaccgggtttgcctcggcgtcgaccggcagatcaaccgtgtagtcggtcttggacgggtcgaagccttcaacggtttcgccgtcaagacgcaggtcgcccagcgtggcatcggatgctggctgcggggtgagtaccgtgctgtcttgtgcgaacacctggatctcagccacgttgatgtacaccttggtgtcctgcaatgtgttagtcaggcggatggccttggcctttaccggggtgccgagcacgaagtcaacggtcggggtgtcggcggcggtgatgccgtcggagccagagccggcatcgccggcctgtatcttccagccatccttggtaccgactccatgccattcgccagcctcatcctggtattccagcgtctggctcttcggccaagacgcacgaccatcgtagtagaagaaggtcttcacttcggtgatggtctgagcttcgtcgaaggtgaacgtggcgaccgggtccaccgtcgaggcggtggaagcccaagtggaccaaccctttgacgtagtgtcaccatcgatggccttggaagcggaggcaccctcctggaagttcaccgagaagttcgtgccagaggccgcggcgatgttcttcgcagcaccctgaaccggcgtcacgaatgcctgaatttcggtggcgttcatgtagtcgttgttcacggtgttcacaatgcgcatcttcgtggcattcactgtgcccttatcggccttgaacgtcaccgtctggcctgcggcaggcttaacatcgctaccgaattgcatccacgtctcgccatcagtggtgtactcggccttggcggaagccggagccttgtcaccatacgtaatggtcacgctgctaagctcacactcagagccgaagtcaatcgtggcggtcgggctggcggaatagtcaccagcagagttccacgtcacccaggcttcagctgacgtgtcaccatcggtgagcttcttccactgatcgcccttgctgtattccgtctgctggttggtcacggtcaggttggaagcagtgtcggccacattctcaggcgtggcggcggtgacatagatcgcgcccttcagtgcaatcgtggtcgcgtcgtccagctggtaagtaccggtcacggcaatgttgtcgccagccttggcatcggcgagcttggtatcaagcccatcgaagttccacgtaaccttagccgcatcgccctcgaatgcaggcgatgccttgacgtgtaggtacaccggcgcagcctcaagcgcggccttcgcctcgctcgcactggtgccggccagcactgtagccgataccggatcggaaacggtgagcgcgccaacgtagaccgtagcggtgacgttgaactcgttgccgtacacatcggtggcggtagcggtggcttcgtaggcgccttccttggccacatcgaccttggaagtatcccagttggcaaccgtggccttgccttcgccccaagtgtagtagagcgtgacttcgaccggaagcacggccttctcgttaacggcggtctgcacgttcacggtcttctggctggtcggcgttacattgcgcagagtccatgtctggttggcggacggcgaagtgccgctcggtgactgccacaagccaaccttcgtgccgactgtggtaccagagttatccacatcaaggttcgtcttagtcgcggcattgagcagctggtaggtcgaaccatcggaagtgttgagaatccacttggcagccgggtcggatttagcggccccaaccgtttcgttggaaagcgcgttcgtgccatccttggacaccagcaccttgccttcggcgttagtaatcacataagccttgagatcagggcgctcggagtcggtgggctgctcgatctgggtaaaggtccaagtctgcttcttggcgttctcggcatcggaagcgacgttggccagggacagcgcggaatcaccagaagtggtatcagccacggccttgccggactgcttaccaacgagctggtaagtgtcgccggtctcgacggcagcatccttagcgtagccggtcacgccagtgagctggatggaggcgatagaacgggcgggcacagtgaccgtagcggtcttggcagccttgtcaatcatcacagagccttcagcttgcttgacgttgctggtcttggcgaagacttccggagtggcggaatcgacacccgcgttcttgtcttcggcagaggtttcggtggtcaggtagagctcaccgtaagcgttgtcggcaatctcgccgtacttcgacaggtcgatgacgaaggtctggtcagaggtgccggagttgcggtggatgacggtctgcgtcttgccatcgtcggaggtggcagtcatgttgttgtcttcatcgttgttggcgatgaccttgtcgcccgcgtggatgaagtgggtgatggccttgacgccgttgtacttggcgtttgcaataaccgtgcacggttcaagtccatcggtggtaccgccgttgttgttcacgcggcgctcggagtagagcttgccgtccatgccagccacggtgcagtcgaagtcgatgagcacggtgccccagttggtgttctcaccggccggattcacattcgagcccatctgcatgttgtagaggtcctcgaccacctgccagaaggtgaagtccttggactgcaggcgggtgacgttggagctgatcttgctcatcatgcccagcgcgttgtcgaaaccgtacgggttgtaggagccggactgccaggagccgtccacctcgctcatcgacagcttcttgccgtctgcctgagcgatatcgcgcgactgcatctggttgctgtcggagtaggcgtgaacgttgtactggccgataaggtccttgatcgcctgcgggtactggttgtacgacttgacgaagtcggcggagttcgtggcatcggtggctgcgatgatggtgtcatcattgtccttgagcgcctcagcgagtgcggtaatcgtctgctgctgctgggcgttgctgacatgcataccctcctgcggcttcttcagcgcgttggagtatggggtgacggacctatctttgtcggagtagtacttatcccagtagttgttaatgagcttggtgttgtcatcgctctcatcggtgtacttcgaagccatgtcgcccggagtgccccagtaactggtctcggactcgttgaacggctcgaccgtgtcaacgtttgcgccaaggctttcgaggtgctcgacgttcttggccatgtactgagcgaatttctcagggtttgcaagattattgctaccggagttgcgtccaccagtggcgtaaccgctgttggtcaggaaccacggagcggagttggcgaaggcctctacatcggtgatgtcggggttatcgccggtggcaccgcgctcaatccaccagtcttgggcggcggacttggagaagtcatactggttgtcgtcagtcgggtcgaatgccgcagccagcttgtctttgtcggcctgcttggtggttacgccattgccatacgtgccggagccggtggcgtcatctttccacgtgccaggcacggcagcgccttggcgcatgaatgggtagccgtaggcaacatcggaggcattgccgccgcccacgttgtagcgggccatgttcaggtccagtccttcatcaccgaagatggactggtagaactgttcgcgcagctgcttgccgtattccacagccttagccttggaagcgtcatcgccgagattggtggtgatggccgattcctcgccgaggctgccggtggcgttggcgaaccaagccagcgaggtgccccagccatcgaaactgttggcataccacgggttcggggtcacggtaatggcatcgttatcagccgcatacgcagtgccggcaaccgcaaacgcccctcctcccactagtgttgccgccgcaaccattgcagcaagcgatttgctcagtaccctcattggtctccttagtgttcctgctgtccgccttataccggaaaaatcggcctttgcttcactgagccggcctctttgcctgatacatgacctacgtcgactccttctttcggcgcagccaaaatgtttacgcaaacattttgatatgagcgattttatcacaaaaccgtcacccagcaaacaacttcagagaccacaaacgacgcacaaagtcatgagccattcgaattgcgctggcccaatcgctacgaatcatatttgccgtagcccttaagtgaatcccactgcatcgagatatcgcgcccgctatcccttccgataacgccgaccacgcgtgttgccttcagcaatcagctttccttgcgcaactaaaccgtttaggaatttgcggactgttctgttatcgagctctgttatcttggcgagttcaggtacagtcacatagtcaacctctgtcaagcgtcgattcatcgccgacagcatcgctgcccgcgaatcaatttcacccgatgcggttgcatctgctttcttaccatccacacgttccccgccaatgagcctcgcaccctcttcggcatctttctcaactacagatctcacgctagcaaaaccagaaccatccacggtcttcagcgcaggaacaataggaatcgtcgcctcgaatatgtcaccatcgcggaactcaggctctcgctcagtatattgccgggacgctcttatcagattccgcagtccgctacccagctgctcggctatgccggtctgcacaaacacattagcgataatcggattctttggcattggcgtgaactcgcccagcttcattcgaccttcaaagaatgagcgcgaagcattaaccgtccggatggattcattatcaatggtgacacgcgccaccaccggactggaatactcccgatgcatgaggctgtttgccaccaattcacgggcgatcatcgtacgcgggctcactcgcttatcgccctttaacacaaagcggtcaggcagattccgctcagtaaattcacggagttgctcgtacgaatcgaacaagttggtccgcaccataagtcggtcatcgtatcggtcaatattgtctcgccgaaccacggcatcagtaatatacgctgggcaaaccgaggaaatgacttcatccttgcccaagagcagcactgcagcaagattaaagccctcttcgccggtcgtgtaatcacgatcgtatagcttggcgctgcggaacagttcttcgtcagacatggttccccaagggtgcccagctcgctgagcgaccgccagctgccgcattcgcgcaatcagctcaggacgcaaatcaaacggagtcacgtaacggaaaattcgccgttcggaatagtagttctgcttgcgaatatacatttgactaatctggatatcgctttcgatgtgtgtatccacatcagcaatgcgatcaaacactgcgcccttgaaccgcacaaccgaagaactcggagctacccaaatacgaacaataatccgttcgtcgtactcgatatgttccgtttccaccattggagccggttcgaacatcttacgattagacactacgttgacaacgttgcgctctatctcactaacgcgcttagaatcgacgccgagcacttgaccgtcatcgtcaacgccaagataaatgctgccaccagaacgattggcgaatgagcatacagtctcaaaagtatccgtatgaggcaattcgctgcagcgcttgaactcgaccatagatgattcaccggcctgcagcacttgcataagttcatcctgcgtcatcgcattccgcccttcatagcgataattcatacattaggacatggcacttatcgtattttagcatctaattagtacattaggacattgttttatgtcctaatgtactaattaggcggctaattgtactaataattgcacactgatgtactaatccgatgatcgaatgcactaattgtccgcacaaatgcactaatcggatgaccgaatgtatcaatgagacctataggcagccgattggctgacgatcagcccagtcattggctatcggccgctagccagtcagccgccaacagccaacagccacccaaccaatagccgccagccaatcagcccgtccaatcactccttgtgttccagtgcggccttcaaatcgcggctacggtagcgttcgcgcagcatagagaatccaccgaagcccacaagccacaccaggccggcaatcgcggaattgcgcgtatcgtccgcaaggaacaacgtcaggtagatgaacacgaagaacacgattgccaccgtattgagcaccttccacgcgggcatgacgaacccgtccggaatgaaatcagcggaacggcggtacctgcgatgcgccagcagcgtcaggatgtagatgaacaggaacaccgcggagctggcggacgagaacagcacgaacgctccggacacaccggggatggcgttgacgatcggcgacagcagtatcagcgccgcggacaccaggatggcgcgggccggcaccttgcgatcggacaccttgccgagcttgttcagcatcgggttcggcgacacctcggacagctggtacaggtggcggccagccgagtacagcagcgagttcagcgcggaagatgcggcggtgatcaccacgaagaacaccagcgcggacgcccaattcagcccggcgtactggaacaccataatgaacggggaggcaaaggagccgtcctcgttcggcttgaacgaggtccacggcacgatgcacatgatggccaccagtgcgcccacatagaagatgagcacgcgcacgataatctcgttgatggccttgggcagcaccttgcgcggattcttggtctcggagacggtgacgcccacgaattcaatcatctcgtaggcgaagaacaccatctggaagctcatgaggaaggccatccaaccgttcggcgcgaacgagaagttggcgaacaggttgtcgaatccggcgtggccggccgggctcacgtggtccacgccgtgaatctgcacggctgggtaatggtagccgatcacgatcatgaccacggcggtggcgatcatcgcgcaaatcagcgtgatcttgatcatcgagaaccagaattccacctcgccgaacaccttgacggcaatcaggttgatggagaccagcgacaccaggaaacacagctcgatcagccatttccaatgggtcaggtcgatgccgaacgtgtcgaagaaggtgatgaagtacgtggagacggccgtgatctcggtcatgcccagcagcacgagcgcggcccaatacgtccagccggcgaaatgcccccacccgttgccaaggtaacgggtgatgaaattgatgaaggtgtgctggctggggtcacggtacatcatttcgccgatggcgcgcatcaggaagaacatgatgacaccgaccagaatgtacacgaagatgatcgaggggccggttagcgagattgacttacccgagcccaggaacaggccggtgccgatggtgccgccaatggcgatgaactgtacgtggcgattgctcaggccacgctccatctcgttggtctggtccaggctttcgacagacttgagtttgcccgtagcctgctgtgtaccaccattcacattcgtatcggccatactgatttcatttctcttctctgccgcccgattgttacgcaccagacgcgatactcgttcaaaacaagttcaaactgtatcaccgaaatatgtcacgaaaaccgctcagctcaagaatacatgcgatgatactgtaaatattccgccaaaaagttcaattcatcaacaccaaattgaacttctacctctattccacggacttgagcgagctgaccgggtctacgcgatcgagcactgggttggtgaacagctgcaccagcagcgcgaacgccagcgtcgccaccacggcaatcgcatagctgtgccagtgcacttccacttcgaaatacagcgacggcatattcaacgcagcagtcagtaatccgcctatccacctgccaagcggcagaccaaccaccacacccataccggtcaatatcatcatctcgcggttcacgtagttgtgcacctcgcggtcatagaagcccagcaccttcagtgtggccatctcgcggatgcgttcggacacgttcgtattggccaacgtaaacagcaccaccagcgccaggccgccggcgagccccacaatcagcgccaccacggcacccatcaaatcgaacttaaacgtggcggccagatgcgcacagctcacggccttgagcaccgacgattcctcgcccaaccgatccgcatattcggcctgttcggtctcggaacctttcagcttggcgagcatcgcgttccacgtcaaggtcgaggcagtgccatctcccgaagccgaagacgtcacaccgtcggccgcaaacttctggtcgtacagtcgctcactgatgtacacatcagagccgatgaggttgcgcgtcaccgccgcaaccttcaccttggcccgcccgctgccgccattgctcaacgtgacggtgtcgcccgcatgaatatccaacgaattggctgcggacttcgccacaatcacaccactatcgtccagcgctacagtgccgccacccgctttgccgaagatattgggcagctcgaaccacccatcgtcaccggcctcttccagcgtgaccatgtcgttcagtttgttcaacgaattgttgggcaccgtcatcagctgcacggtttcgctttcctgcgccgcattgctcatctcgccgctatccacgcgcagattcagcgtttcggtggcccggccatcttgtgccacctgcttgcgcatcgcggcggcgtcatcgtcattggccaccaccatcaagtcatactggtagatctgctcatattgcttgacgccagtcgtgtcgacggtgtcgttaatcgcaaatccgcagataatcagcgctgtgcaaccagccacgccgcccacggtcataatcaaacgcgacttgaatcggaagatattgcgcgcagtgactttgccgaggaagttcagccggctccataccgggcgaatccgctccaacaatatgcgagcgcccgccttcggcgccttcgggcgcatcagcgcggcgggcgtgtgccgtatctcctcgcggcaggcgagcgcggtgaccacgcccacaccgaccacgaacagcacgatgccggccgagccgtacagccagtcgtattcaagtcgcacaccgggcaatatatacagtccctcaatcaccaccatcaggaatgccgggatgccgaggaatccgaccagcagaccgatgccgccgccgaccaagcaggcgagcaacgcgaacagcagataccggctggacacggcgagtccgccatagccgagtccaaggtaggtgccgataagtccgcgatcttcctcgaccatgcgggtcatggtggtcaggctcatgagcacggcgaccagcaggaacacaatcgggaatgcgcggccgatggattcgatggaactgacatctgatttgagcgagctgaatccgtcgatcgaagcgcgcgtctgcacataccaacgtgcgttggccacatcgtcgatgcgccgttgctgcttggcgaattcgctttccgcttcgcttcgcatcgcatcgagtgcagactgcgcatcatccagtttcgccttgccgtccgcgagctgttgttcgccttcttccagctgccgctcgccttcttcaagctgccgcttgccgctggccagttgggcggcctgcgcttcaagttgcgccgactgggtttcgagggttgcggcattcgcttcgagttccgcggatttggtattgagctgtgcctctcctgcagccgcttcctgttccttggcggtcagttgcgcgttctgctggtccaaggtggattgtgcgggggcaatggtttcgtttaatgtgcgctgcaaatcggctttctgctgggccagactgtctcgctgcgtttgcagttccgtttgcttggcggtcagctgttgccgcagatcgctgattgacggcacttcaggcagggtaatgccaaggcgcgcgagcagttgcttgatggcctgccatgtgggtgagttgaggtcgatattcgggtcaagttgcgccagtagattgtcggcctgttgaatcatggacagcatctgatcaatttgcgccatgccttggtcgatttgggtaatgccctgttcgattttcgtgcgattggcagtcagttccgtttgcgccgcatcgagctgtttgcgagccgaggtgagctgcgctttgcccgattcgagctgggtgcgcgcttcggctatctgctggcgaccttgcgcgatctgttgacgggccgatgcaatctgcgcacgtccatcggcgagctgccgttcgccatcggtaatggttgtcctgttgttctccaattcggtacggctatcttgcaatgtcgttttgttggcttccagctcggcccagttgtcgtcgatctgcttctgggcttcgtccagctgctcgttggcctcgtctttggcatcatccagtttgcgctgcgcgctggagacgatctgttgacgacgggctttctggcgtgtggtctgtatctgatgttcgatacggtcggccacggttttgacggcttcatcgtaggcatcggaaaacgtgtcaaaatcggacgcaccagtgacggcaaccgatatcgcagtgtatatattgccggtcacgccgtcgctgggtgcaaagaacgtatagtcctcggatgaggtggaccggaaggaggtcatgcccgaatagccgtctggattgttgaggtcgcgcgggtcgagtacgacgccggtgatggtgagtttcgtggggaactgcggggattgctcggcgtcggcgtccgtattggcggcggacttcgcatcggatgccgaggcattggcggcgacacctaccgtatcggcattattggaatcgtcagtctccgtggccgctaccgatatgacggatgaagaggtgtcttgtggcgtcacagtaatggtgccgccaatcttgagtccgctatcgttcaggaattgctgcgtaaccgccacttcgccggccttgttcggcagtttgccctgccgtatgtacggctgatcaagcccttcggtaccgatttcctgcatggtcacggttttcttggtgccgtccaccaacgtggtcaccgtctgagaacgttcgggctgcacggtttgcacaccgtcgattcggcgcagtgccgctgcatcatcaccggtcaggccgtatgtggatagcacctgcaggtcatgcagtccctgctgatcgtaaaaacgaccggccgccagaaaagcatcgcggcatccggcgtagatgccggtcagcacggccacgccaagcagcgtaatgacggcgatcgagacgaacctcttccagctgcgcagccagcaacgcaacgtatctttggcaaataccgcagaaacgcccgctcctcgaccgccgctatcgtcgaggttccgccgtttcacagaatgtttcacaggttgtttcacgaatcgcctcgcttgtttcacggggcgtttcacagagtgtcttgcagtgagcatcgccaatcacctaccattcgatatcggcgatgggccgcggcgttgcgttgacctcctcgctggtcaccttgccggagcggaagcgaatcactttgtgagccatcggtgcaagcgcggaattatgcgtgatgatcattacggtcatgccttgtgtttggcaaatatcctgcagcaactgcagcacttccttgccggtctcgtaatcgagcgcaccggtcggctcatcgcacaacagcagcttcggctttttggcaatcgcgcgggcgatggatacacgctgttgttcgccgccggacagttgcgctgggaagttccccatgcgctcccccaacccgaccttgtacaaggtttccaccgggtcgaaatggtcggggcaaatctgtgaggcaagctccacgttttccagcgcggtaaggttcggcacaagattgtagaactggaaaacgaagccgatgtcgttgcgccggtaggtcaccagtccctttttccgcaggcccgtaatatcgcgcccgccgaccactacgcggccggttgtggcggtatccatgccgcccagaatgttcaatgccgtggttttgccggcaccggactgtcccagaatcacgcttaattcgccttgttcggcggtaaagctggcctcgtcgagcgcgcgaatcacactgctaccagaaggatattccttgaccacatggtcgaattcgatatacgccatcgcacacctccaacgcgctcgtggcagccacctagccccataggccccgccaaaacttcctgctatactcaagtaaaacaacactgtgtcggttctgcaaccaacagttggattgtgggttgtcggaatttggggagaaggccatggccaaagaattgacggaaagccgccgcacccgctacacgagacgtgccatgcaggacgcgcttatcgagttgctgcgcaatcagccgctcggctccatcaccgttaaagcgttgtgcgagcgggccgatgtgaatcgttccacgttttacgcgcattatgcgagcatcgaggaactgctgcacgacattgaagacgaaaccatggcctgggtcaccaccgcactcgaacagctactcgcccagccagattctgccggcatcgagcatgttattgagcgcatctgccagtacattgccgacaatcgcaagcatctgcaggtattgatgagcccgaaagcggatatcggcttccagcagcagctgctgggattgatttacagccagcgcggcgtaggcgaacagttgcaatcttcggcgggttacccagccgaggcgcagatgcgtatgcgattcgccgtgtccggcagcattgggcttttgcaatattggctcgccaccgatctcgcggcctctcccgaatcggtgtcccacaccatcttcaccatgtgtatgcctgccacgcagtgaacacggtgaattcagtgaactcagtgaagcgtgcggtttcataagcatcgctcgctatagcttcgcctgctcaccggccgcgcccacgcccgcgcttgcgatagcgcacaaatagacgattgaccatttctgagacgatacggcggcatagaataacgaacgttgcgcatcgcggcaagccccgcgtgcgccaaaacccaagaaatgtgagagaagggcacaatgagtactgctgatgcgcctaagaagccgcgcgaaaccgacgacgtgccggtgccggccacgctgcgcaagtcactgaagaaccgtcatatccagctgattgcactgggcggcgccatcggaaccggcctgttctatggttccagcgaatccatcgcgctggccggcccctcgattctgctcgcctacttggttggcggcttcgcaatcttcatgatcgtgcgcgcgctgagcgaaatgtccgttgaggatccgaaggcgggcgcgttcagctactacgccactcgctactggtccaagcgcgccggcttcatctccggttggaactactggttcaattacatcctcgtctcgatggttgagctgtccgtggtgggcaaattcgtaaactactggttcccggcgattccgacatgggtgtcggcggccgtgttcttggtgattatctgcgccgccaacctgctgggcgtctccaagttcggtgagttcgagttctggttcgccattatcaagattgtggccgtgatcgccatgatcgtcggcggcctggccgtcatcatcttcgctctgcccaccgcatccggcatcaaagcgagctttgccaactggttcaccttggaagggggcttcttcccgaacggtctcatggagcagactaaggacggcacctggaccggcctgttgatggcgcttgtcgtggtgatgttcagcttcggcggcaccgagctcatcggcatcaccgccggcgaaaccgaggaccctcgtcgtacgattccccgcgccaccaatgacattatctggcgaattctcgtgttctacattggcgcgctcggcgtaatcatggccgtaataccgtggaacaccatcggcggagacgatgttcccagcccgttcgtgcaaatcttcgattccgtgggcatccacgcggccgccggcatcctcaacttcgtgtgcctgaccgctgtgatgagcgtctacaactccggcctgtacgccaactcccgcatgctgtattcgctggccaaacaaggcaatgcacccgcgtatctgggcaagctcaacgctaagggcgtgccggtggccggcgtgctgacgtccgccgtgatcaccgccatcgccgtggtcgtggtgttcgtgtggcctgagttcgcgttcaactatctgatgtcgattgccaccatcgccggcatcatcaactggacgatgatcatgttcaccgaaatgaagttccgtaaggtggtcgccgcgggcggcgctcccgaggattccgaactggcaggcaagtccggcaaggaagcgctcgacgcgattcacttcaagctgccgttcgctaaggtgaccccgtgggtggtgttggcgttcttggcactggtggtggtgctcatgtgcttctccgccagctaccgcgtcgccgttatcgccggcgtgatctggctcgccattctcttcgccgcctaccagatcactcaggcgaagcgataagccccctattgcaaaaaactctcactgagggatgcccagcgagagttttttgcaaaatcaggccactcgttgcaaatttctctcactgactaagcgtcagtgagagttttttgcaattggggtcagatttgacgcttgcgccagatgatgagggcagcgccagcggcggctaggagggccatgagggctactgcgccgaggatggcggcaccggtgttggcggtttcgtcggccttgggctgttcggcggtgggcttggccacgttgaccgcgtcccagaccagcgaatcgtcagcgaactggacagcgaacttcgtggcgcccagcttcaggtcggcgggcacagtcaccaccacagtgccgtccttggagacggtcacaccggaggcgaccagcacggccttgccgttggagaaggcgtacacgttcaccgtcttgcctgcgaatgccttgcccacgttcaacgtcagcttggcacccggctttatggattcggcggtgatgaggtcgtccacatggttcgcgtcagtcagatccttctctgccggggcgggctgctccggcttgctcggctgctcaggctgctctggctcggtggtggtcttcttggtgacggtcaccgcgacggaagcggacttggtggcgtcttcggtagacgtggcggtaatagttgcattaccttcagccacggccttgacgttgccgttcgcatccacggttgcgatcttctcgtcggaggaggtccaggtcacggtcttggcgatatcaccggtcaccgtcacgtcggcggtgagagtcgcttcgccgccaaccttgagctccagcttgccgtccttgacctcgctacctgtgatggcgacggaatcaacggaaggtgccggaggaacgaccgggtcggtaacagtcacggtgatggaagcggtcttgccgcctgcggtcgcggttactgttgcggtgccagccttgacggccttcacgagaccggtcttgtcaacggtcacggcatcgccctcgaccgaccacgagaccgcagcatcatctgcatccgtcggagtgacagtagcagtgagcttcacggacttgccggtttccagagccaacttgccttcagccacaccgtcgccgaaaatggcgatggactcgaccggtacagtcttcttgaccagcttgaccgtgtaggtctcggtggtcttgccgtctgcggcggtgacgatgaccgtcaccacaccgtcattgacgttcaccttggcagtggcgccggagtcgttggcctcaaataccacatccgaagccttaacagcggtcggatcatcaacggtcagcgaagcaccgtcctcagtagcggcagccgcaaggtcaactgtctgaccggccacggtgagggacttcagcgtggcatcgctggacggagtcggagtcggctcgtcacccttgtccgggttgaagagatcggcggcggtgacggcacggttccataccttgaagttgtcgatctgaccaccgaagtacgggtcgttatagaacgacttaccgaggtaaccggcaatgttgtttgtgccaacaaagtcggcggcggtcagcgtggtcgagacctgcttgatcagttcgccgtcaaggtagtaggcaatggacttaccgcccttaaccaccacatccacgtgaacccacgtgttcttggccggagtggaaccggcaagctgagtctgggtaccggacttcgaggcctcgactcgtgtattggaaccacaggagacgatgttcaccaaataatccttggtgtccttgcccaacgcccacgggtagatgcaggtgttgttgccgtcccactggtagtcggcggaaatggtgatgtccttctggctggcatcaatcaggccggccggaatctgcacgtacggagacgcggagcccttgtcaccaccggtcagggtgagcgccttgccattgtcggcatggtcgcttgccgatgcgccatcgttcacgaccttaccgtcgagcttgtcgcctgcggtaccagtgttgtcgatagtgccgtccttgacgatggtgtccgtgtcgaaggtgtactcaagcaccggatcactggcggcgggcacagtggcgtcgccacgcacgatctgcaccgagtagtgcttcacggccttgtgatcctgcgcgtaggaagtgatttccacagtggtcacgtcgtcggtcagcgcgatggtgcgggccttggtgtcatcgatgatgatgccatcgaccttgacgtaggcaccggcatccttcacgccgatggtggcatcgacggactcagtaccggccggaacggtgagcgtgtactgggtcttggaaccatcgaaggtcgggtcaagagtgcccttgtcgaaggaaagcgacttcagcgaggcatcggtagacaacgccgcagcgttctgcatgcgcacgccgtatacgccgccgacgagaccgccggtggacttgaacagcacgcgcaccttgccgtccttggcctcggcaatcaggtcggcgggcagttgctggacatcccagtagaaggccttcaagcccttgttctcgatcgtgacggtgtaggtcttcgcgttggcggagacctcgcccttcgagttgtcggcgaccggggtcggatccacgatcatgctgaacgtgcggcccgcatcggcggactggtactggacgctcaggtagttcttggcatcggcctcagtgttcaccttgagatcgtagctgaaccagccgtcggccttggcgtcacggtactgcttgtcctcgtaggtgccggcgttggagtcgtcggacttagcggcgttgtgagcgagctcctgctggaactcgttgtcgaaggcgtcaaccgcgtcgatgatgatcgactgggttgcagcgtcggtcttcttcttgaagatgttgttctggtaggtttcggaatcgacctcggccatatcccagtagatcgcgtacgtggtcttgtacgtggagtagtagggttggagcgtgaggtcggcggcgtcaccgtcaacattggcgaacttgaagctcagggtttcgcggttgccggtgttcggatcgtcggtacgcacgaggttgctgccttcggacgcgtcctccttgatgcccttgagccagtcagtgaccgagccagaggtcgggatgaccgcagccttggcgttggcctcggaatcgtagttggccacgcgcaccttgacaccaccgtaggagtagttcgtcttgtagttggtatcggtcagcgcaccggcgagtacgaccgggccgtactggaaggcgacccaatccttgttgtcggcggcatcgatggcctgcaacttagcgggcaaggtgtaggtaatcttggcgccatccttgatggcgaccgtcacccaaccgttctcgtccttagtcagagcctgctcagtaccgtcaacaacgagcttcacaccattggtgatggcccagtccggcacgcgcaacttgaggttcgcggaaccggtaccggagacttcgaacgtgacgtcctcggttttcggcacattggcggtctgcgtgatggtcaggttgtggcgtgtgtccgtgtaggtggacgaccagaacatattcacgtaaacattgttctcgtcggtgaagtagaaagaatcgttgagcttggcgaagttctcgataccggtaccctggcagcaccaatactcgccaatcgcgccgccgaaccagtcggcgtcgtagtcggtgccggtgatgccgaataccttcgggtagccggccttcatcggctggaagtacgtggtcataccggtttccgggttctgggaggccacgatcgcgttgatgaacgtgtgctcgtagtactcggagtacttggaatccttggtcacctggaacaggatgcgggccagcttgagcatgttgtactcgttgcaggtctccacggtggagaagttgcggtagccgccgttctggtcgccgttctgggtggcgtccttccacagttcaccggccacgtggaagtgctcggactgcgagttgccgccgttcacataggtgtgatccttcacaacgatatcgaagaagttctgcgcagccttcaggtacaggctggtgagcttgcctcgctcgtcggcggaaaggctgttgtacaggtcctcatcctcggtgtaggccacgtatcgctgcatggcaccggtgagcttcggaatcgtggtgttggcgtgcaagccgttgagcggatcctggccattggcgagcttctggaacagcgcggtctcatcgaacaggtgcgcggccgtgagcacggtctgcttgtcggatgcatcggcgatttcggcgacctgatagagggcgtcattcatgccgccgtattcagtgcgcagcatgtcggtggaggcgtgtgcggacttccagttgacaacccacttggcgaagtcgaccgcggcggccttggcggtttcgcgagtttcagcgtcggtggagtagtcgtatgcctgcaccatgccggcctcaaccttgtgcaggttgtagaacggcacgatcaggccgccgccaccgttcggcaccacgctcgcggagaatgcggggaagaaaccagcgttggcggtgtccttcttggcataggcttcctgcgcctcacggatgcccttgactacagcagtgaggtttgcggagagctgggccttctgatcagccgtggcaaaggtggagcgctgcgcctgcgaggccgcggaaatccagtgacccacgaagtgaccggtgaagcgtcccggtttgctgctgccgtcagggttgcggctctcgtccgggccgttctcccaaccgccgtagttcttcgcgcccttggtgtcgagaccggcctgtgcacggaactcgaccagcagacggtccggctcaaagctcagcagatactcgacttccttcttaccggcgttctgcaggtattcgtcggctacggtgacgttctccatgccctgctcggagaggtagttcttaaggtattgcacgtcgtgtccaccaccgttttcggtctgcgctggcacggtgacggtcacggttttggaaacggccttggagccgtaggaggcagtgacggtaatctttgcggtgccatcggcctcgcccacagccggacgggttacgacaccctcattggagataaccgcttcgttatcggaagcgtacgtcagcgttgcaccattggccgcttcagtgttgaaggtcaggttggaggttgccgaagtagcgatattcaccttgtcgagcgcggcctgagccagcgtggtagcgtcaaaactcttgtcaccgaccttgacttcacgctccgcatcggcggtgttggccacggtattccacagtttcacgtcatccaacataccggtgagctggccaccggaagcatgggcaccattccagccgatgtacttggtggtgtcgtcggccacgatggtgccggcagaagcggtgttatcagaggcagcagtctgcgcctcaccattgatgtagaacttcgcggtcttggtcttggcatcgaacgtgaccatcacatgggtccacgtgttcacagggaagacatccgcgcgcttgcctgacaggttgaattcgagcggctggccggagccggagccgccggagcccacgccgaccgacagcacgagcggcttagtatcagaattggaactcaggtaccaaccgttttcgttgtacttgcccttgccccacatcagaatctgctcgccggtcatcgtcttgctggggttccaccagaacgagagcgacaggctttccggctggagcttctggcttgcgccaaggctgagcgcgccttggctcagcgtaatggccttgccatccacgccgtcaacataggtggcggtgcccttatattcggtgacggtgtttgcagcggcactgttgtcggtcaggttgccgtcgaaaccgagatcgagcaccttgttagtatcacttgtggccggctgaatgctggagtccacttctgcagccccagccgttcccgcagtcatgagcgtgaacaccatcggtattgcagctaccgccgcaatacctttgcgccacgcgcctttccctttatcgatagttctcatacgttgagagcctctcctactttgaccccattgttatcaaattgttatcaggctggatgctgcgtccatcgaacacaacagcggcggctccttccaccgcccaacccaatatgcacccgcatcactgtggggagcgtgacaccaagccaaaaacccacgaaacacaagagattcgcagaatcccagcgcagcatcagcacactgtgtaagtgtttatgcattataccgttagcgctcactgaaatacagacagggaggcagggggtatccgtcgaagcaatttccgcacatcacatctgtgcgtttggacagcatataccgcataaaccatatcggacataccattgattcttctctgccagaccggcgaccctctcataagccggtcttcttcgcgcagctcacgcgattttcgcttatgcaccgacgtgtggcatgcagttcgctctgcttgccacacactagcagccactgaccgacaccgacaacgaatctcaatacggacttgcgagccaatcgagtcgctgcaatgaacacgcaatcgcgccgccgaggcaacctgaaaatctcaaacacaacgtcaaaagatgacagagtacgaaatctacagctacgaagcgtttcgccgcaaatacgaggacgaaatacgcatcgtggaacgcgccgaagccgatgacctcaaccaagactccctactgcggcatgaactcgcgctcaaaagtgagcgcccacattttgcgcggatggacgaatcacacattctggaactcaccagcgttttgcggaacggaaagccgacactagccgggattatgctattttccacgtatccacaggcattcttccctcagttatctatcatcgcaacgcgaatccccggcacgcaaatcggcgatacaaggccaaacgaagaacggttcatcgacaatgctcgcattgaggggccgcttgacgaacagctgcgcggagccatcgcctttatacgcaagaatattcgcacaacaactatcatctctcccgaaaacggcgaaagaatggatgccgctgaatatccaattgaggccgtccgcgaattgatattaaatgcactcatacaccgtgactacagcatccacacacagggtatgccgatacagctgcagattctcgacgatcgtatgaccatcatcaatcccggtagcctatatggaaggctcaccatcgatcagcttggcactattcaaccagatacacgcaatccagttatcgcaaatgcgctggaggttctacgagtgacgaagaatcgttattctggtatccccaccgtacgcagacttgcttcagaaacgggaatggccgctccattattcgaaaacactcgtggagagttcagagccacgttgtattcgcctctcgcccgaactacgttgccatccgttatgagtcacgaagcgttcaaccgactggactatcaggcaaacggtcagaggcctaattcccggcgcagaatccggcccgaagagcgtaatgccgcaattctgcaattctgtgcaacaccgagagcccgccgacaaatcgcaaacttcattgggctggatagcactgcatatgcaatgcgcacttatgtgcaaccattggtcgtacctggtcaacttgttctaggcttgcccgacaaaccgcagagcagtaaccaaacctatcgcactgcatagccgtaacaagcgcccccaacgccagataggtatgagccctaaggcccaattgcaaaaaactctcactgaggagtgctcagtgagagttttttgcaaatgaggggtcagatacggcgcttgcgccagatggtcagggcaataccggcggcggcgaggaccaccacggcaccagccacgccgaagacggcgacaccagtgtcggagatgacggcacccggcttcttgccatcagcggagaccttcacgagggccttgcgggcctcggtcaggtgacgaatcgcatcctggacctcggtggaggtggcgttctccttggcgagcaccttcttcgcttgggccagcgcattggcgtaggccttccacgaatcggcggtgtaatcgtcctggttcagcttctcggcttcggccttggcaatggcgtcttcgagctgcttgagctcttcctcagtggccagatcgggatccggagtcggcgtctcgtcggcaacgaccttcacggtgaacgtggcggtcttggtcgaatcggccacagactgcacggtcacggtcaccttgtcggaggccttcgaggagtcgaagccgagcagctcgtactcatcggcggcgagctcacgggtggtggagccgccgttgccatcggccacggtcgcggtgacgaccagaccggcaacgtcgagcgcttcaccaaccttgtactcggccttggcgggctgcgcggtcacggcgatggagaggatcgtgcctgcggccgggtgctccggctcgggctggctctcctccaacgcattctgcgcgtcggtcagggccttggcggcggcatcgacatcagcctgagacaggccggagtcaaggaaggtctgcttggccgtcttggctgcggcgagcgcatcctcgaatgccttccagctggcctcggtgtaagcagagccatcggtgccgagcttgtcggccgcttcaatcgcgccatcaagcgccgtcgtatcggccatctcaatggacacgccttcgtcggtcgggtgaatggtctgcatcaggccgtccgcgtcgaaggtgatctcgtcgatggcggtttcacggtggtagccgaggccggaggtgaacacgccgagcggcgtgtagtggcgatggtaggccatgagccaacggtcgttgccgtccgcgtcggtcacatgcacgtcggactggtgcgcggtaccttgcaggttcttggaggaatccttctgcagcagcacacccttgtaggtgatggtgccgtcgatggaatcggagacgccgtacctcacatggtagttcggggagttggcgtcgtcgcacgaccaggtccagtggtacttgccgtcgcggtaggcgacgaccacggactcgcggaagccgttcagaccgttgagcttcttcaccgtaccggccttgatgctcaccatgtcgtcgttgagttcggcgatggcgggcgaaccgttgccgtacaggatgtacgacttgccggtgttcgggtcggtgaagatggacgggtcgatggcctgtccaacggtgacgccttccatcgtgcgagtgaccagcggctgatcggcggccttgaacggaccggccgggttgtcggccacggccacgccgatggcggatgtaccgttcggcaacttcgcgcagtagtagaagtagtacttgccgttcttcttctcgatggtcggcgcccacgcggagcccacggaccacggggagatggcggtgttctcatcgccatcggtggtcggctggtggtccttattgacatcgaggatcacgccctcgtcggtccagttcaccaagtcggtggagctgaacgcatggaagtagttgccgctccagccggagaagccgtcggtggtcgggtagatccagaacttgccgtcgaagtagtcgatgtccgggtcggcgtactggccgggcagtaccgggttgttgcccacggtgaccttcttcagcgtccaggtctgcggcgcaccgtcgcccaaatcaacgaccaaagtacggtccttagccaggtcggccgtaccaccattggtgaacgcctgaccatcaagggtgagcttgatggagtcgtcgctacggttgacagacaccttgacgggcaccttggtcgcgccgccacggcggttgagcacggtggtgacggtcttcgtggaccagtcgagggtggaacggacctgagagtggtcgtcagtgccacgcagcgagttcgggtcagacggcacagtgcccacagaaataccctgcagagcaatcgggctggtcttctcgacctcctgagcagtgagcgcgcggttccacacgttcacattgtcgaacgaacccttgaagtatgggtcgttgtagaaggacttgcccaagtaggccagcagatcgttacccaaatcggtgaccttgttcttggtcgccttgttctgagccacctgcgcaccgtcagagtacacggtcatcacgttgtcgtccaacgtgaccgtgacacgatgccatgcgccgttgccagacaacgtagcgttagccgcgtcctccgcaccatacgagttggtggtgatgcggctggcgagctcgccggagttgttgtacttcaggaagtagtacttggtggagttctggccgaaagcgaacgtgaactggtttttattgatctccgacttgacatccatctgcacagtcagcttgtcacggccgtcgaacaggcccttcgggaactcggcgtaggtgccgtcagagccgtcgagcttaagcaccttgcccttgtcggcatcctcggagaccttggcgttgccgttgaaggtcaggtcgttgttgttctcagtggtgtcggtacccttgctgtcttcgaagtcatactcggcaatcggaccggagccgtcctcatcgggagtgactggcccagcgtccttgttcttgtcgaacaccttcaggattgcgttgtactcggtttcggtgacaggcaggatggtgccgtgacgcttcttcagggaaccgaagttcacatcagaggcaaagccccaatcagccttatcagtgctgcttaaatcggcagaacggtatggggtgtaacccttaccggctgcgtactggtcccacatcagaccatagagcatcttcttgcccgcatcactggcctgcacgtcatcttcattgtagaagaacagctccgggccttccagctgcgcaccggtcagaccggtaccagtcaggtctccgaaggtaccgacaagcgtccaccggttcggatcactgtcagtgttgtagtaaccattcgcgattgtgtcaccagtggtgagcgttgtggcatacggatccttgctacgctcgatgccgaggtacgtgtcgccggaaacacggtagtagtaaccgtcatcggccttaatcatcgtggtatcgataacggacttgactcggtcgatccacttgacaggcgttgtgaagttcacgaaatcacgcgtggtggagtagtacatgttggtgcgatcaccggacttgttgtcggagtcggatgcggtggcccagtacaccatgtactgcttgttcacatcatcccagtgggcttccggagcccaagccatgccggctcccggaatctgagaggcaacgtcaacggcgcgcggttcgctccagttgacgaagtcatgcgactcccacacgatcaggttggtgctaccggtgctggtggccgcggccgcgccccaaccgccacggttgcggatgctcagctcggtagcgatgaggtagacagtgtcgccttccggagagcggaccagatacgggtcgcgcacgccgttgtccttgccacgagagttgccggtctggctgttgttccagctgagtaccggatcgccggactcgcgggtgtcatgccagctcaggccatccttgctggtggcgaagtacatctgctcgtcggtagtgctgccttcggtgccggtgaagtgcgcgaacagatagtccgtggtcttcggctgttcgacggcggccttgacggtcagctcgaattccttggtttccgtgttgccgtcagcatcggtaatggtggcagtgagcgtcaccttggcgtcggccttctggcgagtgacgacgccggctgcgatgtcgccatctgcagcatcagtaatgaccttggcgtcgctggacttccatgtaatcgcggaaccattaaccgaacccttggctggaagtgtgatgtcggaatacgcatcggtgctgccgttgttgatggtcagcgcgttagcgtcggccttggcggcatcggacttcgtggaatcgtaggcttccttgatttgctccgcagtgtgcgcggagccgtaaatattcaggttgtcgagtgcgccggtgtagtactcgccgttcacccagttggccttgccgatctgcagcacgccgccgtctgcgccgagaatatcggtgagctgagcgaagctcgcgccatcagccggggctacggttgcggcctgctcaccgtcaatgtacagcgtggaagcggccttgtcgatgaccaaatcgacgtgacgccactggctggcgagaccatccttgctcacattgccggtggtgtcgcgcttaccagcgttgttgtaacgctcaacgttcaccgaagtggtgcgatccatcacgccgaggtaacgctcttgctgataggtctgcgcattcgtattcggtgccgcaaataccgaccagccctgattggtgctggcggacttggaatcatacgaaatcgtgaccgcatccaggcccttgagcacagccgaatcatccgacttagtcacattcagccagaagccagaaccgagctgagctgcggtagtgccgtctttactggcagttactgcggcggcaccgttgatggttgccttggtgccggttgcctcatcggtgaaggtaccagtggcacttgccgtgacgttgttgaagtcaaggctggcaagcaaatcactgtctgccgatgccttggcatttgatttcagggctgctgccagcgcccgctgtgcggccgatgaatcggtggtatccgattcaaccgcatttgctgctggcgccagcgccatcagcatcgggacagctgcaagagctgccaccgctttcttccacttacccatatgtctcctctgattgtgggttttggttttgtgttcagttatggattgaagattgaagttatggtgatactaggtgctccctctccgtccgccagaagccgactgagagggagcatttggatccgctcaggcgcgacgcttgcgccagatagtgagagagatgccggcaacggcgagcacaaccacggcaccaccaaggccgagcacggcggcaccagaggacggcagaccggagtctgctcccgtaccagcgttaccgttatcgctgcctgcaccatcgccggaaccgtcgcccgaaccgggcttaccgggctcggtcttggcactcacggtcaccacgaacgacgtggtgagctgatcgttggccttgagcgtgacggtgacggtcttggtgcccacagcggacatgtccacgtcgccgaccgtgtagtcggcggcatcgagcgtcttcaccgtgccgtccgacatcgtcgcctcgatcacaagaccatcggcggagaactgctcgcccaccgtgtacttggtctttgtcggctcgctcttgacgcggatgccggtgatggacggctcaaccggcgtatcgggctcgccgacggtcaccgtaatggtcaccgtgcggttggccggagcaacctcctgatccttggtcagcgacatgtcgagcatgccgttggcgcgcacgttcacggccttggcccacgtattgcggtcctgatcgaacaggccacccgctgcggaaccggagtgaatttccgggtaggggcgtgcgtggtaggccatgacgatgttgccggcctcatcatgtgcaagcgagatgtggccggggccggcctgcttgcgctcgtacgaggcctcatccgcaccgtaggcaccggtgtaggtgtcgttggtgtcgaacgacgggaagtcggccgtggtccagctcgacagatcctgcaggtcggcattcttggcggcacgcatcacgttggtgttgtaatacttatccaccgtggcacccgcataggcaatgtagacgtagtcgccatgttcgaacatgaacggtgcctctacgattgcctgatcagaaccttcagagttgtctccgggggtaggcgcatacttgccgtactcgaactgctggctggcctgatagatgtgctcaaggctgccatccaccagcggagtgacgccatcgcccatctttgccttggcaaggtacaggcctgcgctcttcgggaagagccagtagccctgggccttgccgttctcctcgcgctcgaagtacgtcacgtcgaatgcggcgccttccagcacggtcggctcgccccagttttcggcctcgaggaatccgccatccttgatggaccgctcgtcgccggtgtacgggatgaggatggtgttgttgcaccagccaccgttcgtggacgaggcacccctgtggaagccggccacaatccaccacttgccgttaatcttgtggaactcctgggcccaaatgaacgcgctccaaccgtagaacgagttggggtactggtcttcgtggcccggagtgccgttctccggcttgatgatgatgtgttcctcagcatccttcagaccgttgatggtcttggcgcgcttgaggccgatggaacggtagctgtccttctggttgttggtcgaatcagtggactttacctcataggtggaaccggtgaggtagtagtagccatcgtcttcgttgtagaagatgtccggatcggcgcgagcgtcgttgtacatggcctcggtggtctgctgaacagtgcccttgacctcatacgtgccggcctttgaggtgtccacggcggccagatcatcggcgttccagtcgacgttgaaggtcttcgtggagccgtcgttgtaggtcattgtggcctgcgttccggaaaccgctgcggtgacgtcctcggcggaagcaccgttctccacggttgcgccgcccagagctttaacgccggtgttctgcagatcgacatagttcttgtagaacgcatcgaattcagaggagctcacagcgaatgcgcgggtctggccttcgccggcccatgcgggcagaccttcggtcacgtcgcccacacccatcgcaaccgcgtcggccttgagcgtctcgccgaccgttgccttggcagtcaggtcggagagcgtggccatacggccttcgccgctcaggccatcggtccagaagaccttgtagcccttggaggcggcatcatagacgatgcgcgggttggtgaccatggagctgtcggtcacggtgatggcgcgctcgttggtgaacgtggcaccgtcgcccttgccatcccacacgtaaatcgcaccggtggcgttgttctgcgaggaaaccacaccaagggtaccgtccttcgcacggaagaaagcgggcgagcccatctgcgcattcggcttggcagactgcgagccgtcccacttgaccgacagaatcgactgcgaacggttcagggtctcccatttgctgccatcggcggccttggcggccacgtacagcgagtcggcgcgacgatcgtcgttgtaggcgagcgggtcgtacttggcaccgttctggtcggagcgatcgacatccttgacgtaggaagcgatttcgccgccgttgttgaggatttcggattcggcggtgatggccttatccacgccgtcgatggtggcggtgagcttgaccttcacggccttctcgccggacttcggctgcgtgaccttgccgtctgcggctacgagcttcgcaccgtcgccggtcgcggaccaagtaaccgtcttgcccagcacagtgctcggcaggtcgccggtgatttgcgccgggatggcgagcgcggcggcgtagtcggtcttcgcgctttccacgccaagctcgtcgtcgctcagggccttgccccagatcttgaagttgtcgagcagaccggagaagtactcgccgttgctccagttggccttgccgatctgcagcacgccgccatcagcaccgaggatgtcggcgagcttctggccgttgttgttcacggctaccagcttggagtcgatgtacagcttggcggttgcgccggaaatcacgatatcgacgtgcttccagtcggcgttcgtcttggtgtatgagacgttgccggaggaatcgcgcttgccgtcgttgttgttgtagcgttcgacggtaataccggtggtcttgtcgagcacgccgacgtagtgttccttgccgtactcctgcttggtggcgttggaggcggcgaagaaggtccagccagtgttgttggaggcatcgggcttgacgtcgtagctgatggtcacgtcgttcttgcccttgagcagagcgtcgccgttcttggcggtgacgttgagccagaagttcttgctgagcttcgcggccttgccgtccttgccgtcggcgagcgtggcggtgccctgcgtggtgcccgtcgcgttgccgccgtcaaaggtcttatcgccatcatcgaacgtgaagtcggcaagcagatccgggtcggtcggctcggtttcgccggtcacggtcaccttagcggtcacggtgatggcggtggagctgtatagcgtgcggttcttgttggcggtttcattgtccacaaagccaccggtctgcttccagctgttgttcgcgttcgcaccggagttgatgaggtcgtcctcgtcggtcttcgactcgccggcggcgttcgtccacttccaatggttctcgttggcaccgatggtgtcgaccgtgccggtgacggtgtattcgccgggcttggaggtgtcgacgttggaaacgtcccacgtcacgtcgcgcttggcagtgccgtaaccgttggcaagagtgacctgctgcgtcttcggcagcttggcagtgatgtccgtatcggcagcacccttatccaccgtcacatcctcggccttcaggtcggcgttgtcggaagccttggcgtcagccgcgcggatcgcgtcgtactgggccttggtgagcgagaccacgccaccgtgcttggtgttggcggtgaggaagtaatcgtcggccttcaggacgctccacggattctcggaatcgaggttgtcggcttcgagtaggttgtagccgtagcgggcaccggaggcgacagatccatagttgtcgacgaacatgtaccacttgttttcgccgttgaccttgaaaccgttggcaccttcctgcgcgctgccgagcgtgtgtccgatgttggtctggcgcaacacccagcccttggccgggtcggtcgcgtactggccctggtcgttggcacgccaccaatcggcacgatcggtgtattccatgaagatcacgccggaaccggtggtgcggtatgtgcgggaaccgttctgcagcatcgtggtgtcgatggtgttgccacggttgtacttgctgttaggcacgaagacgccgccaaacatgtaggtctcattggtgaagtccttggtggcggcccacagcacgtgagtcaccttcttgccgggctgactgttctcgccatcgtatttggcggagacagaccaatacacaacgaatgcgccgccctgctggttcttcgggttgtccttatcggaaccgttgagctgaccgtcgtcgttgagatcatagaagttcggcacccacgtagcctcaggagcccatgccatgccgatctcggagatggtcttgccggtcacggaatcggtgagcgtctggctcttgttcggattggcagtgtacttgtcggcggtggcggtctccagttccgtcatgtcgttgaagtgaatgagatctttggacgaccacacatgcaacttggtgctgtaacctgtagcccacgtgccccaaccggcattatcgctgccgaacacacgcaaatcggtggccagcacgtagtaggtcttcgactcggggttgtaggcgatgaacggatcgcgcacgccggtggtggattcgttgctcacaagaatcggctcgccgccgttgagcgtgtcccactgggtggcgtcatcaccgcgtgagatgtcgaggtagaccttttcggcgtagcccttgttgttttcgatgaagtggaccatcacgtagccgtaggcgtcatcggccttgacctcggtgacggtgaccttgagctcggcggtcttggcggcgtcagcttcggaagccgctgtaatggtggcggtgccggccttcacgccggtgaccttgccgttggtatccacagtagccacagccggattattggattcccatgtcaccgtaggctcagcgccttcaggggtgacggttgcggacagggatgcggagttgccttccttgagactcagcttgccgtccttcacattggaaccggagatctcgattgcagtaggcgatgcgatgccgagatcggccgcggaaagcgcggagccataaatcgtgagattgtcgagcaaaccggtgaagtattcaccgttgccccagttgcctttgccgatttgcagcacgccacctgagccgccaagaatgctcttgagatcctcgccgttcacgttgctcgccacgaacttcttatcgacatagagcttcgcggtcttgccggagatgacgagatcgacatgcttccaagcatccttcgtaccggtgttcttgtcgatggtggcgatgtcggatgcgcggccgttgagatagcgttccacgcgggtcttgtcggtgcggtcgagcacaccgacgtaggtgggggcgctgccgttcaccgcaccggcggtcggcgcggcaaacacagtccactggccaccggtcgcagccgccttgctgtcatagctgatcgtcacatcatcaagaccgttgagcagtgcactgccatcggacttggtcacgttcagccagaaaccgctgccgagctgggcggccttgccgttgtcgtcatcttttccgttgacgagattcgccgtgccttgcacggtggccttagcgtcaccctgagcactggcgaatgcaccatcgtccgggtcgctattgaaatcgaagccggcaatcgggtcagccgtcgctgtattggccgccgccctgacgttcgcactggtcgtggtcgtctgcaccgcaggcgtcgcgtcgtcggccacggcggtgatcggcatgatcaaccccgcgcccaacgtcgacaccgccgtcaggcaggccgccaatcgtgtaactctcctcactgagtttccttccttgggtccttgcttctttgcaatactgtgatggatcatcgttgcgccatcgcaatatttgttatcgaattgttatcgagtgacacccggtcgctcctttatcgaccgcttctcgctcctgcttccgcttcgccggagcctcttcgttcgccagcgcgacccacttccgcccgaacgacggccaccggaaatccctacgaacgacaccgttcgtgaacaggagcaccgatgtgcaatcgcacaggtttctgtaagcactcacaattctaatgtgagcgttcacctaaatttgagcacgctttgagcgacgacgcgaaagcggtaacgcacatgctgattccttgccatacctgaaatacccggcacccctcttaaaaccggtttcatctccccgaatgaacatttaccccttctcagcaccccacaacaaacaaaatcgcacatcatctgtgtgcaatattggcttgttgagccgcgtggcctgcatgtccgcgttatccagttcacgggatcatgctggtaaatcccgtgaactgaagacatgtgcaatcgcacacgcaaaagattggaatcaagccgaactcgatggccggccatgtgcatttctgtaagtttctggttcacgggattttcagccgaaatcccgtgaaccagaaacggctccgtaccgagcgtatttccgagttgtagggcacgcgcccgggtactcgccactcccagagccgatcaaccacccgaaaatggcggaataccaacgggctctcatcggccgcaacggccaatacttcagccattgccctacaactcggaaaatacacctccacacgggccgatttcgcgattggaggcttacgccgctcaggcctggcgcttgcgctggagggtcagggcgatgccggcggcagcgagcgccacggccacgccgctgaggccgagtacggcggcaccggtcttagacagaccgagcttgttgcccgtcttatcaccagtagcaccagcgtcaatgctcgagccgtcgcccggcttagtcgaatcgctcgagccatcgcccgaatcggaaccgtcgaccttcaccaacgcggcctgcgccttgttcaacgcggcggttgcgtcgtcgacgtccttctgcgaagcgttctcgtcggcataaaccttctcggcggaggccaacgctgcggcgaacgccttccacgaggcggcggtgtagtcggactcgcgcagctgcttggcggacgcgagcgccttggacaagtcggtcttgtcgaccgtaaccgtgtcgtcgaccaccttcactgtcacggaaacggtcttggaggccagctcctcggaagagctcatgtcgaacaccggcataccgtcggcagcccagtgcacgcggcgtacgaacatgtcgcggccggtggcattcacggagccgaggttcttcgtggcataggcgtggaacacgtagatctggttgccatcttcgtcctcgctccacatgccgtgaccggtgccgagctgcatctcaccgttgaacggaccggacttctgaatcgggtagttgagcaccgtccaactggccgggtcggtcaggtcagtaccggaggcatccgctacggccagcccagtggtgtatgtcttacccacgccggaaccggagaacatgaggtacagcttgccgtcgcgcagggtcacgttcggaccttcggctatggcggcgttccacgcatactccggggtgacgatgcgcaccggggagctggtcacatgggccgggtccttcggatccatcgtggcgatgtaggtggcgccgagctgctgccaggcgtagtaggacctgccgtcggcatcctggaaataggtcatgtcgagcgacatgcccactccgccggacgctgtggctgcgagctgcttgttaccgttgagcagcgaggcgtcattgcggtagatcggtgtcggcacagtccagttatcggggtcggccgggtcgaggtcgtgaccgtcggcatcctgcttgagctgcatgtacaccgacttgccgttggaccatgtgttgccgtatccggccatgaacagaatcgtgagcctaccatcaatctcatgaatttctggagcccagaagctgtgcatgatggcattaccctcggagtccttgtcgccagccttgagcagcgacacctccttgttgttgtagccgttcgactgaatcagggcattcgggttgcccggctcgtcggcgagaccggaaatcgtgtcggccatgcggaacggcatgtggggcgaaccatgctgccaagtgacgtcaccttggatgtcattggaagcgatcatcaggaacttggtttcggtgacttccttgccgtcggcctcatgcgtccactgccacttatacaccgatggatcggcgcggtcctcagcgaacggaatctggtattcggtctgcttgacggtgccggtgacagtgtaatcacccaccttcgtcagatctatgccctcagtgttccatgaggaaatcggcagggagccggtagaaccgtcggagtaagtgaggtccacgttcttcggcagttgcgcggtcacctcatcgattgaggcgcccttcttgacggtgatgtcagtgagattgctcgtgccggtgttctcagagcggccgtaacgggtgttgagcgccttcaccgtggcctcgtccaccgcgatggtggcaccggagcggaagttcgcgatgccctgtacaccgtcggcggcgagtacgccggacttggcgacggaaccgtacagtacgctgccgtgcttggatgtggagcccttgagcgaatcgaacgtggtgtacttggccacgccgttgtcatcggcccagccgacaacatactgcttgctggcggtgtcgtacacggcgtacggagcgttgacgccgttggtctcgccaaggtcgacgatggaaccggagttctcctgttcgctataggtgagcaggtcttcggaggtggcgatgagcacgctggacttcgcggtggagtcaccggtggcggtgccgcggttggtacgcacggaaatcacgccataggtgccgtcggccatgcggaacaggctcggatccttgagactgcgatagtcattgccgtcgaggttctcgttgagcttctgcgccttcggcgagcgtgcgaagaaaatgccgtaattctcgttgtacggggtgtacgagccgtcggcgttctgcagcgcgaggtgcatgctgtaggcgacgtcgccgttgttggcctcattctcgccggtggcgttgcgatcgtaggcggcgatggtcgcggacttcgcggcgggcagcacctttacggtgaaggccttggtaatgggctcgatgccggcgagaccgttcttggagaactcgacggtgatggtaccggtcgtggcctcgtcgccatcgatggtgatcttgccatcctcgacggctacgtccttagtggacgtaaccgtgacggtagtgccattcacagccgccgggagggcgtctccggaacgcacgacggacgggatcacgtagccggccgcgacttccttgagctgttcagcggcagttttcgtggtcgggttgaccgtgaccgtgaattccttcgtagcggtctggccacggaccgtgacggcggcggtcagcgtgacagtcttggctgcctcgcccttggcgggctggttgaccgtgccgtcagtcgcgatgacgctgctatcggaggacgcccacgtcacgccgttcgcagtgggcagcgaaatgaacggatcgtcgaccgtcgtggggatgatgatgccgttcagcacggaaccggtgagttcaccggcatgaattgaggcatcggcagtgctgatcgcggcgacctgatcggcggtgagcgcggcatcgtatacgcggaagttcgagaccgcgcccttgaacaggttgtcgggccacggcgaacggccgatggtgttgagcgactggtccttgacgctggacagtttggccggcacggtgccggatgccacctgcgtgccgtcgatgtacagtttcgcggcggtgccatcaatggtggcggtcaccgacaaccattggtcggccttggccacgcaggagctggactgcacgagcgtctccgtaccgcccgatttcaggccgacgagcgggttacgcgaactgccgcagttgagcgtggcgaagaaatactccgtatcggagctgtcgttaccgatgttccacaggaaatggaaagcattgagcatgctggaatccgctttgacctccaactgcaccgtggcggcgtccttgccggacagcagattcgagggcagcttgacccagtcgccggtgccggtcttggcaccgccggaaagggtgagggcatcatcggcccaaagcgagtcggcggagttctgtacttcggccgcgccaagcgtagcgttcggcgcactgttggccacggtcttgccgtcacttggcttcgtggtgaagtcgtaggcggcgatgagattattggtcggaacggtatcggccgcgaccgccgtggtcgcgccgattcccatgccggcgagcgccatcggcactgccagcatcgcgccgagcaggcgtttgcctatcgatggtttggttgtcattggtttcctctttccgcgcggtgatactgcttgtcgcgcaacagatctagatgttgagtggtgaagttcggtaatggctattggagctatggggctatagagcctatgcgtccgacagcgtcgtcggacgaacgtgcgatacgcccctctgatggggccgcgccatgaagcaaacaatccagtaggctgcttgcttcacagctcgactcatccagaaggggcttggtctacgctgcaaacagttcaggcgcggcgcttgcggaaggcgtaggcggcgccggcggcggcgagcagtatgaccgcggtgatacccacaccgaacaccgaggcgccggtgttggacagagcgctgcccggcttggcggcgggcttttgcgtgccgtcatccttgccatcggtcttgccggaatcgccggacttcttgaccagcttgtcgacggcggactggagccgagacagcgccttgtccacttcctgctggtcggtggagctctgcaacacctgcttcgcgtcggcgagcgcggcggcgaaagcatcccaaccagactggtaatcagccttgttatagcccttcaccttatcgacaagcgcctgcaacttggacttgtccagcgtggagccgggctcgccggccttgatggtgaacgttgccgaagcagtaccggagtacttgccagcgccggttacggtcactgtggcggtgccgggttcgatgttgttcgtgtaggccaccgtgtagtcggcgccttccttgagcgtcgcgccatcgagcgtaacggtcacggccggttccttggcagcaccgtctgcggtgaactcgttgggttcggccgtgacgaccgccccggagatgtcagtgccagtcacggtgacggtcgcctcgaccggcatacgggaatcgtcctgggcgacgcccttgacggtgaaagtgccggtcttggcataggaagctgcgtcaatggcatcccactcaactgcaacgtcagaaacggaaccgtccgcatgagtcagatgcgcggtttccggcagcgtcggcgccacaccaaccgtcgtctcggcagacagcgcgtcaacggacttcacagccacagccggagcgtacgcctccagcaccttctgatactgggcgcgggtcacgggcagcacagtgccgtggcgcggcttgccgccatcggaattggtcgggaagttcacctcaggcatcttattgccgataacggtccactgaccgctggcgatatcctcagtcgccatcggcacatagtggtttggaccttgatgatagctcggctggtcggcgaacaggtagtactggtagccgttcacgtcgccatcgttggccttgaatagcgatggaccttcgccggaagtgaaggttttaccgtaaccgttagcctggcctttaccgatgttcgtggcaacttcgctccatgcactacccttaagcgcatcggcgtagttcttcacgccggcaccaccaattgcggcagtcaaatctgtggacttctcctgacgcaaagacatcgtgttttcatctttgtagatgcggtagtaggtatcccctaccttttgcacggtcacatcgatggatccactgcctgcaccacctcggcgatcaacgtcaatccacactgtcgggtcggagaagttgacgaagtcatcggtggtgacgtacaccatgcggttgtaggtcagctgcttgcggctgttctcgtcggtgttgtcgtacaggttcgaggcccaatagaccacgtacttgccgatttcctcgtcgtagtaggcctcaggcgcccaagtgttgcctgcgtaatcagagctcaccttgacgtggctttgcttggaccagttgaccagatcgtcggacttccaaatctcaatgtacttggaaccgttagcctgtgcaccagcaaagccattcagcccgttgaggggagcacgaccgtcaatcttcagatcggtagcaagcatgtagaacttgtcaccatccttggacttcatgatgaacggatcgcgcaaacccttctcgccaaactcggaagtgaacagcggagtgccattgttcagcgtgttccagtcgagcgcatcgttgcccttggaagccgcgaggctgattttctcgccgcccacgccctcgccggtgaagaacgcccacacgtaggcctcgtccttctcttcggcggcaggcatcggctgaatggtgacggtgaaggtcttcgtttcggtggcggtaccgtacttggcaatggctttgagcgtcacagtgacggcatcgctaccggcggcagggcgcttaacagtgaccgttcgagatttgtcgttcacgccttcgcctagtgtggcgatatccttgccaccggtcacttcccacgagatggtcgaaccattgttgcccttggtgggcacggagaagttgctacggatgtcgtcggagtcctcgatggtgacgacgtcaaggtcggccttggcttgctcggcatcggagagctgcttcggcacgaggaccgtgtagtcggcggttttggcgttgttgccaaacgtggcggtgaggatcacctcggcatcagctgcggttgcggccggacgagtgactgtggccttgccggtagcgttgtcaacggcgatggctgcgttgtccgacttccacgcgatgctcacgccagcggcgctggtcggcagcgcgaagtcctcggtagcggatgcgggcacagcggccttgacagcggcctcggccttgtcgagcacctgagcgtcatacagcttggtcacgtctgcggcgctgatggcagtgtcgtatacggcgtaatcgtccacgtcgagcttggagttcgggtcagcgtaggaggacttgccaatgtaggcgacgaggccgccgtaattggtcaggccaccggccggaatggtgtaggtggcgtctccaacctgcttgccgttgaggtagaagctcatggtgctgttggtgccgctgatgacggtggtgtacagagccaaatcgctggtggccttggtgccggtggtggcggcgttcgtcgatccagggccgacttcggtgccccacgggctgttattcgggtcggccgcagtggcattggtcattacggatttcgcgtagccactcgggttggccgggttgagcagccagtagccgttggccggataattgccggtcttggccgcgccgatgtacgcggcggcggtattgccgttgccgtaattgttcttgagccagatggagacggtaacgtccttcttaccggcgatggccgtggtcggcacgctaatggtttgcgagccggtcaggttgatctggccattggccaccgtggcgtcgccggatagggtggcatcgctgttggccgcgctgccctcgttggcgatggtcttggacgtcagtgcgttatcgaatgaatagtggatgatcggactggcatcgattggcgatgcgctctcggcactggccgtcatcggcagcaccagaccagcgagcagtgttgccacgccgaccgtgagtccggttgcctttcgtatcagctttcccatgtttctcctcattgatagggttgattgtggttgcgccttcagttatggagcgaagttttgtggccgccctctgatgagctgagccgtgaagaaaacgccagagtcgtttttaggcgaaggcgaacgacagtgagcaaatatgaagccagctgaaagctggtccttaattgcgttcgaggtggccgccgttaggcagtcgggggagagacctgcggcggcagccgcgggatacagaatcggccgaaggccatgccgttctttcggtggcttcgccgcggtctctcccccagtcagccttcggctgacagccccctcgtcagaggggggcttggttgccgtagcagctcaggcgcgacgcttgcgccagagggttagggagatgccggcgatggcgagtgctaccacggcaccacccaggccgagcacggccgtaccggtattgctcagcgcgctgccgggcttgttgacgttggtcttgtcgccggtggtcggggtagtcggcttattgccgtcgcccttatctccgtcaccttcgcccggattggtcggagccttctgcagggcttcgattgcggtcttaaggtcggctgcggcggtatcgacctcgccctgattctcagcggcgagcgcggccttggcagtcttcagcgcggcggcaagcttggcccaggaatcggccgtgtagtcggattccttgagcgcttcggcggcggcgatctgcttgttgagctcagccaaatcgaccttgccctgttcaatgccgtcaaccgtagtatcggatggattgaccaaaccatcggtgtagccgtcgtaagcaaccgcaacagtgccagagacgctggccgggagggtcacagtggccttgccttcggcgtcgagcttcacggtcttggaccagtcgccagcagagaacttcaccgaaccggcgagcgtgcccttatcggcggaggtcaccgtggcggtgagctcgcgggtgccggcgttgtacacggccttggtggtggagtcaacagcctcgatgtgcgtcgggttggcagcggtccaggacttcgtcaccttgagcacagactcaggcacgttcacgaacgcaccgtgacgcaccttgtccggcagaccgccgttagcaccctgagtgatgtagccctgagcgcccggctcggctttgaccggcttcttttcgttgttgaagtccgggtaacgcttggtcatcgggttgtcccacgtggtcttggaaagctcggcacccgtggtcataaatgcacggtaggcgaagttgtcggacagcagaatgtagccgtcgtcgtccttcgtgttgagttcgtcatccttgttgagcttgatggtctctggtccttcgaacggcagcaacgcctgctcgagcagctgccaaccggtgttcgggtcctgacccggagatgcctcggtggtcggtgcagtcagcaccttggaacgctcaaggaagatgctcttaccagtggtgatgtaatcgccagcggcaccgccctgctcattcttggtgaatcggtagtagtagccaccgatcttacgcacggtggaatcaatgcgcgagtagccggtgtcctgccacatctgcggctcggtgaagttcacgaagtcgcgggtgatggcgtaacgcacctgagcataggagctattgccggttttgtcgttcttgaccggagtggtacgggtgtcatcagtgaacatgcgggaagagaagaacaccacgtaagcgttcaggtcatcatcccagtaagcttccggcgcccaggtcataccggcgttcggcgtgttgatggtgatgccgccgttgccgtcgccgttggtacgggtccagttcatcatatcggtggactcgtagacctcaactttccgagaaccgttaacctggttctggctccagcccattgacgagaccttgagatcagtggcaatcaggtagtacttgtcgccttcgtgggaacgcagcacgaacatgtcacgcaagccacccgtgtctgcatcattggtaagtaccgcctggccattgttgcgagtcttaaacgtgaagaaatcgttcttctcagtggaagccacccaggccttttctccaccgttgctgtcgctctcaaaagtgacggccgcatagccggtgtcaggcgcgatgcgggtcttctccttgacagtgacctcgatggtcttggtgaccttctcaccgccgttgtaggaagcggtggcggtcagcgtaaccggcttggaatcaccgtcgccgtaggccggacgattgatgatgccagcaccacgatacgggtcatcggcaccagtggtcctgttttcgtacttctcgttagtggacgtaatgagcttctcgtccgaggacttccacgtaatcgccgagccgttcttggtgcccttggcgactagcggcagattctcggccgccggaactttcagcgcagcaatcgcggcatcgaggtcggctgcggcggcgttctgggcgttcatcggctcaacggtgacgggcagttcggccttcacaccacccagctcagtggtggcggtgatggtggcagtaccagccttgacgccggttacagtaccgtctgcggcgaccttggccacggactcatcggaggaggaccaggtgacgttcttgctcacggcgtcgtccggagtgacggtggcggtgagcttggtggagtccttctcaatcagggtgagcttgttgttcaccacaccggtaccggaaatcgcaacggcggtcggcatggtcaggtcagcgcccctgtagaccttgatatcatccattgcaccattccagtactcatcgacggagtagaacgacttgccgatgtaggcggtggtcgcaccgagatcgctcatcttgatgccggtgttggccttgaaaatgatcagggcattgttgcggaacacggcaaggttggtgccgtccacgacaatcttgtaatcggcccagctgttgtcgttgccggaaacggtgaccttggatccctgttcgttaccccagttgttgttggagataacgcccttgatggcggtcttgctgttgtagaacatcaggtacttgttggcgttggcctgatcggtggtgttggcgtcgttcgagccgtccttgccgacgatgaacgagaagaacttgccgctgtcgtcgtgacgagtcttggacgcgaactccagagtgaaggagtcgccggcgtccttgaacagctggtcatcgatctgggcgtactggccatcgccgcgcagtgagagcgcctcgttgttgctgcggtcaccgtactgttcgatcttggcaccgtccttcagcgtcaggttgtacttgccggtcgaatcggcaatcgcgctgttcgtggtgccgtttttgcccgtgaagtcccagctggcgagcagcgtcggttcagcagccttagtagtctgcactgtcgcggtatcggttgtctgtggttgggaatcttccgattccatggcatacgtcgtcggaactactgccaccatcgttgatattgcaatcaacgatgctgccatcttcttccaatgcttcaccgcatctctccttgtcctttgcctcgacccacttgtcgggtgtctcgttcgcctctacgtgaacgcaaacattatttgcgatgataccattacggcactgagactcagtgtgccagattccttatgtatataagcacttacagggggcaaccgcccagcccgaacactccccgtatgccaaaagcccccttccaagccaatcactaatacccctcaatcggcaccccgctccgccagccgccccaaactgttatcaatttgttatctttaccgcgcttgcgtggacagagaacgctcagacctcgaagatcgccacatattcgtgagagaacccgcctagtcaatgagatatggattgaaaacacgctcggtaacggggatatggagcatcagcatggtgccgtaaccaaggatcaccagcaggaacagtccaccgggcatgtggaaccagctggccgccagcagtgccacgaacacggcatccacgatgaccagggccacggtcatcgcgatgtgggagatgccgaagatgaaggcgttcttcaaggtgccggccacggtgttctcgaagcgtgcctgaagcgcgaacacccattcgaaaccgataagccagaggatggtcagcgcgaatttgatgatgagcagcggcgtgatctgcaggacgatccatgaccagaccagtgcaatcagcaccaccaagaacggcagccacagcagtgtggctttgatgaagttggctttgaatgacttgaagtagttggcggttacgcctttgccctcgccctcgatggagcggcggcaagcatcatggccggcggtcagggccgcaccgatggtgatgagcggaatcgaagtgaccagcatcagaatgttgatccatacgccgtcaacaagattgctccacgcgcgcatgaatttcgagtccggtgccagccagttcatcaactactcctcgtacagcttttggctcccctcagggaggggagccaaattgtcgggctcaacccttgaccgctccgccttcggccctgcaattacggactcgcctacgacgaggctcatcattagcttcgccgctgtcgcggctcagcctggagcctgctggaagcccactgggcttccagccatgggctgacgacgcgagtcgtcagcccttgacggctcccgccatgacaccagagactatatacttctggcataccaagtagaagacgatgatggggatgatggccagcaccaggcaggccatcatggcgcccatatccacggaaccgtagccgcccttgaggtattgcacggcgaccgagacggtcttgtacttgccgaggtcgagcgtcaggtacggcagcaggtagtcgttccagatccacatggcttcgaggatggccaccgagacgatcgacggcttcataatcggcaccacgatctggaagaagatgcgcggcactgacgcgccgtcgatcatggcggactcctcaagctcctgcgggatgcccttgatcacgccagtgaagatgaacacggccagaccggcaccgaaaccgaggtacacgatgcacaggccccacggggtattgagcttcagcatgtcggcgatcttggagagggtgaacatcaccatctggaacggcacgatcatattgaacaggaacagggtgtagagcagcttcgcggcccagttgttcacgcgcacgatccaccatgcgcacatcgaggtgcacaccagaatcagcgccaccgagccgacggtgataagcagcgtccagccgaaggaggcgaagaactgcgtggtctcgatgccgcgcacatagttctcaagtcccacgaacgccttgccggcaggcagggagaacgcgttcttggagatgtacgccttctgcttgaaggagttgatcagcaccaggacgatcgggaaaatccagaacagggagacaacggcaaacagcacggtccataatgcgccatgcttcacaggcttgttctcgttcatcaggctgccacctccttgctcgtggtgagcttgttctgaatcagggcgatgaccgcgaccaggatgaagaacagcacggccttcgcctggccgacgccttcccagcccatacggccgtagaaggtgcgggtgatgttcagcgccagaccttcagacatgttgctcggcgcaccgttggtcaatgcgaggttctgatcgtagagcttgaaaccgttggtcacggtcaggaaggagcacacggtgatggacggcatcatcagcgggatgatgatgcggaacatggtctgccgtccgttggcgccgtccacggccgcagcctccagcacgtcggtgggcagggcctgcaggccggcgatgtagatgatcatcatgtagccgatctgctgccagcacaccaggatgaccaagccccagaacccgtaggacgccttataggtcagggcgcggccccagtgggccagcacgccgttcaggagcagcagccagatgtagcccaggatgatgccgccgataaggttcggcatgaagaataccgagcggaacagcgtggagcccttgatcgccttggtcagcatgtaggcgatggcgaaggcgatcacgttgatcacgatggtggtcacgatggtgaacgcggtggagaagccgagcgcgtgcaggaattccttgtctttcaacgctttgccatagttcttaagccccacccattcaccgtcggtaacggtggtgaattcgcagaagcttaagtagacgcccatgatgaagggcaccaggaacccgatgatgaatgcggcgaatgtgggaagcgcgaacagcgcccaccatctgcgtatcgccttgccagccatgctgatcatgacttttcctcctccttgagtccgctgcgttgcgacactgcatcgtgcgccggctgcggagttcaactcaatgcgagcttgccgatcgagaaccgcatgcacggcctgttctcgttcaagcctatgttcatagtaaacgtcgaatcattatatgtcaaacgttgtcattttaggcgtttcaagttcgagcatactccggttccagcaatcttctttcacctaagataatggctatataaagccaatctaacgccgacatagacactttgcaaacgtttgtaatacaatcgttgtcatcgccgcagatcaatcaatcagcatgtacactggagtcagttgtgcatgtgtattgcgattttccattcaacgcaagggggctgcaatggctacgagcattcaggatgtcgcccgcgaggccggcgtctccatctccaccgtctcacgttccttcaccaggccggatctggtgtcggccaagacccgcgagcgcgtgctcgccatcgccgacaaactcaatttctcactctcccgctcggctgcggccctgaaatccggccgctccctgcgcatcgcagtactgatgagcggccatatccgcctgtggttcaccgcctcggtcatcgaggggctcaacgaggtgctgcacacgcagggctacgatatttcggtattccagatttccagcatcgaggagcgcaaggaattcttcgagatgttgccggtacgccgtaacgccgatgccgtgattgtggcgtctttcgatatcgacaacaacgaaatcgcgcaactggcttcggtcggcgtgccgatcgtcggcatcaattcagtcgaacccgaagcccgcggctttaccgccgccgtcaatatcgacgatgtgcagggctccacgctggccgcccgccatcttatcaatctcggacatcgccgcatcacctacatcagcaccaatcgcgaggtgtcgctgagcttctccgtgcaaagccgattcgactcattcaccgcctgctgccgcagggaaggcatcgagccgcaggttatcgtctgcaaggtcgatgacgatggacgttatgaaatcagcgacgtggtcaaccaactcataagccaagacgagatgcccaccgccatcgcatgccaagaggacggcattgctttgccgcttatgttccagctggagcgcaatggattctccgtgcccggcgacgtctcgttgatcggctacgacgatagtttctacaccggcgatatcggcctgaccaccatccgccaggatccggtggaaatggcccgcgtggcagcccgcatgacgctcgatctcattgacgaaaagccgattgagcaaccctacatcgtgttcccggcccagctgaaggtccgctcctccacctcccgcgttaagtaggctcacacaacaaagcccaccatagaaaaagtgtgaggcaaccgcacaataacgctcaatcgcacattgtgggaaatggcgaaaaatcgccaatctatggacacacagtgtgtgattgagcgggtgcgtgcctcacacttttttgcggcggacgattttgtgcgagactcagcaatacaaagcggcgcccccggagaaggaaatggcaggggcgccgcggattgttacttatcggctatgggactctatgagactcagtgcgaagcctcgtattcggaagcccaaccgtccacgaaggcggtcttgacggcatcccacttgccggtgccctgcgcgtactcgagcagtgcctggccgaccttgttcttccactcttcggacggcatcatggtgaagttccaagaaacctgggtcttgccggacttctgatcctcaacagcggcttcagtcagcgggttgtcaaacttgacatcatcgaaggtcttgaacggggtggtgaagcccatgtcctgagagatggccttcttgccggtgtcggaggtgatcacccaggagaggaagtcctcggtggccttcttgtcggcgtcggaggccttgtcgttgatgcaccagtagttctcggaaccagtggccaagccctgcttctcttcacccttgacaccggtgtagattggcatcatgcccacggattcggccttcatgccggccttctgcaggtcggtccaagcccaggtgccgttctgatagaaggcagcctcgccgagcgcgaactcggagttcgcatcatcgccggtcttggcgctcagctgggtggggtcggtggtggagtcggtgatgtacaggtcgaagatcttcttgtagttcggcagataagtgcccttgatggtggccggctgctcggtgacgttgtcgtccttgaactcatagtagagcggcaggttggccagatgggtcttgaatcgccagtcggagctggagtcgaagccggcggaggtgaacgcgcccttgatgccaagctcgtccttgcgggactgcatgtcgtcagccacggccttcagggtgtcgaagttgtcgatttcgtccatggacgtggctttggcaccatccagcgcgaagtatttgttaaggatgtccttgttgtagatcaggccgtaggtttccatcacgtacggcacaccgaccaccttgtcgccgtctttcagggccacgtcctggttggtgagttccttatacacatccgtgttggacatgtcggcggtgtacttcttccagttctggtagccgaccgggccgttcacctggaacagggtcggggcctcggtcttggcaatctcggacttcagggtctgctcgtaggtgccggaggccgcggtctggaccttgacatcaacgcccttctccttggtgtactccttggccagagcggcccactgatcagccgcttccggcttgaagttcaggtagtagaccttgcccttggagtcgtcgccggaagtggagcttccacaagcggcaagggttccgagggacattgcagcgatggccgccactgcgaccgctgacttcactgtacgattcatcatcgaacctttctctttcatcgtcgacccggccatccccggtcaggacaggtacgctaacacgcacctttatgactatcgacatgcactattgtgcaacggtttgcttctttttgcaaacgatagcaatatcggcgcgtcataaatcatcattttcaggccattgtcaacaaatatcccattaattcggtcatttttgcctcattatcgcaatgcaagcgttcgcaattatgagagcgctaacatatctttcatggcaatcgattgccacttatacccatcaaaaaaacaacacggcgacgctatcgtttgcaaatcatttatcgacataccgcaattcccaccacaaacaataaaggcccgcccgcagcagcaggcaggccagcgtaatcacagcgcaaccggggctaggcgttccaccgttcgatgacgttatctcccttatagacgctgagcaccgagtagtgcgccgtatccaaacgcagcaaccgcgcgaaatgcgggtccacgcccagccattgcgaggtgaggatgcgcaggatgtgcgcatgagccaccaacagcacattatggccgtctttcagcagcggcgtaatctcatcgatggcgctcttggcgcgtaccgctgcttcttccagcgtctcgccaggcccggcatggaccggcacctgctcgcccgaaggtaaggtctcgacccaatcgccctccagcgtgggcgtcagcgagcgcggcccgtcacgccacacatcccattcaaaaccgctggcctcactcacctgctggcgcgtacgcccctcggctcggccgtaatcccattcagcgatgccgtccaacacaccgtggcccgcaaaaccggccagttcagcggtttggcacgcccgcttcagcggactggaaaacacacagccctggctgaatccttcggggaaagcttcgcgcaggcgccttccggcatccgctgcctgctgctcgccgaccgcagtcaacgggatgttcgtgcgcccggtatgctgcccggattcgctccacacggtctggccgtggcgcagcaacaccaaaaatccgttgccgccacgagagttctcgacggcaacggtgccgttcacgttctgttcgctcatgcctccactctagtctgcgctcgttcatgactccaccattaacgcccatcttttgcgctgagatgattgagatgctattagactgagagtcatgagcgacgaaacgaacaccgacttcccctccagcgccgaccgtgcggtcgacagcctgcaccgcatcgacgagaaggtcaacaggctgcgcgaggaccggctcaacgaccctgattctctgggcgacaagctcatcaagtcggcagtcccagcgctggcaggcttggttgccggcaaagcattccagatgatatgggacaagggcacaagcaaacgcaatctgcgcaagggactggcggcagacgcgccgcaaagtctggcaatgagtctgacattcgccgccgtttcggccgcactcggcgcagtggtttcgcagctgtcggatcggggctccaaggcgttcgtcgaccaccgccatcgcaagcccagccgctaatcccccggttggatgatggtttctgttggctgactgatgactcatcgctggaatttcgtcaaggaaccatcagtcaatcgacaggaaccatcagtccagcacagttccgccacacaatatcggcatttcactgtgaggtaatccaccgtggcgtccggcgtctgccgtgcgacaataaagccatggttaccaacgcaacaatcgaggctcttctgggccgccgctccatccgtaagttcaaggacgaggccatcgacgacgatacccgcgccacgctcgaaaccgtcgcccaacatgccgcgtccagccagttccttaacgactggtccgccatccgtatcaccgacccggccaccaaagccaagctcgccgaattcggccatcagccgtatatcgccaccgcgccgttgctgtacgtgttcgtcatcgacgagcaccgcaacgcacgcatcgccgaacgcaagggtatcgatcccgcttccgacgaattccatctcaagtacagctatcgcttcacccaagctcagaacgacgcagtgctggccctgcacgccatggagaccgccgcctattcgctgggactgggctgcgtgattctcggctctctgctcaacaacatccccggccttatcgacgtgctgaatctgccggaatacacgtatccggtgctgggtctggccatcggcaagcccgatcagaacccgaccgtcaagccgcgcatgccgcgcacgatgcagttcttcgagaacacctacccggctgacgccgatggcgtactcgaccagctgcccgccttcgacgaggaagttcaccggtactacgatctgcgccaagccgaccgtccggtggacgccttcagcgatcaggtcgccacgatcagtcggcaggatgtcagccatcagacactgctcgacaaggccgccgctcagggcttccgtctggatcagtgagaccagaaccaacgagatagcctcggataggctcgtcactgagtcgtctcggtctcagcactgcgacgactcagttccaacacctcaacatttcatcaccggataccggcaaaattgcacaaccatcccgccggtgtcgcaccatcaacaaacgttcacatatcagtcccattatgcggacaaccaacggccagttttgcaagaaaacccgccaaaccagcagtattcgcaccagtggtgggaatagactgcatgtggccgcaatgactacgaaccggaaaagagggactggatgcggacagtttggcaagtctttctacgcgattgcagacgtatcttacgcaatcccgttgccgttgtggtgacgctcggcgtagcaatgctgccctcgctgtacgcatggttcaacattctcgccaactgggatccctattcagccaccggcaatctgcaagtggccgtagccaatgaagaccaaggcaccaccaacgatctggtcggccatctcgatgcgggccggcaggtcgtcaagaaactcaagcagaacgacgaactcggctggcgcttcgtagacaatgaggaacaggccgtccacggcgtggagaccggcggatactatgcagccatcgtgctgcccaaggatttcagcgccagcttggtcgaatcggtgaccggaacctccaaacagccgaaaatcaagtattacgtcaacgagaagaagaacgcgatcgcgccgaaaatcaccgacaccggcgccaccaccatcgatgagcagatcaactccgccttcgtcaccacggtagccaccaccgttgcctcggccgtttccgaagcgggagacgatctcgaccaagtcaccggcaaagtccagcacgatacgatcgatgatctcaatacggtgatgtccacgctgaacaccgttcaggattcactcaccgacttacaggacacgctggcccaatcagacacgattctcgccgacgccaaacagaccaccgcctcactcaagcagaccgtcgcggccgcgcagaatgcctcccgccagtccggcacactgttggcggaaacacaggccgggtcacaagccttctccaccacactggtcggcgcgctcgacagcagttcagcacaactctccggactggccgtccacgtcaacaacgccgccggcagcatcaccggttccttcaacagcgcgcagaactccgtcgacaccatcaccaacacactttcggccccactgaacgccacccaaacgtcaatcagcgatctgaaagacgcgctgaccaaagccggcatcggcaaagacaccaccgacccggtcggccagaacatctggaaacaaatcgatgcgctcgactcattgatcagcaaacagcagacacagctcaacaccttccataccgacaccacacagttcatcaactccggcaaagacgccaccacgaacctttccggagccatgaccaacaccaccaccggcggcatcgcggcgctgaataccgcgcgcggctcgctgaccggcaccgtgatgccgtcgctcacctcatcattgaacagtttcgccgccctgaacggcacgctggatggcacgttgacttcgttgtccggcaccttggatcaggccgacgggctgttcgaccagcttgtcgataccctgaaccaaacaaaaaccaccatcagcagcacgcaggattcgctgcgccaggtggccagcgatgtcgccaccgtacgcaccgatatcgccacgctcgatagttccgccgcttaccagaaaatccgggatacgctgcatctggatgacaagggattcggcgacttcatgggcaatcccgtcaccctgaccacgaaagtcgtgtatgccaccgacaattacgggtccgcagtcaccccgttctacacgaatctggcactgtgggtaggcggtttcgtgctaatcgccatctacaagcttgaggtcgaccgcgagggcattcgccgtatcaccgctacgcaagcatatcttggccgctggctgctgctggtcaccatcggattcctgcaagccgtcatcgccaccatcggcgatctggtgcttggcatccaatgcgagcatccgctgctgttcatcttggccgggatcttctgttcgttcgtatacatcaacattatttacgcactggccgtggcgttccgccatatcggcaaagccatcgccgtaattctggtcattgtgcagatacccggcgcctccggcctgtatccgattgaaatgatgccgaacttcttccgcgaactgcacccgtggctgccctttacctacggcatcaacgcgatgcgcggcccgattgccggcctgtacgcgaaccattactggctcgacatgctgcacctgttctggtatctgccggcggcactcttcgtgggacttgtcatacgccggtatgcgatgaacctgaacgcgctgttcgaccgtcgtttgggagataccgacctgatgatcaccgagcacaacagcatggtgaacgaacaggtgagcttgaactccgtattccgcacggtgtccgacagcaaggaactgcgcgatatcatcgcccatcgcgcgcaccggttcttcgcacggtatccaaagatgatcgttgccggtctggcattgctgaccgtactcccgttcgtattcctggtgctgctgttcgtcacccaagagaaaatcgccatgctgacctcctggattctgtcgattattcttatcgacgcctatctcattgtggttgaatacgcacgcgaaacctacgccatgcagcttggcgtcagtgccatgagtgccgacgagttccgcaatgtgatgctcaacggatatgtgtggcggcgtttccacggccacggacgtcacgaagcggcgatgggcagcaatccggatatcggcgaaaccactgaacgactcacactgttcggcgatcaggccgccgagccgactgcgcacaccgcacagtccggtcagtctgggcagtctgggcagtctgggcagtctgggcaaggaggcgcacgatgaagcttatctggaaaatattcgtacgtgacgtgcgccaagccacccgcaatgtgatcgccgtaatcgtggctatgggattggtgattgtgccggcactgtacgcctggtacaacatcgccgccagctgggacccgtacggcaacaccaaggccttgaaggtcgccgtggcaaacgtggataagggctataagtccggtctgatgccgatcaccatcaacgtcggcgaaaccgtgaccagtacgctcagggccaatcatgaccttgactggcagtttgtggatcgtgctaaggccatcgatggcgtgaactcaggcgaatactatgccgcgctgattattccaaagagcttcagctccgatatgatgacgctgttttcaccgaagatcaagcacgccaagctcgaatactatctcaatgagaaaatcaatccgatcgctccgcatatcaccgaccagggtgctaccaccgtggccacgaccatcgaccagacatttgtgaagaccttggcgagcgtggcgctggatttggtttccaacgtggccgattacgcgcaaagcccgcaaatggagcagtacgtcaacaacgcctccagtcatattgccaccatgtcgtctcgtttgaccggcactgcgtcgcagatggattcctatgccaatctgctcggggccgccaacagcatcattgattccaccgataagctgctgggatcaacaggctcagctgcggccacaaccaaaaaggcgttgaaacagacccgcaacggcgtctccagcctcgacaaggcattgtccggagccaccgatggcgtcggtacggcattgcagcaggccggttcatcctacgacaccattgccaagcaaatcgatgccgcttttgccgatgtgggctcacaatcctcacagatatcaaacaagctaaccgatatgcaatccaaagtggaggctcaggccgacagctttggaaagtatgccgccgctttacgagatctcgccaaacaagcggcttcactgcccgtgggcggagataccgttgccgctcaactgaacgcggctgcagaccaagccacaaaggcgcagcagagcatgcagcaagccgccaccgcgttgggcgatgcggccacgcacatagcaaacggtactgccgatgccgatacagcgcgtcgagatctgaaatcacaaatcgctgccgccaaacaatcgattactcaggcttcagacacgtacaagagcacgctgaaaccgcaactgaacaatctgacctcgtccatggacgaagtgaccacgcaggcaagttccgtaatcgacgggcttgcatcgaccgtaagcagcgtgtcaggtctttctggcggcgtttcagacagcctgacggacatccagtcggccttgactgacgcagctagcgctttgacccgttcggcgaagaaactcgacaacttgtcttcccaactcgcctctatcaccaatggcggcaccatcgacctgtctgcgatttcctctgcgaagcccgatgccattgcttccatgctggcggcacccgtagcggtcgaccgcatcgcgctctatcccgttgccaactatggttccgcgatggctccgttctacacgattttgtctatttgggtcggtgcgatcattctggtcgccatgttgaaagtatcgatttccgaccatgagaaggctcgtatcttagggttgggcaatgatctgccgctcggttcggaagtgggtcttcgcgaggccatgattgccgggcggattgccggaccggccgccgcgttggatgtgctgaagaagccgcgtgccgaggctcccggcaatgcgcggcagttcggtttacgcttgcaccacgaatatttcggccgatacatgattttcggtttccttgctttgctgcaaggtacgctggtgtgcctgggcgatatgttctatctcggcgtgcagtgtgagcatccgattcagttcttgatggtcgggtggttgtctgcactggtgttctcgaatattgtgtatacgctgaccctgtcgttcggtgatatcggcaaagccattgccgtagtactgctggttatgcaggtagccggttccggcggcacattccccattgaaacactgccgacgttcttccaggtcgtttctaaatggctactgttcccctatgcggtggatgcgatgcattcggccatggcaggctcattcggcatggaatactgggtttccatgggcaaactggcactgttccttgtcccctcattgctgttgggacttatgttgcgcaagccggtaattcgcttcaacgattgggttatccgcaaccttgaaaacaccaaggtgatgtaagtgttggacgaagtgtgtccgagcgccctgaacgcttagcagcctacgacctgacgtgtttggaccgtaacctgtctcagacacggcgttggcgaggtctgtggagcttctgacgctaacgtctacgtggcttgtagccctttttacgactgtgtggcttgagttgctggttcagcggtacatgccggtaactggattgcggatcgcgatgcgtgagatgccagcatccgcaaaattcgcaacggtacacccatagctcaactccgcgctcgattaggctttgatcagcggcacgctgaacctgcgccttatcgtgatacatgattttattcgacgtagcgcaacgtttaggggtgaagtaatgcatagcagaagccagtgtagagcgaccccataaccaagccagttggcagattctagtggtggttgcaacacctgaggtttgagcggccttccatggtcacgttgtcggttgttgaggttatcacgcggcgtcgagcagttcgatgatcttctcgcttggtttcatgaacccgagggttttgcgtggccggtcgttgagttcctcggcgaccgcgtcgaggtagtcctccgggtagacggataggtcggtgcctttggggaagtactggcgcaggagcccgttggtgttctcgttggtgccgcgctgccacggggagtgcgggtcgcagaagtagacggccatgtccagcgaggcgccgatccgtttgtgcagggcgagttccgctccctggtcccaggtcaggctgttgcgcaggagtttgggcaggtgctgcatcttgtcgatgatgtgttttgcttcaatgtttgttcgacaggttcggcagtgtttttccgtagtgtgggctgatggttttccccggtgtcgtcatcgtttcccggtgatgtgataggcatcggtgccgccgcctgtatattcccgagttgccaatcggttttgattcggccggttgccgccggccggcgctcgggaaggaaaggaacatggcgataccgatgcccattgtgcaagatatcaggagactcgaccggcagggaatgtcgcgcgcgcagatagcgcggcgtcttcacgtggatcgcgggacggtcgcgaagtacgcggatatggaggattgctcgcccaagccgaaggcggatcgcaggtacgggtcgaagatcgacccgtacgcgcatctggtggacgagtggctggaggccgatcgtctgctgcccaggaagcagcggcacacgatcaggcgcgtgcacgaccgtctgctggcggagacggattacgacggcgagtattcgaccacgatgcgttacgtgcaccggtggcgcgaggcgaaccgcggcgtgccggatcgcgaggggtacgtgcggctcgagtgggcggcgggcagcatgcaggtcgatttcggcgtggcccgggcccggatcgctggcgagatggcggacgtgcattgcctggtggtctcgttgccgtattcgaacatgcggttgtgcgtggcgttgccgggcgagaacgcggagtgtctgtgccatggcctgatgctcgtgttcgagcatatcgggggtgttcctcccgtgatcgtgatggacaacgcgaccggtgccggccggcgcaacgcgaagggcgaggtcgcgttgaccggggtgttctccgcgttcgtggcgcattaccggctcgaggtccggttctgcaacccgtattcgggcaacgagaagggcagcgtggagaacgcggtcgggtttttgcggcgcaatctcatggtgccgcccatgcgcgcggaatcgtatgggcagttgagccgtctcctgctggagcggtgcgacgggctcgccagggactcgtattgcccgaggttgctggacgtgcccgtggccgaggtgttcgacgaggagagggccgcgttgatgccgttgccgtccacggcgttcgacccggttcgctgggaaagccggacggccgacaagtacgggctggtcgacatcgactcgaaccggtacctcgccggccccgattcggcgcgttccagggtattggccgcgatccggtgggacacggtcacgctcacctcgcccgccaccggcgagctcttcgcggagtatcccagacagtacggacggtcgcgcaatgtggaggatcccgcgctcgtgcttccccggctcgcggtcaaaccccgcgcgtggcgggaaagctcgatccgcccggacgtgcccgacgatatacgcgcgtggcttgattccatggacgaaaagacgttgagggagagcctcaaagcgatcggggacgcgtgccgggcggccgggttcgatcccgcgatgcaggcgtgcggcgagatcctgcgctcgaacagggacatgggcctgcacgcggactcgctcacccctatcgcgttgcgcatgcgcgacggcgagtgggaataccccggcgggatcgaggagcccgacctgagcggctacgaccggttcatcaccggcacggacgacggaggggaagaacggtgagcgtcagacccgatccggtgatcccggagacccgccgccgtcgcgcgtccacgaccgagaagagcgagaggatcctgaagatgagccgcagcctgaccctgacacgcagcgtgctcgcgggcacgctcgccgaggccacgcccaaccagctcgacttcatcgaacgatggttcacggccgaactcgactcgcgcgagcgatccaaacgcctgcgcctgctcaaacaggccggcttccccgccgacaagaccctcgacggctatgactggaccaacctgaagatgcccgccgactgggggcgcgcgcagctcgagaacctcgacttcgtcgccggatgcgaggacctcgtgctctacgggcccgtcggcaccggcaagagccacctggccatcgcgatcggacggctcgcctgcgagcggggcgtcccggtgcgcttcttcaccgcgaccggactgctcatgcgtctgcgccgcgcccagcaggagaaccggctcgaccgggaactcgcgagcatcggcaaggcccgacttctcatcatcgacgagttcggctacctgcccatagacgaggagggcagcaggctcctcttccagatcatttccgattcctacgagacaaggagcatcatctacaccaccaacatcgaattcagcggatggggacgcgtgctcggcgacaagaacatggccgccgccctcatcgaccgcaccgtccaccacggacggctcatcagattcgagggccgctcctaccgaagcgaacacgccctcatgaccaaataaccaacacaacgcagacaggcagcggccgataccgcacaccctgcggaaaacccgctgcctacactgcggaaaaacaccgctcacaaagcggacgccaacttgctaaaacacagatgatggcctgctggacgtgttcggcgtcgtgcccgtcgggcaggtgcagcaggatcgtgaacctggtggtgcgctcgacgagcgtgccgatggcgcttttgttgcggctgccggtgatgagatcgccctcccagtggcccgggaccgcccggtcctcgatctccgggggtcgctccgagatcatggccatgggttcgcggaaacggggtttgcggccttggccgccttggggtctgcgggcggttcgcccctgcctcatggcgcgtttcagctcctgcttgagttcgcccctggcctgcaggtagatggcctggtagatcgtctcgacgctcgcgtgcatatccccattatccgggaagtccagcctcagccggttggctatctgctccgggctccaatgcctgcgcaacccggcggcgatctcgtcccacagtcgcgtgccctcggccgccttgcgcggtttggggcgtttgagccggtccgcggccttctgctgggcgcggtaaggctcgtaaccgccggactcgggattcctgttgcgctcgacctcgcggctgaccgtgccggggtcgcggcccagcaggcgggcgatggcgcggatcgaatcgcccagacgcagacggtccgcgatctggatgcgctcctcctggctcaggtagcgcggatggagggtcttgggtttgtccatggtggaacgataccagtccaccaggggtttctcgttccttcccgtggcgcgcgtcctgccgttgcgccacgccttgccggtgcgtttcgagacgccgaccgcgtgcgcggcctgggtgaagttcatgccttcctcgtccagcaggcgcacgtactcggcgcgtctcgcctcgcacatcagcttcctcgtcggatattcgacgccgttgaacgtccaacggtgttccccgccacggtcttcgtttcggtggcttctggtcacctgaccctccttgcggtaggtcaggtgttgcaacgatcactagaacccaccgtttctggctcccctcaggggggggagccgtccgcacagcagaccgggggaggaggcccgggcgtcgggattccacggtcacggacgtgctgttttccggatttcctgcggaaatgggaacgcgccgcgccgtctctcttcggccccgacggcggggccggccgggaatggtcccggacgtgggtctcatgagtgcgagaagccccgggtgtttttgtggggtgtgtgggtttgggtcgtgagtgtttcgggtatgcgaaagccccttggggcgtgtgctccaaggggcttcctgtacgtgtggtgcggcggcgtgctactctcccacaccctgtcgggtgcagtaccatcgccgtgccaggccttagcttccgggttcggaatgggaccgggcgtctcacctgggccatggccgccgcaaatcttctcttatacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccaaccgccaggggttggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctacccctggtctgtgccaccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatcccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtacccccggccgaagccggtaccgacccatgacggtcggtgggttccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaactcttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccggcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacggggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactctcgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggaacatccggcattaccacccgtttccaggagctattccggtgtatggggcaggtcggtcacgcattactcacccgttcgccactctcaccaccaagcaagcttgatggatcccgttcgacttgcatgtgttaagcacgccgccagcgttcatcctgagccagaatcgaaccctccacaaaaaaacttcatgaaaagcatccgaatagatgactctcaaaacaaaaaattgacgagcacgtccttaaggaaggacgccctcaaaaaacctcacccctcatcaaaccctcccgggtacccaaccaccacgacaggcaatcaggcgaggaatgaactggcaatcattgactataaagaagtagtacaaacacgctcttgagttctcaaaccaccaccactcacccacctcgcagctccccggaggagaaccactcgctgagcggcagcaaggaaataacttacacgcattcacggactcgcgcaaatcgggcgcacgaagataagcccaaatcgttgaaacgacaggcttcgctcggcgtgtcgaaatcgacgtttcgcacgtctatatcttcagtctagaactagatatcgtcgaaaattggattgaaaattttggtcgatgggcgtgtcgcgaattacctcttacggcgcatgtggtgcaccgccaattatcggaatcatcattgatccagtacaccgataagaaccattatgttcggattactatatgctcgccagtcgtgcgccaatcaaccgcctggtagcgatgcggttgccgtatcgcttgccttggcacgaccaacgaccgaatggcatcagcacattcagaaccgccggtccgatccatgcatcgcagcacagatcagtcgtggtcccacgggtatggggaggccccgttgccgtgtgggtgccggaggtgtcctgtttgtgtccgggcatgcgagaagccccgggtgtttttgtggggtgtgtgggtttgggtcgtgagtgtttcgggtatgcgaaagccccttggggcgtgtgctccaaggggcttcctgtacgtgtggtgcggcggcgtgctactctcccacaccctgtcgggtgcagtaccatcgccgtgccaggccttagcttccgggttcggaatgggaccgggcgtctcacctgggccatggccgccgcaaatcttctcttatacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccaaccgccaggggttggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatccccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtaccccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaactcttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccggcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacggggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactctcgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggaacatccggcattaccacccgtttccaggagctattccggtgtatggggcaggtcggtcacgcattactcacccgttcgccactctcaccaccaagcaagcttgatggatcccgttcgacttgcatgtgttaagcacgccgccagcgttcatcctgagccagaatcgaaccctccacaaaaaaacttcatgaaaagcatccgaatagatgactctcaaaacaaaaaattgacgagcacgtccttaaggaaggacgccctcaaaaaacctcacccctcatcaaaccctcccgggtacccaaccaccacgacaggcaatcaggcgaggaatgaactggcaatcattgactataaagaagtagtacaaacacgctcttgagttctcaaaccaccaccacaccagccagacgggaaaccaaccagaggaaggaacccgccgcgctgagcggcaacaggtgaataacttacacgcatgtccggattcacgcaaatcaaggcgcacaaaaaccccaggaatcggcataacagcgcggttccctcggcgtgtcgcacagagcccactttgctctgatgaggctaggttaacccctcaaatgtttctgaaaagcatcaaatccactattcggctggcgtgtcgcgagagttttcagcttgtcggccctgcgttcatctctcggcaaccacactgccggcgcacaatcggcgcatgacagcgctccgtcatcggatttcgttcatgaatcgcgggtatacctgtagttatgaccaagaagattgctgtattaaccggggcgggcatttccacgtccgccggcatccctgatttccgcggtccggacggtgtgtggaccaagcatcctgaccaaatgagcgtttacgacatcgatctgttcctgcgcaacaaagaggaccgcgagtactcctggcgctggcaaaaggaatcgccagtatggaatgcgcagcccggcactgcgcataaggcgctggtcaagctggaacaagccggcatgctgacgctgctggccacgcagaacttcgatgcgctgcatgagaaggccggcaacagcgacaacgtcatcgtgaacctgcacggcactatcggcacctcgcattgcatgaagtgtcatcaggaatatgccacggcggacatcatggcccgtttggatgaagagcccgacccacattgccatcgcaaactgaagtatcgtggcgatatgccgtgcaatggcattatcaaaaccgatgtggtgtatttcggtgaggcgttgccggacggcgcgatggagaagtcgtacagtctggccaccaaagccgacgaactatgggtaatcggatcgacccttgaggtgtacccggcggcgagcattgtgccggtggccgcgcaggcgggcgtgcccatcaccattatgaatatgggtcacacgcaatatgaccatcttgcgagccgcttgattcatgaggatatcgccgttgccctgccgaagttggtggacgagacgattgcggagaacaagtagccctcagcataacgaaagcgccggtgggtgggttaagcaactgatgattgtcggttaaccacccaccggcgcttttgcgccacctcccgccagcgggaggtattggagcacacttctgcgcggcttcccgccagcggtattggaatcagtagatgcgcttgggctggaatccggcttccctgagtgccgcgaggatgcggtcgatgtgctcggggccgttggtctcgaccgtgacgccgagagacaccgcgttggtgtagtggccggatgccttgaactggtcgtgatcaagctgaatgacgttggcgcgctgctcggcaagcagggtggccaccttgacgagctggcccggagtatccggcagctcgacctcgaagttcatgatgcggccgcgggcgatcatacctttctgaatcaccgcacccatggtcacggtgtcgatattgccgccggacataatcggaaccaccacgtgcgggccggtggcggcggcgaacttgcgcgaacgcaggttcaggtgttccagcgcagccagcgaaacggcgccggccgcctcgaccaccagcttatgcttctcgagcatgagcagaatcatttcgttgatgtcgcgctcggtgacggtgaccagatcgtccaggaactcgttaatcagagcgaagggcaggtcgccggggtgcttgaccgcaacaccttcggcggaggtaaccacatggtcagccggagacacacgacccgcggccagcgagtccttccaggccggtgagccctccggaatcgcaccgattacgcgcacttcaggcttgaatgtcttgatggcgagcgccacgccggcacccaggccaccaccaccgagcggcacgaccacgtcagtgacgttcggcacgtcttcaaggatctccagaccgatggtgccttggccgcagatgacttcgtaatcgtcgaatggcggcacgtaaatcatgccttccttgtcggcgagctcagcagcgtgggcggcggattcatcgaacacatcgccgtacagcaccacgtcggcaccgtaggccttggtggcatcgaccttcagcggcggggtgatctgcggcatgcagatggtggccttggctccacgctcgcgggccgcataggccacaccctgggcatggttgccggcagacgcggtgacgatgccgtgagcgatctgctcttcggtgagcgaagcaatcttgttataggcaccgcggatcttgaaggatccggtgacctgcaggttttccggcttcaggagaatctcatggccggtcatctcgctcagcaccggagaaggaatgatctccgtgtggcgggcagtgcctttgagtcgttcggcggccagcttcagttcggctgcatgatcacgttgcagcgccttcaaaacatccttttgttccatagctttccattgtaagcaccacaatgccgagagacaccagctatctcgcttcacagaggtacattcggccttttgcagacagctatctgttttcataggggtaccgagaagcaaaaaccccgggtataagccttgattttcaatgcttatacctggggtttcgacgttacggtacctctctcaagacagatagcatttcgggatagccccgaagtacctctttgagcggagaaaggcactcaatgcactacaactggatgacggctgcctcccacgggtcgagctcgcggttggcaagggaggccacggtgtgcggagcgtcatacgtgctgatcaccacattcggctcggcgattccgacggcggctagttcggcagcctcacgtggcaggtcaacggttcgactggacatattgactacgaccaacaacttctcagcgtcgagctcacgggtaaaggcatagacgtgcggatcagcggcgtcaatcagtcgccagtcgccggcggccacgaccgggctgttgtgacgcagcgcaacgagttgcttgtagaaggagtacaccgaatccggatcatcgaattcaccggcggcgttgatctcggcatgattcggattcacggaaatccatggctcagtggcggcgtccggagcggtgaaaccggcgtagccggaaccgtcccattgcatcggagtacgcgcgttgtcacggctgcgcgcggccagaccggccatcattgactcagacgactgcaccttggcctcctcgaccctctgccggtaggcattcaaggattcaaggtcacggtactggtcgagacgcgtgaagtgggcgtcggtcatgcccagttcctcaccctgatagatgtacggggtgccgcggtgcatgtgcagcatcaggccaagtgccttggccgaacggacgcgggattcctccgcggagtcgtcgccccagcgggagaccacgcgcggctgatcatgattgccggtgaacaagctggcccatcctgcgttctgcacggcagtctggtaaccggccataatgctcttgaatttcggcaggtcaagcggcagcggcttccacttggtaccttcgcaatcaaaatcaacatgctcgaacaggaagagcatgtccaattcaccgttgcccggatcagtgatgtgctcgttacgctgagccgtgacgcctggcgcctcgcccacagtcaggaagccttcacgcccctcgaatacctcacgtcgcatttcagccaggaattcatcctgacgggggccgtccgcacagaacggattcgggttggaatagccctcctcgcccacaggaagatcctcaagctccgagccgtactcgcccggcagcttgccgttcgaatcggtgcgcttggagatcagggtgatgacgtccatgcggaagccgtcgacgcctcggtcaagccaccagttcatcatgtcgtacacagcgcggcgcacggcagggttctcccagttgaggtccggctgcttcttcgagaactgatgcaggaagtattcgccacgctcggggcagtattcccatgcggagccgccaaagtaggagccccactgattgggctcggcgccgggctcgccgggcgtggtgccgggacgagccggacgccaccaataccagtcggcgtgttcgtcgtctttgttcttggatgcttcaaaccaggcgtgttcatcggaagtgtgattgacaacaagatccatcacgatcttgagcccacgcttgtgggcctcggccagcagctcgtccatatcgtcgagcgtgccgaacagaggatcaatgtcctgatagtcggaaatgtcatagccgttgtcgtcttgcggagacttatagaccggggatagccacagcacatccacgccaagatcagctaagtaatcaagacgcgacgtgatgcccttaagatcgccgaatccatcgccgttcgtgtcttggaaagagcgcgggtaaatctgatagaccaccgcgttggaccaccacggattggggtggcgccgttggtgcggatggcgtcggggattattgcgcggttgaaagtagtcatcattggctccttattgatatctatattgctcgttgctcacagtctaaaaattggcgaattacattcccattggagaactgcgttggtgtgccggaaaataaatatcaatcggcatatgcgctttcatgattgcacccggaaaacacgcagtcggccgtactcgatctcgcaagtatgggtttctcccggattcatatcaatcgtcgcaccatggtcatcgatgatgcggcaagagcgaccgctagccgtaataatgccgatttgtggctgccggcgcaatccgacgaaagcgatgacctgttctgcgccgaatcttgctgtgacaccgagcgcatagtccgtatgttcggggtcattgagcagtgacgcaatgactggtcgggccggctcatcaggacgcggtaatgtaccatcttcggcaagtaaatcacgcaagacagccgcatcagtgtgaccgcaggcatcggaacaatacactggtccgccgctaagcaatcggagcacggcatggactcgcgcatggggatgctccgtccagaacatgtcccaatcacagtggtacagctcccccatcagcagtgcacagtatgcgttctggataaggtgttcgcccagcgaatcaggattgtgcggtagatagtcgtcgctactacgggtgattggcgatgaaggacgatgccaataatcctccggtgccatgcccatgcagttaatcaatgcgccgccgaatcgtcgtgaggtcacttcatcaagcgcctgatggcgtccccaggtggcttcaccgtaactttcggtgccacgaaccattactgacgtggaactttgcgaatccactttgacgaaatcgacgccggcttcggcgagttcgccgtcccaggcatcccagaactgtgcgggttgttcagcacgacttccaggaatcaggcaaccattcgccgtggtggttattgcggtcgggcagctggccgcggctacacccgattcgtccaaaccattccaatagccttggaacgcctgccacacgcctacgctgcgcacgccatagtgcgttttgagcagcgcaatggtgtgggcaagcccgtgggggaaacgttggcgatccgcgccaaagtcgatcagggtttcctttgtgcgatccgtgttggaccaaccgtcatcgataagcacccaggaaatgggcacatgcttggcttggaactcctccatcttgttgacgatagcctgctcgttgacatctcgccccaatgaatcccaagtacaccatcccaacccggtgagcgcatccgggaatggacgctccttacgggtgcgaatacccagctggcgtgctgccgtttgtgtggcagctcgaatggccatatacgggtcggatgcgcaagcgatatatgcggcagtgtcacatagagtcgtgcgaccaacccggttggaagacagcacgagccgcaaagccgtgtcatcagattctgttgcgggctgcccactgaaatcagcccgaatatccgtgccgcagatagcgaccaacactagccactcggcatcttcggcatcgttgttgcggcgtaacaataactgcgtgcgttcaggcagttcagatggtgtacgcacccaggtcgggcgcatccaccactccttgtgctggtatagcgccagcatggtgtcatcgttgccgctgtcgacgccggccatggtgagcgacacgtcaatcgcatggtggggctcaaacgcttgttgttcctgaaaggcagcggcgcggtccttgggctggggtgcatgcgcgttcacatcgatacgccagagtcgcacctgagcatcaccctggatacccgcactggacgtgcactcgtcttcgcatgattcgggaacgattgtgacggcttctaccggcagttcacagattgccgaagcctgttcgccatagacggcacgaccggtatcaagatgggccgttaccgtgcgaacggttattggacaggtttcggcaatcattggcgtaactccttggtgttcttcaatgagattatgctggcaaggcccagacggtagcagctggaggaacgctctcgacctgagtgttcgcctgcacagtcgcgtcagacacaagtagcacggtcatcggctgcggcaaggcgactggttgactgtcagagaagttcgccatcacaaccatgccggacggcaagcgccaaccaagcagcggcgccggacactcttcgttggtaagccacgagaactggaagtccgtgccgttggccacccactgtttgcgcaatgcgacagcagcacaatacaggtgcaggacggaagccccgtcaccaatctgacgattagtggcatactgcgcaaaccatgccggctggggcagccacgaagcaccggtggcattgaagccgaacgccgggccgtctgactgccacggcagcggtacgcggcaaccgtcgcgccccttgaaataatgaccggaacgttcccaattgggatcctgaatttcatcttcggtcaaatcaaagtcctccggcaaaccaagctcttcaccctgatacacaaaggcggtacctggcaggccgagcatcaccagcgctgctgcacgggcacgacgagcggcgagcgcggggtcaatcggcggattcgtgccgttggacgtcacccactgctcgatgtttgcaccgctcggcagtccgagacgcgaggcgatacgtggcacatcgtggttgccgagcacccaggtggggcggtttcggcagcgagagcatagcgatgcgtgcgctcaatcgtggtgcggtattcttcgcgattccaggcggcctttgacatggagaagtcgaatacggcaccaagttcatcaggcttggcgtattggaaaatacgggtggtgaatggcgaccacgattcgccgaccgcatacttggctggcgtgtactgattgaacaggtcgcgccattcacggtagatatcatgcacggcgtcgcggtcccagagcggatcggagccatcggtagcctgtggagacatcagtgtcgggtcgatacggtcgcgcagcggctcacgcaggtctttggccagaccgtgcgagacatcgatgcggaaaccgtccacaccgcgatcgcaccagaatgtgagtacacgcaggaactcatgccgcacctcgggattgtcccaattgaggtccggctgctccttggcgaacagatgcaggtagtaccagccgtctccacacgactcccatgcggaaccgccgaagttactcagccagttggtaggcggcaattcgccgtgctcccccttgccctgccggaacacataccgttgtgccgcttccgattccggaccttgagccagggcctcttggaaccaacggtgctgatcggacgtgtggttcggcacgatgtccacgatgatgccgataccgcgttcgtgcgctttggccactaattcgtcgaactgatcgagtgtgccaaggcggggatccacatcacaatagtcggcaacatcataacctccatccgccagcggcgatggatagaatggagaaagccagagcgcgtccaccccgagcgcctgcagatagtcgagacgatcgatcacgccttggagatcaccgttgccgtctccattggcatcgctgaatgagcgggggtaaatctggtagatgacggcgtcgcgccaccagtcattgttggtgaaagtcatatcgttcccctgtccgattgctcggtacgtatggttttaccagtatggccgcacgaaacactgttccggcggccataccctacatcctcttgccttcggatcagcccttaaccgagccggcaagcatggcgcggatgaagtagcgctggaggaagatgaacaggatcatcgtcggtgccatgatgagcagtgcgcccgcgttgagcagcaccacgtcggtctgatactggccaacgaacgactgtagggcacctgccatcgtgcgcttgttcgggtcgttctccaacaccacagccaacaggaactggttccaggtggccaggaaggtcagaataccgagcgaggagatggctggcagtgccaacggcagctgaatggaacggaacgtgcgcagatggcctgcaccatcgatggatgcggcttcgatcagatcacgcggcatctgctcgaagcaggagcgcatccacacaataccgaacggaatattcaggccgatgagcggcaggatcagggcaagacgggtattcagcaagcccatgccactgatctcgtagtacagcggagtgaccaaggtttcgaacggaatggtcagaccgacgaggaacagcacgtagatcaggcccttgcacggcaccttgagctgagcgaaggcataaccgccgagcgagcagaagatcaccacgcagggcacgaccacgatcaccagaatgcagctgttgagcagcagcggggtgatgtttgccatgttccaggcgtcgatgaagttctcccagtgcgggtgggcagtgaactggataccttcgggcatggaaccttgcggctgcaatgccgcggagagcatgctcaggaacggcagtacgcagaagaggacggtcagagcgagcatcgccgtgccggtgatgcgaacggctttggattgctgcatggtcactgctcctttccgttgaccagacgctgcagaggtccgacgaccagcagcacgagaatcatcagggtgacggcgagtgcggaggccaagccaacgctctgctgggtgaaggccaagcggtagacctgcacgccgggcaccatggtggaggtgccggggccgccctgagtggacatgtacaccacgtcgaagctggcgagcgcggagatgatggtcatggtcaggcatacgccgatttggccgcgcagaccgggcaacgtgatggagaagagctgacgccaccagccggcaccgtcaagacttgctgcctcgtacagggactggtcgatgccgccgatgcccgagagcaagagcaccacacagaagccgagctgcagccagaaaccaatcacgcctaccgcgttcagggaggtggattggtcgccgagccacacgtgggcgaagtcgccgaggcctactgcgcgcagcagctgattggcggtgcccttgtcggccagcatccaggtccaggccacaccggctgcagcgcctgggataacgcgcggcaggaacaggcaaacctgcgcgaaggaacgaccgaccttggacttcatgtctttgatgagcacggcaatgatcaggccgagcacaatcgggatgatggagaagaagatgatcaggtagaaggagtgcagaatcgatccgtacagatcggggtcggtgaacacggtgatgtagttttcgacaccgatgaaggtgctagcatcgataccgttccactcgtagaacgagtaccagatggtctgaatgatcggccacaactcgaaggcgatgtagaacacaagcgccggagcgaggaaaagcaggctgaccagaccgagggacatattgcgcttgggcttgaccgccttggctgccttatgggaatccatgattgtcaccacgctttgctggtttggtgtgaactgggaatcgaacatcgcacacaacgtcgtgcgcgcgatgggaaggaaccaggcggagcgggaaaaagggaagaacactccgcccggtaagtgcaagggttacttgacctccttctcgtactgagcctgaatggattcgacgaatgccttggggtcatcgtgccgtcaatcagggactggaagccggggataatggcgctggcctgcatacctgcggtggcgttgttgatgtagtcggtggtgttaccggtcttcaccagaccttcgtaggcggtaaggacctggccgagaagctggttatcggtgctcggagtctcgccttcgccgaccggcgggtagccgttgtcaactgcgatctggcgggcttcgtcggactggaggaagtcgaggaaggcggctgcagcgttcttgttcttggcgttggccgggataccgaaagcggtcacggcgttggctgcggcagaaccggaatcggccttttcgccggggaaggcgatccagccggcgtcatcgccaagtgcatcgttgatggaggcggagtaccagctgccggaggggaagaacagggcttcgccgttgcagaagcggctcagtgcagtggaaccgtcaagggcgagcgcgtcggaggagaagtaaccggcatcctgccagtccttgatcttctgtgcagccttcacggcaccgtcggtgttgaaggtggcgccatccttctggataatccaatcctgcacggtatcgcgaccctcatagttggtgagcaatgcctggtagatgtaggaagtgccgccttccttggccggcatcatcatggcgagcttgccagcgtcggaggccttcttcatatcggcctcgagctcttcgacagtggccggagcctcggtgatgccgagttccttggcgactttcttgttccagtacaggccggtcatcgagacaccgtccggcactgcgtagaggctgccggaaccgatcttaccgtcggagcccacgcggtagacctgagtctgggaatccggcagcttccaaccgtaagcatcggcgtaagcgtcaagattgacgacatggttgccacgcacagcggagttgatgtcggtgatacgggcaatgtccggggtgtcggcggcggagatgatgcgcgggccattctgctgggaggtgttgtccggatcgtaggtggccttgatggtgatgttcgggtacttcttctggaaggcttcgatcagctggtcatcaaaggtcttcaggccagcgccgtcccacagcttgagctcatacttggtatcgccaagatcagtgctcaccgcttcggtttcggtgttggctttgttgctggacgagcccgggccgcaagcggcgacggatgccaggcatgccacagacatcagaccggcaataacggttttggcggttcgttcgatcctcattgatcattcctttcttccttccgggcgatcccggctatgtcttccttggctatctcggcttagcgtatttgctaagcgcttatgcatgaggataacagatgtcgaaccggttcgtcaaatccgcaacacgcaaacaaatggccgattcccgaagaaatgaggaaggcttgacgttccccataggcaagcacttccttctcgcgaaattgcaacatcggtcccttaaatacctaagcgcttattcattcacctaggatgacgtttcgaaggctcgggcagctcgggaaaaattgaatgtggctcaatttgataccagtacgccacgctagacacatcatcctgacgctcaaatgcaccttcatatcctgaaccaatttgttgaagcgtgactctaagctcactatcaaacctgatgggatcaggaatatgccatcggtacaagccacgcataggtggacaataatcgtcatgatattggtttgctatagccccatcgcgcacagaataaaatggatatcctacatatggggcacaaaaagtacgctcgcgcgtatgaccatctcgctgctcagcgaagctccatgcaccgccaaaataatcttcggtgccggtactacacactgtgggataatcgttatcgccatctaggaaaaacttaatctctccctcaccccaccaatatcgttgcaacgtagaaatagcaagatatgtgccgacgtaatggccccgtccgctgactccatcgaggattacatagtcctcgcctaaagtagtgattggctgtctgcgccattgcgcatggaaataagccatttcacgggaggaatacgcattacccaatgcataatcaatctgataaaacaaagccggaatagcatgagcgtggtcattgcgcactacgatacgtgcccgtttacgaaacggcatcgtgaaataacaattcatacctcgtgtaggtgccaccacaataggctctgagaacacatcgcaactttgtccaaagccgcaacagaagaagtctcctaggggacattccacagaaggtcgcttttcatcatcccaatagatggcaagcaccgcatcgcgcagaacgtatcgatcagcgtcactggtgcgatccgtaacggtaaaccacatgtgccgaatacaaccggggccttcaatatctgccaatgtcacagactgcccgggagcaatgtcattcaaacacggctttcccttgcgcgacggccccaacggaccagtttcacggcaaccaaaacccttggctcccgttgggttctccgcattaatcgaacatgttacttcgtcgcggacagtcggcaaatccgataaagttcccgcgtacggtcctgccatcatcataggttgactctcctcaaatcaagcgtcgctagcgaaagcggcatataagttgaagctgtttctaccgcttcgcttctttgtcatattgcgcctgcacattctttgtgaattcctgaggcgtgatgctgttatccagcagtaactggaagttagggattagcccacttgactgcattcccgcagtagcattattaatgaaatcgctagtatgaccgctcgtcagcacgtcggcataggcatcaaacatactctgctgcaatgcgctattcgccttgagatccaaagtagatgattttggcaaatagccagaattgtcaacaataatctgttgcgcttcggcactttgcgtataatcgaggaacgccgcagcagcatcacggttcttagcattcaccggaataccataaaatgcacctgcattagcagcaacgttcggctcatcttcactggtggcacccgggaaagcaaagaactgaacatcatcacccagcgctttggccacagtatccagattccaattaccgctcgggaaaaatagtccttcaccattgcagaacctgctcagagcagtagaggcatccactgcgttaacaccttcaggcatatatcccttgttattccaatcctgcaaggtggacgcagcgtcctgcgccgcctgattgtcgaaggtaccagatttctgcaaaatccaattctgcacatcttccgcagaactgttattagccattaacgcctgaaagacaaaagaggtaccgccatccttggcatatgtcatcatcggcagtatgccggcatccttggctgtctgcatatccgcctcaaactcctcgacagaggtaggagctgcatcaatacctagctgctcggcaagcttggtattgaaataaatgccagtcaccgaataggagttcggcaatgcgtacaaatcaccgctgccgagcttgccatttgaatccactcgatacaattcagtctgcgaatcgggaacatcccagccgtacgcatccacatatgcctctaaagacaccaaatggttgccacgaaccgctgaattcatgtcggtgacgcgggcgatatccggcgcatcttttgctgaaatcacacgcgggccattttgtccagagacattatccggatcatattgtcccgtgatggtgatgtttgggtatttcgcttcgaacccggcaatcagcgcctcatctacagccttcagacccgctccatcccacaaagtcagctcatattttttattacctaaatcagtgctgacctcagtaggatttgtatcacttcgtgagctacttgccgagccgggaccacatgcagtcagacttccagcgataaatatcgcagcaagcgccgcgccgctgttacgcataatcctattcatcggttacctccttgcatcctcatcatatgcaatcgatatttctctttactgtcaccatttttcggcggcaataaaatatatttgcgatatcgattacgcacatcgtacatctttttgcggaacccgtcaaccttgcatcacaccaatggtggccttaacttcaaaatccagatacaatacaatcgattacgcaatgcaggagatcccatgagcgaaccaacaatctatgaagtagccaaggaggctggagtctctgcggcgaccgtatctcgtgcaatcaacggacgtgaccgcatatcggaaactactaggcaaaaggtatttgatgcatgtgcaaagttggggttttcagcatcgaaaacagcctccatgctgcgaacgggaaagacaaatcgtatagcacttaccgtaggtaactcactggctggctggttcagttcacaactagccgaaggcgtatattccgtgctcgcatcccaaggatatgacttgctatcataccgacttgcaaacgccgatcaaagacgcgatttcttttcctcaatgccagtgaagcgcaacgcagacgcggtcatcatctcctccttcgacatcagcgagacagagaggcgaaccttagaacaactcggtatgccagtcatcggtgtcaacaccatcgggcttacggaacagcgagatatgatttccatcggcgtagacgaaattatagcaatgcgacaaaccgttcatcagctcgcaggactgggacatcgcaatatcgcctttatctgcaagcagcaagacagtaacggattcatatgggaagctgaccaacgtatagaagggttccgtcttggcatggcggctgagggactcaacttgcccgacggatacatcatcgcagtacaggacaacgaatttgccggagcagaggcactcagtagcctgctcgcactctcccctcgcccaaccgccgtatgctgcatcagcgacgagaatgccattcctctagtccatgcgcttcgctcatacggattccgcgtacctgaggacatatccgtcatcggattcgatgactggccaatggcacaagcgctcaatatatcaaccgttcggcacgaccctcggtcctacggagcattagcggcagatgccgcaatccgattatcacgaggcgaaattctgacagaaagttgcatcgttgttcccacgacgctcatgttgcgcggcaccacaggcccagcacctcgagattaaacatcgacaacgtccgcatttgatgatgtgcatatcattattgcaacagcgaaacaacaggtaccagccagaggaaggacgaccgggtaacagccacaaggcggccacccattcaccatgaaacgcgcgaccatcaacgacgtagctctcacggccggagtctcaacttttaccgcatcccgcgctttgcgaggtaaggatcacgtggcagcagctacgcgggataaggtgctgaaagcggccaaagagctgaattacaccgcgtctcgctcggcggcggcgctggcaagcggacgcaccaatcgcattgccatgctggctcgcgaacggctggccggctggttcatgggcgaattattcgacgggctgtatgacgaactgagccgcgcacgctatgacttgaccgtataccgagccggcagcgtcgaggagcgtgcggaattctttactcggctgccagccaatcgtaacgccgacgccctcatcgtatccggattttccgccaccgatgaggaagccgacacgttggccagcatgggtatgcccatcgtctcggtgaattcgccgtatatcagctgctgccaagcctccgtggccattgatgacgaggcggccgaagccatggcagtgcgttatcttgcggccctcgggcatcgtcgtttctgctatgtggggcgcaccgatccgctgaccggcaaggaatggggattcgatgcacgcgcacgcggatacaaagatgagatagtctcgcttggcctcaccgactgcggcatccacttcatcgactcggaatcaccacgctcggccaaacaagtcatcgccaccatgctcgcgcagcctgagcggccgaccgctatctgcgtgtggtctgactactacgcattgcgcgtggtacatgagttgcaggcaatcggagtacgaatccccgaagacgtttcggtctttggctttgatgggtccgacgtggcggaatccattggattaagcaccatggtgccaactcccccgcgcgaaatcggacagattgccgcgcgcaaggcactgaatttggttgaggggaagaccttggacgaccctcatacgactgtacctgtggcggtcgagcccggcgcgaccagtgggccagtgcgggaataggcgatatgggaaaagcccccctcggcggaaaaccgaaggaggcttgggtggagctgcactacttcacagcgcctcgcatgactccaccgacgacccacttttgggcgaagatgtagacgatgaggatcggggccatggccatcaggtagctggagaaggccatcgggtagttggtggcgaactgcgagctgaagacgtactgggcgagcgggatggtctggttcgactggtcggtcaggatgatcaacggcaggaggaagtcgttccaggcccacagtgcggtcaggatggcgatggtggcgttaatcgggctcatcagcgggaagatgatggtccagaaaatgcgccacgtggatgcgccatcgattcgggccgcctcttccagcgaaaccggaatcgaacggatgaagccagtggcgatgaacaggttcgtgcccaggccgagcaccgtgtacagaatgatcaggccgacctggttgtccaggtgcagggagcccatctgcttcgcaatcggcagcatgacgaccgggaacggcacgaacatggcggcgatgaagaagtagtacaggaagcggaagaagcgcttgtccatgttgcgggccacggcgtaggccacgaaggtgttggtcagcagggtgagcaccacggcggccaccgtgatgatcgcggagttgagcgcggccttcgggtagttgaccttggcggaggcgtcggcgaagttgtgccactgccacgaggtgggcagggcgaaggtgccggcttcggccggagtcttcagcgcggtgacgatggtgaagtagagcgggatcagaatggtcaggctcagcacggccacggcggcggtcagccaccagttgatcttgtggtccctgcggaacttggcgggcttgccggacttggacggggtaactgttgcagtagtcatttcttatcctcccctaaatcagatctgttcctggctgcgggagatgcgcagctgtacgaaggcgatgatcgccagcacgatgaagaagagcacggcgtttgcggtctggtaggcgtactcgccaccggtcaggccacccttccagatgaggtaggtgacggtttcggtggaggagttcggaccgccctcggtcaaggcgacgacctgatcgaaggtgccgagcgcgttcttcatggacagcacgaggttgatggtgaagaacggtccgatcagcgggaatgtgatcttccagaacttctgccaggcgttgacgccgtcgatggcggcggcctcgtagatttcgtcgtcgatggtctgcaggccggcgaggtagatgagtaccgagtaggcgatgccctgccagacggcgaggaagacgattgggatccagctgagttgctcattggtcaacagcgaggtggacagccacttgatgcccagcgccttgccgagctcgggcagcgggttcatgaagatgtacttgaacacgtagccgatgaccagcacggagagggtgtaggggatgaagaagatggctcggaagccattcttgaaggcgatcttcgagttcagcagcaccgacaggaacagggcgatcacattaatcagcaccgtgatgagaatggcgatgaggaacgtgaacaggtaggcatggcccactcggttgtcctggaagagggcgatgtagttcttcaggccgatgaacttgtaatcgccgtagccctgcgagttggtgaaggaatactttacgccatcaagaaatggcaggtacaggaagaaggcgaagatgatggccgccggaaccaccatccagtagtaggcggggtccactttgcgggtggagaaggcggagaccttcttcttggccggtttcttggcagcggtcttggttgcggttgcgtgtgacatgatgttctcctctcctaccgatcactcgaaggtcctggcttggaccttgtcccattcggtctgcatctggttcaggaagcggtcggtgttgccggaggtcaccatggtctgcaggtagccgccgatgttgatggacgaaggaatgtagtggtcgcagaagtcggccagtcggttttcctcgaagaacgggcgcacggtttccagcgcatcgttgccgaagtaggtgtccttcagcggcgtgatggcggactgggcgtcggcgtaggcgtcaagctgatccttctgcatgaggaactcgacgagcttcatcgcttccttggggtgcttggtgttcgcaccgatggtgagcatcacgtcgtcgccggcggtgaggatctgctcgctggcgtcatcggtggccggcatctgggcgaaaccaagttcgatatcggggttgatcagcaggatctgcgggatggcgtaggtgccgagcgggatgatcgcggccttgccttgggcgaagttctgcgtgccctgctggtaggtgacgccggtgtccgcagtggagtaggtgaagagctcggattccttctcgactgcggtcttccacagttcctggaacgtggtcttgccttgcttgagctcggtgtacttcgattcgggaaccagcgtgccggtcagggaggcgagcggtgcctgggtggtccaggcgtcggccacggaaccctgcagcgggttgatgccggcgtccttgaaggtgttgagcatatcggtgaactcgctccaggtggtcggcggattctccgggtcaaggccaaccttgcggaacagagccttgttgtagatgtagccggaggcgttacccgcgaagggcaggccatacaggcgcttcttggaggaatcggtggtctgcaccagattcttggcgatctgcaccatgccggggttgagggtgtccacaatgggttcatcggtgaagtcgtagaacacaccggaggcggcgaagttgccgaagctgatgtcgccgttgaaggtgatcacgtccggcacacgattcttgacgaaacgggtgcgcagatcggtctgggcgttggcggagttgttgatgttgaccttgatggtcgggttctgcttctcaaagtcggcgaccatggacttgaactggtcggcggcctcggacttgaactggaagaaatccagcgtgacggtgcctgcggtgctggagccgcagcctgccaggccgaacccgacggcgatcgcgcacatcacggcggcggtgcgcacggccagacgcttcagtctaggcgttgcatgtggggaatcggacagcataattgttgactcctttatctttcttttcctccggcttcggtgccggcggttcttccactttccaaggtaacggttcggccatttcattcccagcgccagcgagcccacttgcgcaagcaacaaaaagcgcggtattttgtgattaacgcaataaatacagcgaaggggcttgcatgtctgatgtcaacgcgattccacagtggttttccggatccgagcatacgcatcgcgtggcggcggcaattgcccaatacgggccgatagcccgcactacgttggcacagatgctgggactgagccaaggggccttgtcccgcatcaccagcgatctgatctacgccggggtgatcgaggagcttccggccgaggccggcccgtcaggcaagctgcccgagcgattcacgccaagggaaagttcggatcgtcgcggacgcccgcagacttcgctggtgttgtgttcgaacgcacgcaccttcattggtgtcaaggttcatgggatgtcgattgtggccgctgcggtgaacgcgcatgacgaggtggtgtccggccggcacgaggtgccgatcggggcggatcagtcggctgagtatgtggtgtcggccatcacgcggctggtgcgcgaatgttccgccgatatcgcctcttccggactgccctcccccactgcggtgggcgttgcggtaggtgggcatgtggtcgacgattcgattgtgacgttcgcgccgttcctgcattgggacggggccacggacttggggacgatggtcacagaggcgaccggcctgccgtgcggggtgttcaatgatatcgattctctgctggtggatgcctcctggttcgggccgggtgtcggcgtggatatgttcgccgtggtgaccatcggcgtgggtgttggttattcgctggccgtgaacggcaagccagtgcagtacccggataagagctatggtctggtgggccacgtgcttatcgatccggaggggccgcgctgcaccagcggacatatcggctgttcacaatgcttgactgacgattcgatcgccgaacagtactctgcgattgtgggtcgcgcggtcagttttgaggactttgcgcgcgatgtcaagggacgcgtgccgcaggccacgcagttggtgaaccggacgtgtttccggttgggttcgctggtggctacggtggcgaacatcgcgatgcccggacatgtgatgattgccggggagtccgcgtttttggccaagctcggcaccgattcgctgcgcgatggcattcgtttctaccgtcacagccagacccagccggtcaagttcacgattatggaccacgactggcagctctgggccaaagccgccgccagtcgcgtaatcgtgaagcatattgggtaggccgttcttggctcccctcagagagggaagccaagaacgttgcttcgccacagttactccgccacgaccagcaattacggacttgcctatcggcaaggctcaatcccaccttcgctcagctgtcgcttcgctcaggccgtggctactgacagcctactaggctgtcagcttaacgccacagccttgagcaatactgcctgctgggggtggagggacggggacggatgccgtaacgctgcagggcttcgccggtcaggactacgccttcctcgttccaccagccgagagtgctctggccgttggtcagaccggtcaaatccaagctcgggtcgagcgggctgacgcggtaggtgcgctcggggtcaagtccgggcaggtgcacgggcgcggccggataggtctggctggtggtcagctgggtgaagcggtagatggcggcgtcgcggttcggcatcaccatgccatccaagcgcacggccggatcgttggagtcggcgtgcacgcaggtgtcgatggcgaaccagtcgcggtgcttcttgaattcggccacccacacggccagcttggcgagcgcctcgtccggctccttcaacaggttccattcgatgcccatgtggccgaagaacgccatggccatgcgcagttcctggctggtggcacgctgggtggagtgcgcgggactggcacccacgtgctcgcccatcatcgccggcggcaccagcagcgaggtgtagcgctggatgtccgcgcgctcgaccgggtccacgcagtcggagacccagatacggtcagcgtgctctaggatgccgagatccacgcggccaccgccggaggagcagctttcgatctcaaggcccggatgtgcggtcttgaggcccttgaagatgttgtagacggcgagggtctgcgcgtgcacggccgggcggccggagcggcgggaaccgggctcggtgacgagcttgttgtggtcccacttgatgtagtcgataccaagctcgccgacaagctggtccatgcagccgtagatgtagtcgaacgcatccggattggtcagatcgagcacctgctgagtgcggccctgcagcggcagtcggccggtggtgggcgaaagaatccaatcggggtggttgcgggccacgtcggaatcggggttgaccatttccggctcgaaccacaagccgaattccatacccttggcgtgcacgtagtcggcgagcgccttcagggacttcggaccatcgggccagacgtcctgcgcaatctgccagtcaccgaggccggaggtgtcgtcgcggcgggagccgaaccagccgtcgtccaccacgaatcgttccacgccggagtcggcggccttgtcggcgagcgccttcagcgtatcgaagttgtggtcgaagtacacggcttcccatgtgttgaggatcaccggacggccgtgcgagaacaggcgcgggtgcagggagcgcacgtaggagtggaatcgggcggcgatctcgttgagaccatcgccataggagccgaacagccacggggtgtcgtaggagttctggccttcgccagggccagcgagcgtcacttcgccgccgaacaggagttcgccgccgccgatcacgccggttgtgtagggcagacgttcggcggacagcacggagttgccgctccagcccacgtgcaccgaataggcgtcgccatgctcgaagctgaaaccgggcacgccggcggtcaggagcagggatgcgtcgaagtcagggcggccggcgagctgcggcttttcgaaacggccgacggtcagcggctggcgctgcggactgcgttcacgtagatggtgaccggtggtggtgaggatttcgccggcggattcgggcagcgggaagccgagctcgatcttgccgatctcgagcggggctccggcgtctgcaccgaacaggttggttacggtggccttctgacggaccaggccgccggggagcagttcgaggtgccattcgacttccacgccctgctcctcatcgcgcgcggtgactatgacgccgggcacgcggaccggaccggtggcacgggcatggccggccacatcggtgtagctttcgccggacacggcatcgagggtggcttccagcacgccgccggcctcgatattggtcacggtgaacttggggaagagctcgacgccggcgcggcgcagcaccacgcgctgctcgccgatccagctttcggcctgggtgggcaggatagacggccaggcggtgtcgtcgagcgcgccggacacgcgctgcggcttcagggcgtcataggcggccagcagggtgtcgggcttggccagcgggcggccccagtggacgatgtgcggcaggtcgctgccggcaaacaccagaccgatcgccacattggcggcgggctgggtcaggtagacggcggtgagtgcggtgccgtcagcggcggcgccggtgaaagtggaggtgttctcggccatattgtctccttcgacgtgtgtggatttgcattgcactactggtttcgatggtagaagaaatggaatatgttgccttggtgccgcgtgttggttgcgtgaggtaagtaatgcgtccgtgtctatcgccgctgggcgaagaaatcagtcaggatggactgacactcgccttccagcacgccgccgtgcacttcaggactatggccgatatgcggatcgcgcggaatatcccaaatcgaaccgcatgcaccgagcttgggatcccaggcaccgaacgcgatggtgccgatatgggtctggatgcaggcacccgcgcacatcgggcacggctcaagtgtgacggccagcgtgcaatcggcgagattccaagcgcccaaggcttgggccgcctgacgcatggcgatgatttcggcgtgggcaagcgggtcgccatcagcctcacgcgtgttgtatccgcgcccgacaatctggccggccgcatccagcaccaccgcaccaaccggtacgtcaccagcggctgcggcctgaccggccagttccagtgcgcagcgcatcgcctcgtcatattccataccaacgagtgtatgccttttctcatatcgtctcatgatgtgcataatcggccgcaagcttaacgttttcttcatggttcccatatacttttggtggagaaaaatttaagggagaaggcggcaacatggcggtatttgagctcatcctatgcatcattgcggcggtggtggtgagctcgtttgtcagtcgcttcgtgcccaaagtctccacgccgctggtccagattgtgctgggcgtgctggttacgtatctgccgtttttcccgaatgcaacgctcgacccggaactgttcatggtgctgtttatcgcgccattgctgtatttggaagcccacgaaatcgataagtcggcgttgctgaaaacgctggatctgagcctatcgctggctatcggactggctatcgtcacgatggcggcggtcggattcactttgcatgccgtctggccgtccatcaccttagcctcagccttagcactcggcgcggcactcggcccgaccgatgcggtggccgtcagctccctcggtaaagaagcctcgctgacgcagcgtcagcgcagcgtgctgaaaggcgaatcactcttcaatgacgcttccggcatcgtcggcttccagttcgctctggccgccgccttcactggagaattcgccgtggggcaggccgccggcgaattcgtgatctccttctttggcggcaccttatttggcctggtgatagcagcagcggccaactggctattcgagaccgtgcgatccctcggctgggaaaccactaccacacgtattctgatggaactgttcctgcccttcctgctgtatttgggcgcggaggaattcaatgtgtccggcattctgtcggtggtggccgctggcctgttcatccgattcgaccgcaccggcgtggggccgaatgtggcacgtacgaatatcgtttccacttcagtatggggtgtgctgagtttctcgctcaacggtgcggtgttcattcttctgggcatgcagctgccgcgcgccatgagggccagctggtctgacccgtatatcagcaataccgtgctgatcggcattattctgctggtcactctggtggtaatcgcgcttcgattcttctggattgcggccatgctgcgcgttgcgcgagatacaatcaccggccagcgccgcaaaatgacacccgaacgctggcgctcggccgcagtgatgacctttggcggccccaagggaaccatcacgctgtcattgatgtttaccatcccgtattacattgccggcggtgcgccgttcccgatgcgtgacgagctgattttcattgcgtcaggcgtgattatcgtgaccttgctgctggccaacttcctgttaccgctattggccccgaaccgtggcaaggatcccagcgcggaaatgattccggtgaccatcgatgtgttacgcgccacggtggaggaattgaccggacgcatcacgccagagaatcgccgtgcgattctgatggtaatcgaccaatacaccaagcgcatcggacgattgcagcagcgcatcggcgataccgatcctcagggattcgagcaattgcagatcgaagcgctgcattgggaaaaggaattcgtgcgcgaccgacttgccgacaccaaggcgcatccggcggcggatacggccacgcaagagctgaacgtcgaagcctgcgagcgcatgcttgaccagattatgaatacgctgcgtcacacttccactgatccgacttcggggcatgcggtatcgcagattcgcggtcgcttacgcatgttccagcggcagatgagcaattacgccaaacgcacggtgtccaagattcgccataccacaccattggtgagcgaggaccagattttcgcgcgcacccgcgaactgcaggtcgaggcgattcatcatgttatcggtcggcttattgacgagatgggccaggatacgtacaacaccgagcattgttcggcactgttgctggattatcgtcgtgccgaggcttcattgcaggcacgtccgaccatgagcggcactacggaaaccatcacgcaggtcgaggacgtaaagcgcgagagctacggtatcgaactcggtatgattcaggacatgtacgaagccggcgacatcaaccgagcccaagcccgctccctgaggcgcaacatctacgttatgcaagtggacgctgattccggcatctagtttccctggctcccttctctgaggggagccaagttggggattgctattcccgtgtgactttgagggctacccagatgctgcgaatcagcagaaccgtcagataggttgcgaagagtattccgccggcacgcgggctcatggccccggcaatccaagtgcccagcggtgcggtcagtgccgccacgatgccgataatcagaccggctttggcatgcaccattttgcggcgcacattggccacggtggtggtcatggcattcgggaacatggacaacagcgaagtaccacgcgcgatcaaatcggacgcgccaaacaggatcgacaaagccggcacgcaaatcgcgccgccgcccacacccagcaagccagccaaaataccggcgagcacgccgaaaacaatcatcagcaagacagtaaccagattaaattcgattgacgaatcacgcgaaggtataaaaataagctggctcgcgatgataaacgccataaacaccacgaacgcccagcgcagcacgacttccggcagtcgggacaacagcagcgaaccaatctgaccgccgatgaacatgcccaggaacatcagcagcgcggcaatccaatccacattgccttcaaccgcataggccagaacaccagacaccgaggtgggcacaatcgccaacatcgaagtggcggccgcatgccgctgggtcaggccgagccagaccagcgcgggcacgatgatggtgccgccgccaatgccaaacagtccggacaacagcccgaccaacacgcccaccacaaccataaccgcgatgccgcgcggggactcgtccacatgattctcttcagtatgtgcagtagtacttgcagtgctcacttcgctcatgggagaacagtctatgaccgagtcagccacaagcgccctcgatgtccgattgctgcgacggccgcgccaattccagtaatggcggctgactacagcacgccagaagtaatgtcgttgtcaagtagccactggcgtaaatcggcgaactcctcaagactcacattgtgatccagaccgtggtagctcttggttttcagccacgtatgctcttccagccaagcggcggtggcgaacagttcgtattttgggattacgccatcgttcttgccgtacgtatagaacacggggatatcgtaatcggccaggcgagagtcggcgggggccgtgccgggcacctgaccgggtgtgttgaagccggacagggagacgacggcccggtaccgctcggggttgatgcgcaacaaatgcacggcgaccagcccaccttgcgaaaacccaagcggcaccacgtcacggtcggcgggaatgttgtcggccacccatcggtcgactgctgtggcggcggcatacgcgtcgtagtcacgatcatcgccgataggcagggcatcgtgaaaccacgcgtagttgccggggtcgggactgccttcacgggccggcgcgagtgtcagcggcccgcgcagtgccacgaagtcgttatatggagcgatgaggcgcatgatgtccgccatgtcttcttcgctggatccccatccatgcaggcacaggaacagcggatgcgtggcatgctggtcgaagccgccgcgcgaggtgacgctgtgttccacggtgagtggctcgccaaaacgtccgggcacagtggtggattcgcggccgatcagaggctggctggcattcgcttctttgctcataccattccaatatagaggtcttgcgcgctgtgcggaaaacgatggaccatgatttcaatcacattgggtaatccgcgccgaatcgccttgggacttttcaagggataccggcaatctgtcaggcgttaccgctgtctgcggtatctgcggctgcggtgattgtctcaagttcgccgccccactgctgctgcagtgcggtcatcttgctggcctcgccgaacaccatccagcgtttgccgttcagcaatcgccaatcacctttcgtttgctcattatcagcgtattggctcagcagttcggaaatcttgctttcgataggtgcccggctgatggctgcggacgattccgattcaaaggatacgaaggccactctcggatcagtgcacatctgtacggtggtgatgcccggcaaaccgcccgtatcaagcccctgccatccttctttgcacgcgccggcagcttgttcgatgccttgctccatctgtgcggtatcttcgacgggtgccttgtcgttcgactgctgaatcagtccttccgggaacaatacgcccacggccacgccgataaccaagcaaactatggcgcacaccagtgcgatgatgccgcccgcgcccactcccccgtgagtggcgtaccgaggcatggtgactcgcgcagcgatgaccagaatcagggtgatgccgataagcaccgccgccgtcaacgcaatgtatcgtcctggcactgccgtcataaaggaaatggcgtaaggcgcgatctcatgaaccgccgaggtggccgataccacgacggctagcagtccgctgacaacggcaagtctgcggcacaatatcgacgttgggctgctggcttttgtagcggcgaatcgccggccggcatcccgcctggatgggcgtcgattctgtgcacgacgtgagctgcgcgaatcgtcatactgaccatcgccgaagaaatcgtagtcctcatcgttgcgggccatcggtgcccccttcctgccgattacacagctagtgtaccgctatggcttgggaatggcggtcattcggggaatgattcagggcacaaaaagaaccccggcggttgcccgccggggagagaaaggagagagaagaagaaagggggttcaattgtcgggaactgctgcggctcctgatcagctttccgctgacatcttttatataaccactgctttctgggtctacctctaagtttctctgagaaaaacctgagaatacttgcgattgatggaccgcggaagcgtgaggagcctctcacgtttccgcccaaggcgctagacttgaaggcagtatttatttgcccaaggagtttttcacatgctgctgtccgaccgcgacattctcgccgcacagtccgcaggtcatatctcacttgatccgtggacccccgaaatggtgcagcccgcttccatcgacgtgcgattggatcggtacttccgtttgttcaataaccacgcctacacctatgtcgatccggcggaaaaccaaggcgcgctcaccgaacagttcgaggtggctcccgacgaaccgtggattttgcaccctggcgagttcgcactgggttccacgtgggaatacgtcaagttggacccgtccattgccgcccgtctggaaggcaagagctcactgggccgattggggattctcacccattcgactgcgggcttcattgaccccggtttcgaggggcatattacgcttgagctgtctaatgtgtcgacgttgccggtcaaactatggcctggcatgaaaatcggccagatgtgcttcttccagctgagctcgcccgctgagcacccttatggctccaagggcaccggctcgcattatcagggccagcggggtccgacgccgagccgttcctacgagaatttctaccgcgcgcacatcgacgactgagcgttgcgacgtaccattcggccggcggatgccggccatttgcttaatcccaaggagatgtcatgaccaacagcgatggcgggttccagttcgacttccagcagcccgaaaagccggtcaggccaacggttcctccgattcccgggcaagagacggcagcatatagcacagaacccacggcacaagccacaccggctctgcagttcccgcagtctgtgcagtctgcgcagcccacacagcccacacagtttgtgcagcccgcgcaagtagcgtatgcctcacaacccacgcaagctgtgccgaccgtacaagccgctcagccgacgcagcccatcgatccggccatgacgcaaccgttctcgccgcaattcctagctgcggttgccgcacaagcaccacagccggcggcagccacgcagccagtagtatccgaaacaccaatcgccgctgtgcccggccagcagcaatacgtttgggatcagacgacgcaaagcttccgcccggtggaaccgacagcgccggtgacgccagcagcaccagccgcaccagcggcaccggcgacatcgcctgtttcggtagcttcaaacgccgcgacacaggcgttccaacccaatcaggccgagcagcctgcggtagatgccgaggcaacacaagcgttccagcctgatcaggtcatggcaacacagcctttcgaagctcaggccatgccgaatgccgaaaccgcggccacacaggcatacggcgcatcatccaccgtatccggtgagaccgttgccatgccggcaacgcaagtagcgtctgccgatgatgctgcagccacacaggtgttccaaccggccgccctggccgcttcggcacaggctcagcctgctgtgatgcctccctccattccgttggatcaggtctccgatgaggacgattccgatggcgccgagcctcgtcacggcggtagcggcaaaaagaacacccgcaagatcgtcagcattgccgtagcagtagtcgccgtgatagcgctggttgtcgccggcctgctctggtggcattccaacagcagcaaggcgagccaagccgtggcattggccgagtgcaaggtagcggccaagcagtacacgaatgctcagaagaagctcaccaccgccatatccaatggccaaaccagcgcgcaaacatccaccagcgatgtggccgatgccaatacgctcaccacgctgaatcaggcgttgcaagacgccggcaatccggctgacaccgccaagtgcgattccaacctcaacgccactgagttgaagtctcacactaaagagctgcagaatgatgccagcgacatggctgacaagacggatgccatcaacaacgcgatcaaggccgttaatacttcaaaggcgacggccgataccaacacactgaaatcgaacctgagctcggctatttcgcaggcgcagggcacgctggataattccgcgggcagtgtggccgatgaaaacacccgcaccgcgctgcaaaacgccatcaccgaggccaatacggtgatgaacgggaccagtccgtccgaatccgacgtcaataatgcgatttctaaactgcagaaggccgagtccgacgtcaccgcctcgatgcaggccaagcagcaggcagatgccgccaagcaagctcaggaagaggctcagcagaaggctgaccaagaggcacagcagaagtctcaagacgagtccaacaatagcgacaacaataacggcggcgacaactccacctctactgacggcactgacggcagcaacaactgaggtctgcagcgttctcctgtttcccatggggcggtaactccccatggggcggttagcatattttcctttttcgcggaataatgccgttttcagcgaccgccccatgggatagttaccgccccatgaggagccgtttggatatagcagtgggccgggctctgaataccagagcccggcccactgctatatgcccacaatcagggctattgcgatggcttaacgcttggccatcgcgcgtagcacaatcttgcgcagttcggaggcaatcagcacgattgcggccaggcagatgcattccacccaagccatcgggctcaatgccacggtgccgaacggaccgttgaggaacggcacgtaaatcaccacgagctgcagcgccacggacaaaccaatcgcaccccatagccacttgttggagaacagacccacgaatgcggactgcagatgcgaacgggaggacagcgcgttgaatagctgggcaaacaccagaatcgtgaagcccatcgtacgggcctcggtcatctgcgcttcatggccgatggcatccaccgagcggtcggtgaacaagccgccggacaggtgcatgtccataccaatcagcgtgacgatggccatgatgacgccgatgtagatgatgtcgccccacatggaggcgtcaatcacgcggtccgtcaccttacgcggtttacgacccatcacatcgtcggtctgcgggtccacgcccatagccaacgccggcgcggcatcggtcagcaggttgatccacagcaactgtgtggcgagcagcggcacggtgacacctacggtttccggctggcggatgccgaggaagccggcaaacaccacaccgaggaacacggtgaacacctcacccacattggaactcagcaggtagcgcaggaacttgcggatgttgtcgaagatcacgcgaccctcgcgtacggcggccacgatggtggagaagttgtcgtccgccagaatcatcttggcgctctgcttggtcacttcggtgccggtgatgcccatggccacgccgatgtccgcggacttgactgccggggcgtcgttcacaccgtcgccggtcatggccacgatgttgccttgacgctgcaaggattcgacgatcttgagcttgtgctcgggggccacgcgcgcgtacacggacacttcggacgtggccttgtcgagtgcggcctcatcgggcagctggtcgagctggtcgccggtcagggccttgccgtccttggcgatgatgccaaggtcggaggcgatgcgggcggcggtcagcgggtggtcgccggtgatcatcaccgtgcggatgccggcacgatgggcctcggtcacggagtcgcgcacctcagtacgcggcggatcgataatgccgaccatgccattccagatgagatcggtttcgatggcttcggcctgatcggcgatgtcggacacctggcctgcggcgttgacgcttacaccgggcacatcagccaaagaactggtttccagcggacggcaggcctcgccaagcgtacggtaggcctcggaggagagacgttcgacggtggcgagaatcgactggcgatcgccttcggtgagcttacggacctgaccacccacgcggatgcgcgtgcagtagctcaacagcacgtcgggcgcgcccttggcgaacacggtgagcttgtctgaatcggtgctgtccttggcgatgatggacatgcgcttgcgttcggaggtgaacggaatctcgccaacgcgcgtgtagcgcttgatcttgcgatcggccttgaccttgcgtgcggccacgatcagcgagacttcggtggggtcgcccacaatctcccaacggccgttctcctcgcgtagttcgccgtcgttcgcgagcgtgccggccacaagcgtggcgacgacttcatcggccacaatctgggcctgctcggattcaggactgacgccaccggtcataaccatgcggccttccggcgcgtaaccggtgccggtgatctgcactgcgccggacggggtgaccacgcgctccacggtcatctcgttgcgggtcagcgtaccggtcttatccgagcagatcacggaagcggagcccaaggtctccaccgaatgcagtttcttgacgatggcgttgtgcgcggccatacgctgcacaccaagcgccagcaccacggtcaggatggcggccaagccttccggcacggcggccacagccagcgagacggccaacagcaaggaatcaatcacgtcatggacgtcgttgaagccttccagcacggcgagcgccaccagcaccacgacagcgatgacgcacaccgcaatgccgaggatcttggagacgtaatccatctccttttgcagcggggttttctcatcttcggtggcggagagcatgtcggcgatcttgccgacctgcgtgttcataccggtgccggtcacgattgcgcggccggtgccttgcgtcacggaagtgccgttgaagatcatgttggcacggtcgcccagcgccttggcttcggtgagtgtgtccggcttcttaccaaccggcacggattcgccggtcagtgaagcctcggcgatgcgcaggctggccgcgttgaccagtcggccatcagcggagaccgaatcgccttccgcaaggacgatgatgtcgccggggaccacgtcggcggtgttgatgcgcatgaccttgtcatcgcgcagcaccgaggtctgcggggccgtcatttgtgcgagcgcttcgacggccgcctcggccttggcttcttgcatatagccgagcacagcattgacaatcaggatcaagatgatcacgatggcgtcgaacggcagcacttcgccgccttccgcgccgggctgcgcattggctttttcgatgaaccaagcgatcaccgagataatagtggccgcgatcagcaggtagaccagcggatcttggaattgggccaggaatttcttccatttcggtacgggcggggcgctggcgagctcgttcgggccgaatttggccagtcggcgcttggcttcttcctcgctcaggccgtgggatgggtcgacgttcagggctttggccacgtcgtcggcgctggtcagacttggatcggtatcccccaatagcgcttcctgtgcgcgcacctcttccgattccacgaccccgttcgttgcggtcgtggacactgcggattgatctttgagatcatccataatgttctccttggtattgccgcggagtagtcagccttgcggccgctgccgggttttctctcccggctggacgcacaggactgcgcggttatggacaccggcgcaactgctgccgatgcatacgattgccattattccataaccgcgtggcgcacttggcgcacagcgtaatagcgttttgcctagaacaggcgacgcaaccaggcctcagccaaatcaggccaacactgcacgcattcgacgatgtgcgcatagaagccgttaccggcagtttccgcattggccaaggacaggccgtggctgccttcagggaacaggtgcgcctcaatgctcacgccggcggcccggcaggcctggatgagcattagcgtgttctccacgggcacggcgtcgtcggtcatggtatgccagacgaagacgggtggcgttttggcatcgatgtgcttttcgatggagaacttgtccagcaaagcctgattgtgagcttggtcccctagcaggcattggaagctgccgcgatgggcgtacttgccggcggtgattactgggtacgagagcatcagcgcgttcgggcgcacggcgtccgggtctatgccgccctgttcgcggatgtcttcgtcgccgaccgaggtggcgaggttggcggccagatgcccgcctgcggaaaagccgagtacggccacttgcgcggggtttacatgccactgatccgcattggcgcgaatcaggcgcattgcctcggcagcctccagcaaagccaccggatagcggctgggctgcaccgaatagcgcagcacgaatacggcgaagcctttggccaggaattgcatggccactggctcggcttcgcggtcagaagtcatggcgtagccgccgccaggcaaaatcaggatggccgggcgtatacggtccggttccatctcctcgctgttgtcggccacatagccaaagaatcgcgcctcgctgccatcaatgccaacgatggtttgttgaatgtattgcatgccatacatcatacgcgcagagaatagttctcgataagaaccactcgccatatgcggtcttgcccgtatctccaaaccgaataacacttacagcgaatcgtgaagactgcgggccatggcgcggtcgcgcgagcctttggtgagcttgagaccgagggtcacggcaatcaacacaacagtgcaggcgatccacagcgttcgaccgccgaagttgctgatagtccagccaccaatcagcggcgccagcgcaaccgacaccgaccacactacgttgtagacgccctgatacgtgccacgcgccgacgcgggtgccatggcggcaaccgtagtggtggcgatagggaatgtgcccagctcacccagcgtccacagcactacggcaagcgcgaatccgccccaagaatgggccgcggcctgcaccgcatagccgatgacggttacggcgaggcccatcaccagcacgcgtgaattgcccatgcgcgcgaacagtttcatcgcgggaatctgtagcaggcacaacataccgccattgatggtgagcagcaccgaatactcgcccagccctagaccaaggtccgtcatggcaatgggcaggccggaggtgctttggaagtacacaaggaagtagccgaacatcagcagggagaagccgaggaatggagtatcggtgagcacgcgccgccaattgcgagacatggcgcccttgacactggcagccggtgcggcatccgagtgattcggcctctcaatgccggcgaattccgcatgggtaacactgcattcgtcttcatggcgcaccgcacttggcaccgatacagtaatccccaaatgccgcacctcgcggaagaacgcaatcagcaatatcgtgacggctatcatcaccgccgcttcaacgtagaacatcagcgaatacgagatcttgaccagctggttggccacaatcggtccaatcgcgtacccaaaattaatcgcccacgattgcagtacgtatgcacgttgctgacgttcggcaggcaccacatccgcgatatacgcggcgatggccgggctgggcagcgaggcgaacgcaccatagacgaacagagccgcgcctaaagacacaggatcagtgagtacggaaacgaccagcagggcagccgctgcgccgatttcgccgatgataatcatggattggcggccgaatctgtcggacaaggtaccgccgaacaggcagccgatgattgcgccgaagccgtacatggccacgactgtgcccaccacaccctcatcgaggcgcagcgcggaaaccaaatatatcgacaagaatgaggtcacgaagcgacccatccacagaatcagaatcgccaaccataatccccaatacagcagggacagtccgaatatcatacgctgcttcttcactctcaataccttaccggctaccgacggcggaatagccgcgttttggcgcggggtgctgggacaatagcacctatggctatcaaaaaaggaccgaccaaggggtcgggtggcaagcatcgcaacaaactgaagggctacggccccactcccaaggccgaggaccgcgtctatcacaaggcgtacaaggccaagaaagcggccgaacgtcggcagatggccgacccgcgtctggcagcccgccgtcgagtggacaagttcgcttcggcggatacttcggatctggtgtacggccgtaattccgtgctggaagcactgcgcgtaggcgtaccttcttccacgctgtacatcatgtctcgtattgaacatgacgatcgtactcgcgaaatcgtgaaaatcgctggtatgaacggcctgcacatgctggaggccgatcgtctggagatggatcgtatcgcccgctctggcaaccatcagggcgtgattctgaaggtcgatccgttccagtactcctcgctgaacgagctggccgatcgtgctgagaagaaggccaaggcaatggaggccgcgaattcggcggccgcccgtattgctgcgcgaccgctgtttatcgcattggacggcgtgaccgatccgcagaacctgggtgccgtgattcgttcggcggccgcattcggtgccaatggtgtgattctgccggaacgccgttccgcttcagtgaacgccgccgcttggaaggtgtctgccggtgcggccgcgcatatgccggtggcgcgcgtggtgaacctgactaaggcacttgagggcttgaaggagcgtggatactacgttgtcggccttgacggtggcggcgataagctcgtcggcgagactggctttgaatccgatccgctcgttgtagtgctcggttcggaaggcagcggtttgggccgactggtgcgcgaaacctgcgacgcgattgccggcatcccgatcagctcgtctgttgagtcgctgaacgcttcagtggcggcgggtatcagcctgtacgcggtgtccaacgcacggcgcaaggctgcggcggagtgattgtcgcttgaggccgtaataggttgtacatacacggaagcccctctatttgaggggcttctttgtgtgatgggctcacctacagacagtccaccggattgtccgcttaatgactccacactgccgcatccggatcgtcatcggggttgtagccgtcgtcgtccgggtcgctgtaggtggattcgtcgtcaatgacgccggaatcggcctcttcgttaagttcggcgagtgccttggagtcaaggctgtagctcggcagagcgttgtcgatgtagctggtcacggcctcgcccatcggcacgtcgtggccggccttctccgccaggaaccagcgatggtcaagcacctcatggaagaactgagcaggctcgatctgggagcgatattcgcgcggaatcatacgcacggtcggctcgaacacctcacgcatccagtcggtggccacgatttccagatcctcgccctcacgccacgtggaggcacggtaggcgtcaaggtcgttgagcagacgacgggcctggttctcctgcacgtcaaggccggtgaggcgcagcagcttgcggttggcgtagccggcgtccaccacgcgcgggcggaccagcacacgcttgccgtcctcggcggtcttcatttccagctcgtccacgtcgaagcccagctcgttgagcttgttgacgcgctgctcgatcttccacatttcgtccgggttgaacttgtcggtgtcggtcagggcgctccacagcgagtggtagcggtcgactaggcggttgcccacctcgatctcatccacgtcgccgggcagtagcttgccggacgccaaatccataagttcgccgatgatgttggtgcgggccaagtcgatatcgtattcgcgctggccgtcggtgagctgggcttgcaggtcaccggtctcggcgtccaccaggaaggcggagaaagcgtcggcgtcgcgcaggaacaggacgttcgacagggacacatcgccccagtagaagccggccaggtgcaggcgcaccagcagcacggcgagggcgtcaatcagtcgttcggcggtgtccgggcgcaggttgcgggcgaacaacgcacggtacggcagcgagaacttcaagtgccgggtgaccagaatcgcctccagcggctccccttcacgggtatgacggccgatgaccacggcgatcggggtcacagttggcagttcgagcttctgcagtcgacgcaggatctcgtactctcgctcggccacctggcgcgtgatctccttcatggcgtacacctcgtcgcccacgtgcacgaatcgcacgacgtggcgggagatgcctcgcggcaggttggccagcaggtccttaggccaggtggccaagggcttgtgccagggcagcgtgaacatctttgggttcgagctggcggcggtgattttcagtgcttgcggttccgctgaatcggcgtgttcgtcttcggctttgacagacgtggccttcagcgcacgcggatccatctggggcaattcgttcaactccatgtgttcgattttacgtggtgcttgggaagtgcgcttcccagccacatattcggcgcgttattctcgcatacgaataaacaaaaagtcgggtaatcccccacatgaatgagatcagaagaaatcaagccatctttaattttgtatcgcaagcaccagcaaaaagcatcaaacaaaataggataccgaacaacacaaaatcgatagcccagagacaatcctgtttgctcgttttgcccccgtcatccgcagtaaagagccacccaactatgaggacaacgattgaataaacaaaccaacctgttgcgcaaattattgcgattaaatcaaaagcagtcatggtcagaggagctcccaggctcatttcataacgctttcgtcatctgtatgggatttgtcgctcaaattgacgtcactcatgcggcgcctcatgcgcagcctgaataaaacgaacgcaacgagtagcatgagccccgctgccgcagcaatgcttcctacggcggcaccggtacggccgataacgccaggctttaccggctccttgtttggattattttcgggcggagtgacgagagttccggcgctaaatttcggctctaccgtgatgttgagatcggcggccgtatctccgctgccaggaatcgagatgaggaacggatcacagtcgtatgccttgttggctttcgccgaatccgtgcgggagaccagatataggccaagcggtaggttctggaaagtgagctgaccagctacgttagtggtgccggaatgctggtatagcttgtttttcgccgcgtgtgcagccagcttcttggcggcatcgtgatattcgctcgatgtcaggcgttcccaatcggcagtgagaccggaaaaatcactgacggttttatatgaggaaacgctaccatcattgttcgttgtgacagtggcgacgcgcacgatggcataagtatcgccggcaagtgatttgggcgaagccgtgtctcggccccatacggcattgatggtgagagtgccgaaggaatcagcttgcgcgtatggcaccatgaagccgaaagacacaagaccagtgaggatgatagtaatggtggcggcaatcatggcagcaatgcgcgccgcaccatactcgcttccgctatgcgggtctaacatgtctgcccggtcctttccgccgtgatgaatgtgattggttatttgtattggctggctgaggaggcaagtcaccgtccggctcgatggctgcggagctagaatcatcagacgcgaccttggcgctcccactctgccggcgtcgccgctcatgccgttgccacaaatgccatgcgatgagcaaggcaatcaatgcgagagacggcaacaagtactgcagcgggatgtccacgtggaatgtggatttggcgtcatcctgctgctgcggcgcgtatgggatgcgatgaccgcgcaccagcagccggtgcgtgttgaccgcatacggtgtgcaggtgatgagcgtgaccaaatccttgccgggctcgattgccagttgtttggtatcggtcggcagaacggtagtgatcttatcgacctgatacgcatacgtgtctttaagtattgtgatgtagaacttgtcgccttttttcataaggttcaagtccgtgaacagttttgccgtgggcaagccccggtggccagacagcgccgcatgagtggacgcgccgccaactggcagtgaggtctgtttgagatgtccgatgccggattgcaacactttctcggaagtgccgtgataaatcggcaaggtctcatcgagcttaggcacagtgatgtatcccatcatgccgtcaccgtcaatattgagcagactgttgtattcctcgtccgtggatgcggaattgacggcactggcaagagcgtcggtctctcctgcatcgttctgggcgagcttttcgttataggcgtgcgcagcatccagcaccttctggtactgttcctggctcaatgcttcaacgctggcgtcgtagttatttacggcgcggctggcgttgcgcataatgaggaagttgctgatcgtcggatagaacagaatgagcattccaccgagaatgactagtaagggtaggatgttgcgcagtcgtttcatcgagcgttcttttcgcaaggaaaccgtgttgtgggcgtagcgggtgtgtgcccttcacacccaaaacacggtcatgttcgtcaggcgttcttgcgcttgagagtccaggcaacgccgagcgcgatgaccagcacaccaatcaccgtgaaggcgatggtacccatgccaccagtttcaggcagggtaacaccggacttgttctggaccgggataacaccgttcgatgcggactggttgtagttgctgccattgttgttgttgtaggtgatggcgacggtggcattcgtggtgtcagtaccgtcgttctggccatcaaccttcacgccgatggcgctggcgagcttgttgtagccggccggcgctttggtctcggtgagcgtgtactcgccgttcttcagtccctggaagacaaccttaccgtttgcaggagtgatgataatatcacctgtctcaccagccttggctacacggtatacagcgttctgggtctcactatcagcgactttcacgaagctaatagcggagccgtccttatgtgcgagtgtgaactcagcgccagcaagtcgagtagcggcatcatcatattttttaccagtgtacttatcgacggtgaagccataagtgaagacgcgaaccttgctgggttcggactcaccggtgccactgctgctcgggttgttggagtactgaatcgttgcggagttggtgttaccatgaccgcccacagcagccttctcgttcaacgtggccgtgtaggtgacggtgatcgtcttgccggcattggcctgctgcttggccttgaagtccttcatggcgacagtaagcgtattgtcgggggccgtaggagtggtgacggtgtagtcagtgcccacggtcagtggattagtcacaccgtcgaccgtaacggaagtgacttgtccaaaggtgaggcccttagacaacgtatccttgaagttgaaggtgtaggtgtcataggcggacatgtctggaatggtggaggtcagggtgaaggtcagggtatcaccgatcttcgcgtcggtgacgtccttaccagtgctgcctacctgtaccttcttgtcgacggtaggcaggtcgcccttgatgtcggcagtcacattagcgcggtcaacggaaactagcgtggcgtattgaccactggtgttggccaaggtcgcacccggcacagcgaccacgtagtagccgtagtcgagaccagcgaacgtcgcagtgtacttaccgtccgtggcatcgtcagatacctgagtggtcacgccagccgcgatgttgttggccttggtctgcgcccagttcgatgccttggtagcgaaagcaaccaagtcttcaccctgcagcttggatacgtagtcgtttgctttatcgttgacgttctcgttggtagcaccagttagtccggaagcagcggagtcctcaaagaacggcttccactcgtcagtcaacgtgtaggagacagccgtgccgtcaccgctcacggtagcggagaacatcttgtaggcgttcacggtcttaccggcgaacttcgcgtcagcagtgctgaccgtcagcgtggcattatccgctgcgttggccgtggcgactgtcgtcgcggccaatccaaatacggtggcaatcgccgcggcagcagcgaaaacctttttcatcagtgatttcattactgttcctttccctaaatggaaatcttttctgtttggcaggtacggtttgtctatgtggtcgtcacgcggcatgggcacctcgctttcgtatacggctggaacccgagcggactgtgccggattgaacgcgttgattacgcacgtaccagaccacgccagctcccataagcagcaagccgaacatcaggaaccacatcgtgcccgcacctcccgtatccggaagcaacgccgcattggtaacaatggccacgcgttccttggtgttgtaggagaccgatacttggtatccggcctccgcgggcttgatggtcttggtggtatcgccgtccttataggtcacggcggtttctttcacggtgtacgtgtagtaacgcacgatgtccttgccgttggcatcctgtccatccacgaatgcgaccggcagtccttgaatcaccttgcgccaggtgttgctccaggaagaggcatcggaggagtccaacgtcaccgtccatggattcttctgcgtcacggttgtgcaatccgcgccgaagcattgaatcgtctgcggcgtcaccgtattgccactgccatcggtatagtgcgcggcgatcttcagctcgaccgactgcggccgttcgaggttgccgtccttccataccttctggacggtcaggtcaatggttcggcaaccgtccttgccgcacgggtcctggccgtcgtccggttcgggggtgagtccgccgttgttgtcggtcacggtcgcgtcgagcatgagcacggccttggccggggactggtaggcatcgagctttgtgctgctgccaccagccacagtcacggcgtccttgatgccgacccatgtggtgcccgcgtcgccggatgcaccactgtgcacagcgccgctgtcgtatgtgttgaccacgtcgaacagcttcacttcccaacgatcgagtccggtgttcagcgcatcgtctgccgtgttcttctgcgagaagatcttgttgccgtcctgtgcggaggtgcgggcctcaccggcgttcgcggccgccttgcggtagatgcgataggtgttgtatgccttgccgccgttgccttcatcgaccggtccgaggatgtcgctcatggtgttgaagtcccatacggacttgagtttggtgttcgagaacgggtcgaccagtccgctggtgccgcggatcgtgtcggcgtagaccatgtggtcgtctgccagcacgccctcgtcgttcagtccggcgaaaccgcccgcgtagcctgtggaaaggtctttcatgccgtcggtatcctgagtcgctccaccaccgaacacgtcatagccgctggcgatgcccgtcacggtggactgttccacgcgggtgcggttgcccttgatgagttggacggtcaggttgctacctgacccatccatgtcgatgccgtccttgctgcagggcagtttgatgacgctgtcgccgatggtgacgatcgccacgtcggtctgctgctggttttcggcgtcggccttggacagggcgacgctcaccttcagcccgaacaggttcacgtacagcacatcgccttccgagagcaccttgaggtcgaataccttgccgaagatagtcgggaaccacttgcccaagtcgatgacgccgacctgctgcgccttgtcgaggtacaggagcttgaccagcgcgttcactacttgcaggagcagttccacgagtaccgagttgacctgcgtatcgaccagataggcgcggctggtttcgccgacgaatccgccggcgatctcgccgctggtgaccttcttgagattgccggccgtgcagcccttcactcgggccaggtccgcgtagccgacgaatccgcccgcgacctcgcgcccggtggccttgtcggtggctttgccgtaatcgtcgccatggtgtgtggcggtgacggtgtagccgtccgggatgccggtgacatgcgaatcaccgacatgcgagccccagatgtcaagtacgccggccgtggcaccgagcagattgagcgcatccgtgccgagctgtgcattgtcggcggcgaccgtgtcggatttgccgaggtgcccgatgaagccgcccacgtagttcacgccggtcacactgttgaggttggtgacgttggactgcttgacggagccattgatcagtccaccgccgaagccaccggccgcaccggtgtaacgcttcgagtcgagcatgcccttcgtggtggaatcatgggcgacgacttggatgccgtcgttcacgccgttgacctgaccgtcgtagatgaaggtgcggaacgcttcgagcacgcccacgttgccgaccttgagcagtttgagcagcaggttggtgtcctgcttatcgccggcctcgccgccgccgacggaagcgacgctggacacatcggcaaggccgaagaagccgcccgcgtattgcccgccttcaacggcacgcagcccggtgactgtaagtgcggctgggtcattgttcggatccgcttcactgccggtgcctttggcggaatccttgtcaccgaggatcgaggcctgcagcgagccggcgaaaccgccggcgttcagggcatacttggttgtggtgttacccttatcgtccttggtctcatatgcgccgtcgaccgtgtatccccatgccgggtcatccgagctcacatgcgcaccgcgaatcgtcgtaaccgtggcctgcaatacgctgaccagacttgccggggtcgagaccagcgagtcgaggattccttgcaggaatccctcggatgcgttggtgtccacatccgcgaccgcgccggcagtggccacgccgatgaatccgccgacgttgttgcggccttccaccttgcgcaggttggagacgttggcaccggccgccttgtcagcagtggccccatcggcaagcttctggccgttctggtcgagatcgccccagatctggccgccgaccgcgagacccacgtagccaccggcgttgccggtgccgtgcgtgatgtcttcgccggtggccacgaccttcatacccttgcggtagccggccacgctcgaggatttgatgactggcacgaatacctgtgccacgtcgagcatctgacccagatcaagtttgatgcctttgtcgccgaatagttggatggagccgaacgaggatgccgagccggattccatcgtgcccgcgtagccacctgccgcacgcatggcggagacggtcttgacgtccatcgactggccatcggtgatcgtgccggtgcgcatcaggccgacgtgtccgccggcgacgccggaatcatgcaggttcgcgccggtccgatactccgcacgtcctgcgacgacgttgaatccgaagatgtaggattcgaggaacttgtccagggaatcctggtcggtaacagagcccgcaccatcagccgtggtcacatcggtgaattccttgccatacgcaccgtacttgccgatgttgtcgacccacgtcttccactggtcgtagctcatattgcgcagcggaccggtgaccttcgtgtgctcctcagtcgggtagaccacggacagcacgccggcgaggttgccggccttgatgagaccgccgagcaaggagagcgaaccgccttcagcggtatcggccgcttccatgaagccggtgtagccgccggcgatttcggcaccgtatacgctgcggatgcgcgcggcataggctacgcgttgcggcccgttgtatttgccgtcggtgttctcctgcttccatgctgcggtgttgttgccccagatatggccgccgcggttacgtcccgcatagccgccggccatgccgcggcgtgtggtcgtatccgatgccgcctgtgcgcgcaccgcgccgccgcacactgtggcatcggtcgagctgttgcgaatcgtcggcacgaagtcctgcacgagcgagagcaggttgtcgaggttgacgagcttcttgagcacgctgccgtcgccgagtacgtttgccacggctcccggctgcatggtgcccacgtagccgccggccgaaacctggccgatgatgtatacgaactcatgcgagctggagtcctggatatggccgccttcgatgtctccggcgaagccgccggccatacccagtggatcgggcttgttgttggcgttcctatggtctgccgtgccggccagcacggagtatccgccgatgccgccggtcacatcggaatgttcaatcgtcgagacgacgacatccagcacactgagtacatcgttgagattgacgttctggtcgagcaggctcaagccgccgcccacggccgccgccgagccgatgtccattttgccgatgtagccgccggcataccgagcggcggtgactgcatacgagctgtctttgctcagataggtgtcgtcgatggatccggtggtttccagattcttcggtgccttgacgtcggtgtggcgcagttgggtcacgctggaatgggatacctgcacgccggaaccgtagccgatgtagccgccggcggaaccggattgcgtatcggattggtcaagtcgggtggcggagacggtgaagccgggatcgtccgggtcggaaatcttgttgccgctggtggtctccacggtggtggcatcggaatgcacgcccgcgtaggagatgaacggcacatagccctgcaccacctgcagcaggttggcgagatccaccgtaccgaatttgccgagcaggctcaggccgccgttgccagccgaagcgagtgcgccggaaacgaccttgccgccgaaaccgcctgcgtatgcgccgccggtcacatggtcgaggttgacaacggccacggggttggcttgaacgcgggactgcacgtctgccagcgttgagtcgttctcgagatcagtttcggagaactgattgactttgccgctttggaagtttcccgcatagcctcccgcgatatccccttcgacgtaaccgccgttgacgtacgtcacggtggtatacgtatagcttggaatcagatacggcatggcaccgagcaggtcgttcacggacagcagtccgcccttgatgaggttgtccaacacgctggaatcatcggcgttgctaagtgcgtcagcgaggccaccggtggtggagaagcccacgaagccacccgcgatgccatcggatgtgctggtatcggccgcgaccgacttgaggttcgtcacatggctttcgcgggtcttggtgctgttggcctgaccgtagaaaccgcccgcagcgtaatcggtggtctcgttgttctcgttcttgccggtcgccttgaccgtgaatccgttggcgatgccgttcacattcgatgaagtgactgcaaccgaagaatattgggcaaccgatagcagaccggaaagcttgataagcccaagcacattgagcccgccggcaccaacggcgtcgcctggtccggagaagccgatgaaaccgccggcttctcccttggccgtgaccgtggccagattggtaaggttcgtgttggtcacgtcaccaccggtggcgcatccgatggcaccgcccgcatagtatgaaccggccttcaccgtcaaaccggatgccggagcggtgacagacatgttctccacggtgaacgcggcaaactggtcgaacttcttgagcgtggcgatatcgccaattttcaccacactgttgagcaacccagctaccgttgtcggttgcagattgccggcgatgccacccgcgtaggagcccgtggccgtgaccgattcaaggccttctatggtggtggagcgctgctgggggaagtcacgaggattgttgtacttccagaacgtaaggttcttgagatgatcctgtgaggagtcgccgatcaccgtgcccgaaccttcgcccacgagaccgcccgcgtaatcgccaccagccttaacggtgagggagcccttcatctgcgtgccgagaatcacggagggattcacaccgacgatggacagcagttctcccgcaccactaccgctgccgctcagcaatttggccacagccttggtgagttgtttcagcagcgatgcgttcgcggcatcgtccgtgccgagttccaggccccatcccacggaggcaaatccggtgaatccgccggcatgggatttatcagtagacacggcagccgtggctgaaatcgtattattgaccgcgtaggcattggccatcgcgccgctaaatccaccggcatagtccgtggcagatacagtgaccttgccatcgccgtcgacggtcaggttgctgttctcgatgaggctctgcggacgcagcgcagacagcaaatcaataccaagcgaatcgagcagaccacccacgttgccgttgcggcttactccggcgaagccaccggcgtattgcgttgcctgcacggtgaaaccattcgtgctcgtcaccgaagagttctcaatgattgcaccaatctgcgcaccgacgaagccgccggcctgcgggttgtccttgttgccgatcaccacgttctttttgaacccgttcaccgaactgttcgagataaccgggttgtagtagccaaccggaatcaaggcattcagcccgagcgtgccggacagcaaccagtccaccagatcgcccagcccgaggaatgggatgacacccaagatcttcgagagtacattggtgagcgttcccacgatgccggagaccgcatcgtatcgggttgcgccctcaacatatcccacgaaaccaccggtcatacggcttacgctggataccgaaacatccgccacttcacaatccgtgaccttggcatcgccgtaaatacggccggcgaacgcacccgtggcgagattggagggattgtctttgtgcagggtgagcagacctcgaagattgaggccaagatctacttgtccgaatgtcagcagtttcaacgccttaagcagaagatccaaaagtccacccactgccgaagtgagcataccgagcaaggtcgccggaatatacgattcactcgtatgattcgccaccgacacatcctgcagcttgaggttcgacaccacggccgtaccggcgctgcccagactgttgctgttcatcacggtcttgttcgtgatcgaggcgaagaagccgatgccctgctgcttgctgacatccagctggtcgcctttgacattagagaccatatctttctgattgacgaccacatggctgatgaccggccgagctgcggtagcgtgaaccacgcttgcgccatcggcaccaacagccttccacaggctggctgcggtgtcgccgtcattggagaccgcaccgagcatagtgccggagaacatgagcggagtccactcggtgttgttggtatctgccgcgttcttggacaggtcgatgtcacggaagatcaggtagttggcgtctgcggaataggtcaggccggtgttggcagcggagtagtccgtttgcgtgccatcagcacccacgccgtaatacttgatgcgggtattaccagcgtccactttcgtacgacatatcgccagcgaattgtcatagtcggaggcatcagcatcgcgcaaagtatctgaatcggagagatcggcgtcaccggcgtattcggaagacggcgtgccgtccacccactgataattgggtccttgtcgcatgcaagtctgcgtgaccttgttgatgcggccaataaccttcttgccggaaccaatcgcacgcagctgctgctcgttaccaatcaggatgtaggtcttgccgttgatctccttggtgacctgaccctcaaagtcacggccgccaagcgccgtcgcggcgacctgcacattggccttcgccggcgattgatccgtcgcatttgaggaatcgttcttggcatcttgagaagaagcatcgtttggagcctgcgtttgggctccatcattggcggaattgccagcggcagcttctgctgagtcgtccgccttattgtctgtcgcaccatttgaggattcggaagaatcaccagtagtagaagatgaaggagatgaatcctgctgtgcgtcttgattcgtttcggaaggtgttggcgcaccgtttgatgtattggcctcttctgacgtcttatcgtcaacgttgacattgcgagcagaaggagcagctacgacagtattaccccccctcctcagaaattacggcattaggagagctactcacatcgtctatattctgagcatatgctgcaggcaccatgcacacgatggacaaggaaacagcaataaccgaagcaaggcaacgcttcaaggcatggctctgccgtccagattcctgttctgttcctccgttaaacccgcaacggacgaacttcaatttcgagctcactgtttcccctcatagattcgcaatcctcttttcgggggttactgcatataatcataccccctttctaggaaaaagttgtcgaaaaactagaaaatgttcatttgcggggccagttagcgtacgttttctaggcaaaaagaaaagccccgcagctatgcagggcttttccaacgaggtcataagagaggaagagaataacctcgtttaatggttgacgaagcgattagacctcgccaagtatctattagttcagacgcagctcagtcgacggagcgaacaggtgcatcttggccgggtcgatcttgatcttgacggtcgcgccaaccttcggcagcgcacgcggattcacacgaatcgtggtgagcttgttctggtcggacatgacctgggcagcctcagctgcggagccatcggtgatgatgttgccgtagatgtagccatcggagcccagatcctcgacgttcacaaccttcagggagaaggcgttcgggtcgtcagccggggccagaccagcgtcctcaggacggaagccgaccacgatctggccgttgtcttcggcggtgagcttgttgacggcctcagccggcaggtccacggtgtcctcaccgatcttcgccttgccgttgaccaccgggtgggtgttcaggttcatcgacggggagccgatgaagccggcgacgaagacgttggccggacgatcgtacagctcagtcggggcgccgacctgctgcaggataccgagcttgatgacggcgatgcgatcgcccatcgtcagggcctcggtctgatcgtgggtcacgtacagggtggtgacacccagctggcgctgcagagcagcgatctgggtacgggtctggacacggagcttggcgtcgaggttggacagcggctcatccatgaggaagaccttcggctcacggacgattgcacgacccatggccacacgctgacgctgaccaccggacagagccttcggcttgcggtcgaggtactcggtcaggtcgagaatctcagcggccttctcgacgcgcttgcgaatctcgtccttcggagtgccggcgatcttcagggcgaagcccatgttgtcggcaacggtcatgtgcgggtacagagcgtagttctggaacaccattgcgatgtcgcggtccttcggctgcatcgtggtgacatccttgccaccaatgaggatgcggcccttgttgacctcttccaggccggcgagcatacgaagggtcgtagacttaccacagccagaagggccgacgaggacgaggaactcgccatccttgatatcaagattcagatcatccacggagggcttatcgttgcccgggtagatacgagtgacgtggtcgaaaacgacttctgccataattactaatcctttcagaggcaggtacgtgcctcacgatccgttgtaaagggatttgttctttactgtgcttccgccctcgccaccgacgtacaactttgctttcggaaactgcaagcttcagcgtttacttttttccggttcagtgaaggttctcttcgttgagccgagaactactatacacggaccgtggaccaaggcaagtggcgtgtctgaaatgtagttaactttatggacgtttctgggggtgttgtgtggttcggcccatgacacgcctgtttctcgaacgtgcgaaccggcacgcccgacgtagagcaggtctgctcttcccggactgatggattccatcagtcgccgactaatgcgacacagactcgaaggtgacgccgttgcgggcggctttgcgctcggccttgcgctcctcggcgtcttcgatgcgctggatgcgcagctggcgccagtcctcgcgcatgtcgcggaaacggtcggccagcgttacgtcatcgttctcggcatcgccatcagtactgctgccatcggccttaccgaacgtgccatcggccaccttggcgatgcccagcttgagcagtccgagcaactcacgcaacgtttccggtacgggctcatcgccctcatcggcggacttggtcaggccctcgatgcggcgacgaagcgcgtcggcgtcctcgggatcgatcttgagcccggcgatcagcgactggcgcatggtctcgtaatcgaggttggcaaaaaaattcagctgttgcagcgtcatgaagcccttgagctcggggaatcggtggacgatgtattcctcgcggtcgtcggcggcgcgggtccagtcgcgggtgagctgcggatcccagctggcggtaatcgacccctcgcgcatgcggtagtggtacagcgccttgggcagacggaccacgcgcgtggcctcgccgatcacgttgcagatacgggagagatcctcgattttgcgacccaccgggaaggagaatccggtgccctgataggtggaggcgggtgccaggaaggcccagaaatagccgtcaatctcagccttgacttgctttttgatgacctcgaccggggtcaggacctgcacctcggtgaagtcgttgtggcgatagttggacagcagcggcttgttgttctcggagatggtgtcgaactggaacatcacgaggtcggcgtcatactcgcgcatggcgttcaggcagtcctccaccaacgtgggtgccacggtgtcgtcggaatcggcgaagtatatgtacgcgccgatagcctcagcgataccggagttgcgggcgtcggacaggccgccgttgggcttgtgaatcacgcgtatgcgcgggtcgcgggcggcccaggcgtcgcacatggccgggcaattgtcgggcgagccgtcgtcgaccagcagaatctccagattggcgtacgtctgcgcggcaacagacgccacgcattcgtcgaggaacttctcgaccttatataccgggatgatgatgctgaccaacggctcctgttccatatctccagcgtagcgccgccgtgcgaacgcggcggcgctgcgggttcgcggaccgcgaaacccttagaagtcccagtcgtcgtcatcggtttcttcggctttgcccatcacgtaggaggagccggagccggagaagaagtcgtggttttcgtcggcgttcgggctcagggcggccaggatcgcggggttcacatcgcaaatctcagccgggaacaaagccgggtaaccgaggttcatcagcgccttgttgccgttgtagcgcaggaacttctcgacgtcatcggtcaggcccacgcgatcgtacagcgactgggtgtactccacctcgttgtcgtacagctcgttgagcaggtcgtacgtgtagtcctgcagatccaggcgctcggcatcgctcagctgggcgatgcccttctggtacttgtagccgatgtagtagccgtggacggcctcatcgcggataatcagacgaatcacgtcggcggtgttcgtcagcttggcgtgcgcggagaagtacatcggcagatagaagccggagtagaagaggaacgattcgagcagggtggaggccaccttgcgcttgtacgggttgtcgccctcgtaatagtcgagcacgatctccgccttcttctgcaggaactcattgttctcgctccagtcgaatgcggcatcgatctgctcggtggagcacagggtggagaagatggacgagtagcttttggcgtgcacggattccatgaaggcgatgttggtgtacacggcctcctcgtgcggggtgagcgcgtccggaatcagggagacggcgccgaccgtgccctggatggtgtcaagcagggtcaggccggtgaagacgcgcatggtgagcgtgtgctcgtcctcggtcatcttctgccagctggggatgtcgttggagacgggaactttttcgggcagccagaagttgccggtcaggcggtcccagacctcaaggtctttctcgtcttcgaggcggttccagttggttgcggagacgcggtcgatgagtttcagcggtttgcgcggaatggagataggtgccatgagtagtgttccttttactcgttgtcgttatcgtcgttggatttgttttcgaactcctccggcgcggtcagccggagcagtgctctatagacggttcgtgacattgttggttccttagatggtggagcccccctcagtccgcttcgcggccagctcccctctctgaggggagctgtcggcgttagccgagtgaggggagtaacaacggctctctggttgttcaatgcgtgcggagaccgccgtctgaggccgaaggcgtacgaaggtacgtcgagtgccgaagaaaggcggtatacgctccctcgaacgatcagagcatgcaggagacgcagccttggacctcagtgccttccagggcttgctggcggatgcggatgtagtagagggttttgatgcccttgcgccaggcgtagatctgggccttattgaggtcgcgggtggtggcggtgtccgggaagaacagcgtcagcgacagtccctgatccacgtgctgggtggcctcggcgtacgtgtcgacgatggccttccagccgatctcgtaggcgtccttgtagtacccgaggttgtcgttggtcatgtaggcggccgggtagtacacgcgcccgatcttgccttccttgcgaatctcgatcttggaggcgatcgggtgaatcgagctcgtggaatggttgatgtacgagatcgagccggtgggcggcacggcctgcaggttctggttgtagatgccgtccttcagaatcgcgtcgcgcagggcctcccagtcggccgcagtcgggatcgcgatgccgtactgttcgaacagcgcacggacccgttcggtgcgcggagtgagcgaacgacgaccatcggtgtacttgtcgaagtagttgccctggccggccggcttggcgtagtcgctcgtagcgaagctggcgaacgtgcggccatgctccacggcgagcgcgtgcgaggcacggtaggcgtggtaggccacggtcatgaagtacatgtcggtgaagtcgaggccctcttcagaaccgtactggatgccttcgcgggccaggaagccgtgcaggttcatctggccgagaccgatggcgtggccctcctcattggcgcggcgaatcgaaggcaccgcgttgatgctggtgtgctcggccaccgaggtgagtgcgcggatcgccgtctccaccgtgtggcccaagccgccatccatcgccttagcgatgttgagcgaacctagattgcaggagatgtcgcggccgacatgcgcatacgtgaggtcctcgttgtatgcgctcggctcctgaacctgcaggatttccgagcacaggttggacatggtcacgcgaccttcgatcgggttcgcgcggttgaccgtgtcctcgaacacgatgtacgggtagccggattcgaactgcagttcggcgatggtggtgaagaacttacgggcgtcgatgtaggtcttcttgatgcggtcgtcggccaccatctcgtcataatgctcggtaacggagatgtcggcgaacggcttgccgtacacgcgctccacgtcgtacgggctgaacagggccatctgggccttctgtttggccagttcgaacgtgatgtccggaatcaccacgccaagagccagcgacttgatgcggatcttctcgtccgcgttctctcgcttggtatccaggaagcgcaggatatcagggtggtgggcgttgaggtacaccgcgcccgcgccctgacgtgcgccgagctggttggcataggagaaggagtcctccagcagcttcatgaccggaatcacgccgctggactggttctcgatgtgcttgatcggggcgccgagctcgcgcaggttgctcagcagcagggccacgccaccgccgcgcttggagagctggagggccgcgttgatgccgcgcgaaatcgactccatgttgtcttcgatgcgcaccaggaagcagctgaccggttcgccacgctgggccttgccgagattcaggaaggtcggggtggcgggctggaagcggccggcaagcatttcgtcggcgtattcgatggcctgctgctcattgccggcggcgagctccagggccacagcggcgcaacgctgcgggaagtcctcaagatagaggcgaccatcgaacgtcttgagcgcgtaggacgtgtagaacttgaacgcaccaaggaaagtgccgaactcaaagccggcggattccacgtgctcgtagatgcggtcgaggaattcagcggagtactggttgaagaccgcagggttgtagtactggttgctgatcaggtattcgagacgctcggcggcggaggcgaaccgcttgctgttggtggccacgtgccctgtcacgtattcgcgttcggcggccttgtctttgtcgaactggatcttgccgtcggcgtcatagaggttgagcatcgcgttgagcgcgtggtaatcgtgcgccgggtcgtactgttccgctgcggtgtcggcagtattgtcgagcggcaggccggtggcggtgaggtcagtcattggaaatccttggaatatggcagaagtgtgtttactcagacagttgctcccctcagtcaacttcgttgacagctcccctcggagaggggagccaatacctcgagggggtcaagatttactgttcggtgaagaagcggacgaggccgtttcgcacggcggcagtgtcttccggggtgcccatgagttcgtaacggtagaggtagggcaccttgcatttggcggcgatgatgtctccggcggcacagtaggcctcaccgaaattggtgttgcctgaggcgatgacgccgcgaatccactcgcggttggctggatcgttgaggaagcgtttgacctgaatcggcactgctttcttgaccacgccgccgccataggtgggcaccatgatgacgtacggttcgcggacgtttagcgccggggcggcggcccgcaacgggatgcggtagacgttgatgccttcgtcctgcaaacggcatccggccacgaaccgtgcggtgttttcggaggccgacgagaagtagaccaatgcgccgatcgtcttgccttcggccgcgaattcgggctggctcagactcacgcggacaccgtggcggcggcgcggttgtcggcggccacctgctgggcgacttcgcgaatcaggtcggggcggtagccggtccaggagttgtccggcgtgatgaccaccggagcctgctggaaaccggcggcctgcagctgctcaagggtggaggggttctgcgtcaggtccacggtttcaaacggcacacccagcttggtgagctggcgcttggtggcatcgcactgcgggcaatgcggcttggtgaacacggtgacggtcatggcgactccccttgatgtggttctgatgaacagtgaagcgaaggccatattacagcggtgtgatttgaaatcaaggcactatatgtagtggcgcgtgtcacataacaaacctagatatagggtttttcattgatattccgccattcccatgcacccccgaaaatcggcgtgcagcgacccgcccaatcacatgtggcattgttcacatttgcgtttgaaccgctcttcgactgatcctcaaccgccctgcaaccgccatcttgagtttcgaggggctgttttgaccctttccggagatctatctccgtttcgaggggctggtactcaagtaagcgcatccccaaaatggcggaatgacggtggggcgaagccgtttatacccgtgttctagcgggccaccagcccctcgaaacgggagtaaacctctacggaaggccaaatcagcccctcgaagcggagaacggatacctcggcaccccgtgtggagccagaaggcccggccggatgtccaaacgagcatccggccaggccttaaaagtagttgttcagttatcagaatcgatgcggcgcgatactactccgcgtctttacggctccaacagatcttcgatgcggcagccaagcgtgcgggccaaagcgagcacggtggagacggcagctttgccaaggtctttgcggcgctgctcgtacatttggatggagcgcagggtaacgccggagcggcgggccagcccggattggctgagtccggcgcgcacgcggatcgtgtgcagccgggagtcgccctcggtgcgattatgggcggcccgctcgtcgtacacgtcgacgaatcggctttcgtcggcttcgtgcaaagccgggtaaagtcgcacgatatcgccgagcgacagcacatcgagaatgtccgagaaccgcactcccctggcccattggcagtatgcgagtacccatccggcccagtattcgggtgttgagccggcgcgcagtgcggctggcggcatatcgagaatgcgcgcccaaccggtttgccgcatgatttcggccaccagctcctcgccggacatgccacacacgtatttgggcgtgcctcgcccgaaaagcgcggccgcctcggaggtggcgaagaagtccatgaataggccgaccggcaacccgcaatcgttcagcgcataatcgaaggcgccggccaagttggccatggcgtccggcaagtatgtctcatcgtaggcggtgatcatcgttggtcactttctcacggatgatgtcgcgcatgaacaggccgtcgagatcggcttcagcgctgttgcgacggtaagcttcacgagccgtgcggtcgcgctcgttgcgcaatacgtggtaggtcgaagcgcgggcgatttcgcagccttggaaccgcagcgccgcgaatgcctgaggactggtgagtacgatctgcttgccgagctcacccaaccgcatcgcctcggcgagttggtcgagggaaatcgcgttattgacaaaagcgcgggcgaacgagaaatacgaatcgtcggcacgatatccgacgatgacgtcagactgactggtatccggcagagacacttgtttcagatattcgatgccttgcgcggcgacggtggtggtcggctggaaacgacggttttcgaccagcagggccaaccagttcaggatggtgtagggcaactgggacaggtccaggaaggtgagcccgttggtggccaatgtgtaccgattcgcgaaaccgtcatccagtcccgcgcacgcccattccttggccagctcgacgctgcgcgtgcaatagaatccgcggccataatcgttgttcggcttgaccagcccgtattcaggatgcttgatgacatgcgaagagccatgccacagttcgatcgatgcggtctccattggccggctccttctctctctccttacatattcttgattatatcactgtggtgatagtcataagggaaatacgagatgaaaaataccgctgtatacgttcgtacacaacgtgaaatgtatacgaacgtatacaacactgatgtccggagtcatgctccgcagtggcgcagcggacgcgccactgcaatcggaatatgggactgaagacgtggaagaagtggacggactggccgctgatggtgctgtccgtggtgtttctggtggtgtattcgtgggaaattctctcccgcacgcatatcgcgctgtgtgaaaccgtcatcaacgtgatctgggtggtgttcgtcgtcgattatgtggtctcgctgtggttggccgacgatcgctggcggtggttcaagcacaacctgttcacgctgctgaccatcgcgctgccgatgctccggcccttgcgactgttgcgtttgctgaccgtgctgcacgtgctgaaccgcacctccggcatggcggtgcgcgggcgcatcaccgtatacgcggtcggcgcggtgggaatgctcatgtacgtgggcgcgctggccgtgtattccgtggagcgcggggcgtccggatccacgatcaccgacttcggcacggcgttgtggtgggcgttcgtgaccgtgaccaccgtgggatatggcgacttctcgccggtcaccttccaaggcaagatcattgcggtggtgctgatgttcaccggcatcgcgttgatcggtattgtgacggccacgctggcctcgtggatcgtggatcaggtcaatctggagacggatcggcgcgaggacgctcgggagaaggaagtggccaaggaagccgcgcaagaggctattgcgacatcagccaatcccgaaatcgacctattgcgcgaggaagtgcgtgagctgaccgctacggtagccggtctgcgcaccgaacttgagcgacgttgattggcgaagcgggacaaacaacgattctgccaagaaggtccgcgtcagttgttgtcaccgcggattgcggcagaatcattgtcgccacggctgttttcttcagtcggctcaacccaacttttgataatttttatttttttgatatttttgataatttttattttaggttgattcagcgaggaggcggtccacatgaaggcaaaggaaaacccattcaagccaacggcaggaggggaaccgcccctgctcatcggccgaggcaaagttatccgcgatttcgagaaaggtctcgataacggagtcggtgccccagggcgcattatgctcgtcaccggcgctcgtggaaccggaaaaaccgtgatgctcactgtgttcggagaccgggccaaagcgcgcagatgggatgtcatcgaagaaacggcctctgccggactatgcgaacgccttgttgatgccttacgaaccgggcgaggggcccttgaccacctcactatccgaccatcgttgacttttgctggagcgggcatcggcctcggagaagccgaactatccccgaagcgtatgcccgaaacgttgagaagtgccattgccggacggttggatgcgcttgagaagcgccatgctgggttgcttatcaccattgatgagactcaagcggctgagcgatccgacatgattgccatcgccactgccatacagcatcaaatcagggaacgacgcaatatcgccatcgtgttcgccggtctcccacagatgatttctgatttgttcaatgacgaagtcatcacgttcctacgtcgcgcgaaaacgaacatactcacagatattcctcttgatgaagtgcgcgatgctttcgccacaacattccgcgcctccggcatgtccatcaccgacgctcaattaagcactgcagccaatgtgacagccggatacccctatatgattcaactggttggctaccatatctgggatgccgcagacatgcgggactcggataccatcatcgacgctgatgttacggcaggtatcgaggaagcacgtattgaccttgataacgccgtgtgcatcccggagttgcaaggcttatccaaaaacgaccgtgagtatctcgaagccatggcagcgtcagatggtccctctcccaccgtgaatgttgcacagcgcatgggcaaaacgcctaactatgccgccacctaccgcaaacgcctccttgacgccttcgttatccgcgaaacagaacgaggcgaagtcgattttgccgtgcccttcctgcgcgaatacttgcgtcggaatcagtaatcggcacaatgcacagtatcgatatattccgttccatataatgacttttcgcattcagatacacaatggacggcctgttgagtagcactcagcaggccgtccattctatttagctattcagttatcggagacacacctcaggccttgaccggagcgtcagcgggagccgatgccgccgcggccagtttgcggcgcttgaggtacttcatgatggtcaggaccatgccgcggaagccccactcgccacgcaggacagtgttgagcagtccggagtgggaaccgccccactccataccgatgtagttgaaggcgctcatcacggcacccgcgccgccctgcttgacgctcatctcgaagggcttcaggtagatctcgcgaatcgactgctcgttggcccaggtggcgagctcgctcagtcggttggtctcctggtcgttcagcgcgaagtgcttcatgaaggcgtacacgcccttggcctgagcgccagcgacctgctgggaggccatcacgccgaacaggtagccgtcttcggagaagtattcgaaggtacgaccggcgaagtcgcggcattcgaatctgatatcgttatcgattcgatcagcggctcacgatactgcccttgcatcgctgtgccactgttgaatgtgcccggctggctcacctttgggtcaccgccgacacatccttgatgccaatggttatagagtcgcaaattcacgactggcgcacctgcccacgcacctatcctgtcatttcgagcgcataatttgctaccacatccggtcagggcaatcgaccttaatggcgtaaacggcacttctcaatacgtaaacggcatttattcttggctcccctctcagagaggggagccaagaaatatcaagctcggcctcccaggagagagccagaataatgcaccagcaaggcattaggatggagggcatgagcgatttgaacgcgttgaatcttgagcccggcgaagtggttggtgggtatacgctgatctcccggctcggctcaggagctatggggtcggtgtggcgggtgcgcgacgacggcggcaccacctatgccatgaagattctgcgcgactccctgaccgacgagtcagtggcaggctccggctctgcgtccacggccctgcacgaccccgacctcaagcccgatgtcacgccgcgcgagcgcctgcggcgcgaggccatggccttgaagaagatcaatcatccgggtgtgtgcggcatcgtggatatggaactcgacgatacgttggcgttcatcgtcactgaactcatcgagggcaagaatcttaaggatgatgtggccgccaatggccggtatgtgggcgacgatctggaacgcttggcccgcaagctcatcgaagccaccaaagccgtacatgcggccggcatcgtccatcgcgacatcaaacccaccaatgtgatggtgtcggccgccggaccggtattggtcgatttcggtatcgcgatgggcgagggcgaaagtcacgtgacccgcaccggcctagtgatgggtacacccggattcatcgcacccgagattattgacggtgccgaatccgacgacgccaccgattggtggtcggtggcgtccgtgctcgcttttgccgcaaccggcgcgcctgtgttcggcaccaagccgatgatggcggtacttgagcgcgaggcctcgggcaacgcgaatctttccggactaccggccggcacattggctgccttccgttctgcactggacccggatcgcagggatcgttgcacgccggatcaattgctgaatgccatcgccttggatgcgttgaatcccaacgcttggcagggcgagcaggcgggaccgttcgccgcgggagccgtggctggacaaccggctgcgatcgttgccgaagccgcggaggcgatgccccttttggcgcggccggcggcgttgaccgcaataatccccgaaccatctggcgcgcggccgaggaagccgctgaggctcccaccatggccgtgttctccggcaataagggcgataacggcgatggcgaaaccgccgtattctcgccggctggcgccgctaccgccacgctgcccttagccgatatgccgccacgtccgccggccggtgcggagcaggccacgcaactgttgcccgacgctgctgccgatttcaccgacgacgccggcacgcaggtactcaccggcgcgaccacaccgatgccggaccaaaccacgccgctggccgagcgcaccaccgtactccccacgccgcagccgtcatcattcccccgtccggcaccgcccagagcagctgggatcccgcaagcaaccagcccacagcggtggaccccgccattcgcccggcattgcagcgcatcatcgaccaaaccgcccaagcggcccccaccgaaaccatggtccaaaatcctcccatgcccaatccggtggacgtgaagcgaggggaatatctgcagcgcggcaccctgccattgatcctgctggcggcgccgctggcggcactggcggcaaatgctccgctcgtggccatcatcgcggccactgcgttgttgtggctactgctcaccctggcctataacaccgaaccccagcttgagcgcgagggcaaacgcggcggcgagcgcaaaaactccgattcgtggattcgcgtggcgacttttccttggcatctggtcaaagccctgctgctggccattccccgcatactgctgctagtcatcatctatatggcgggaaccgccgtggccaccgcggctctggcactgcccgttcacaccatctcctggtatttcaccgcggattggggtattccggtgccgttgctcaatgatgtgccgttctccgcttccgggctggcgctgggcggtttcatggccatcggctggctggtcactgtgttcgccccacagtcgatgatgattcggctggggggcggcgtactgcgcgggctcaaacacagtcgcccggcgggcgccccatccaccgaagtgggtggggctccacctgctccagtggcgccggcgcccaagggcggcgggcgcggcaccgtgctgttcaccatatgggccatcatcaccgtggccttgtgcgcgatgccgattctgggcatgccgatcaactggatgccgttcgcctagagcggggcggaatctcacacatcagccatccgcacacatggccgttgtgtatccgatacgttcgttccgtcacacttttacagggaattcacctcagatcagctctgggcgcagtcctcctcaggcccggtcattatgatggggcccaaacattgaagcgattgcaaggggatagctatgtcagatccgaagcgtcaggccaagcgtgccacacgcgctgagcgccgagcggccgaggaggccgcccagcaggcacgggccgagcaggcagccaaggagcgtaagcagcagaccatcatcggctgcattgtggtggccattattgtggtgctggtggccatcgctggattcgccgtatacaaggctatgcggccgtccaacaccagcagcagtagccagcaaagcaacatgaccgcggacgaggcctatagcaagctcaagaaagtcagtacccagccggctaacgccgacgacaaggccggcttcgtaatctccaacaaagggtatggccagaaagccgagggggctcccaccgtatccatctacatggaaccgctgtgccccggctgcgcctcggtgaaccgccaactcgacccgacgctcgtcaagctgatgaacgcaggccagctcaacatcgatttgcacttcctcaatttccagaacaacaagagctccgacaactactccaaccgcgtgttcaacggtgccatctacattgccgagcatgatgacgatcccgaccacctcatgagctacctctccaacatctacgctgaggatttccagccgggcgaattgtccaattacgagccggtaaacaacgccaagctggagaagcaggccgtcaaggccggcgtgagcgaggatgtggccgccgcggcgttcagcggcaagaacgaatacctcgactggctcaccgcctccaacaactacacgatcctgcgccccgaactgttcaacagctccggcgccttctcctcccccacactcaccatcaacggcgaatactgggatctgaagcagctcacgctggcggacacgaatatggtggacggcttcctcaagtccattgggctggatgctgaccaggtaggcgtggaaggcaaaatgccatccatcggtgccagcggaaagccgatttcggtcgcctcctgatgctgcgtggccgaataagttgacgccgcgacatatgcaataccgcctgcggctcggcttaaattgaccactcgggaagtaccggtatactagtcatttgttcgcaacgatttacgcgttaagaacaatcgcctctttagctcagatggccagagcggccgccttgtaagcggcaggtcgtcggttcgatcccgacaagaggctcgtcgcgcagaaaaaatggcgtattatgtgatacgtagacttttctacgcatataattcttaccttgggtaagtactccaggagccttcccccaattatgggcttcctggaatgagggcggagcgtcccccaaccagctccgcgccttcaagggggcgggaacatccccttctctcccgccccccttttcttttctttttttgagctcagaacaatctgacgagcaggaatggtgacggtggccggtgaaaccgcagtacgggccggaacaaccgttacgatgggtggcgtaatcgttcacccagcaggaagagtatggcaatggcacggcgttggaccccgcagcggtttgttacactgcgtcgcatccgcgtaatcgcctgtatcgcggcgaccagtatcgcgctggctggatcattcgcgttcaccgcgcgtaaatccgtggccctgaacatcaacgggcaaaccacccaagtcaccacatatgcgatgacggccacccgtcttctggaggaacaaggggtggatatcaagacccacgatatcgtcactacctcgtccggcgaccagctcgccaatcatgccgtggtcaccgtacagtccgcctaccagaccactatcaacatcgacggcacgtccgttcccttctggaccgtggccaccagtgccgaccagctactgggatttttcgaggaaaaccagaacaacgccgcgaagatcaccgtcgacatcgacaatgtgtacaaccagctcaccggcggactggtcatcaatcaggatggcccggtcaccgtcattgcggacggcaagacttccgtggcccccaacggcaaactgcctgcggcctccattcttgactccaaaggcatcgtgctgaacaaagaggaccgtgtgagcgtcgaaaaggacggcgataccactatcctgcgcgtacggcgcgtgacgcatggcgaggaaacgcgcacagccgtagtgccatactccacacaaaccatcatcgactccaatcttcctgaaggccagtcggagatccgccagcaaggcgtcaatggcgagaaaacccaggtgtataacgtcacgtatgtcgatggcgtggccgaatcggagacgctgaaatccgaaaccgtcaccacgatggccatcgaccagatcatcgccgtaggcgccgccaagtctgataccgataaaggttccgacaaaaaatccgactccgccgataacggcaaggccgattccggtttcaacaatcagcacgagtcgtccggtaacaatgccaacaacacaggcgacaagaacaacagcagctctggcaacaacacgaacaccgataccaacaacaatgccggcaacaccggcggcaacaactccggtaactccggtaacaccggcaattccggtaacactggtaattccggtaacaccggcggcggtacgaacaacaattccggctcttctggctccgattcaggcacaaccaccacgccctccggccgcctgtggcacgccaccgtagcccaggctcaggcctatgccgccggtgccgccgcgcagcgcgggtggacaggcaacgactgggattgtctggtcaaactatggacccgcgagtccagttggctgtggtatgccgaaaacgcgagctccggtgcctacggcattcctcagtcgctaccagcagacaaaatggctgcgttcggtgccaattaccgtgacgatgccgccgtacagatcgattggggtctgtggtacatcgcacaagcctacggcagcccgtccaaggcatggcaacattccgaacaagtcggttggtactgatcggttacgaagcccacaaggaacacacgcttatgaacgacaccattcccgccactggtcacctgttaggtgccgccgatatccgtcgtatcgcggccgatgccggcatcagccccaccaagaaattcgggcagaacttcgtcatcgaccccggcacggtccgtcgtatcgtacgcgaggcgggagtgaccgctgccgatcatgtcatggaagtcggccccggcctgggatcgttgacgctggcgattttggaaaccggcgccaccatgaccgcagtcgaaatcgatccgccgctggccgaacgactgccgggcacagtcgccgaattcatgcccgaagccacgtcacgactcaccgtcgtcaatcgggatgccttaaccgtcaccccggagaacgtgcctgatttcagcgatgacgcatcgtttacgctggtcgccaatctgccgtacaacgtggccacgccgattctgctcacgctgttggagcgtttcgacaacctcggctcgttcttggtgatggtgcaaaaagaggtggccgacagactcgccgccaagcccggttccaagatctacggcacgccgagcgtgaagctcgcctggtatggcaccgccgaacgggtgggcaccatcggccgcaatgtgttctggccggctcccaatgtggattccgcgctcgtcaaattcacccggtatcaggccgatgacccggctgccccgggaactgcgaacagcacagacgacggcacacaacgggaactcgtatttcgtctgatcgatgcggcattcggtcagcgtcgcaagaccctgcacgcggcattgaagaccattgcgccctccgaggcattctccatcgccggcatcgatccgacccgtcgaggagagacgctcaccatcgccgaattcaccgctctggccaaggccatcgaatcgtgtggagagggagatgaggcacaatgagtccggtaatctcacatccacgctcagccgctgcccgacatcagtccgatgagctctcccccatcaccattacggtggattgcccggcgaaaaccaatctcaccttggaagtgggacctgctcacgacgaatggggcggacgccacgaactggacaccatctactgcgcaatcggcgtatacgacaccgtcaccgcaaccgccaagcaacccggagcaggattctctctggagctcgaaggcgcttatttgggcgacttggcctcctcacgcagcgacatgcgccgcaaccatgcggtactggccctcttcgccatggcccaggcggccgagcgcgagccggatgtggcgttgaccatcaccaagcgcattcccgtgggtgccggactaggcggcggttcagccgacgccgcggcgaccatgctggcggtcaatcgtctctgggagctgaactggcccatagagcgcctgcgcaccattgctgccacgttgggcgcggacatgccgttctgcctgaccggtggccttgcatacggcaccggtttcggcgaacgcatcacggatatcgcccccggcagccgcgatgagctggcgctgatagaacagggattcagcggcgaagtattggtcggcgcataccagtcgcaactcagcactcctgaggtctaccacacctttgacatcgtgggagccgcagaaggcgaccgcaatcatctgcaggctgcggcaatcagcctgcatccccgcagcgggcaggccatcgacgccgccacgcaggcgggtgccagccatgcattcgtctccggatccggcccctcagtggtcgctttcgccgccgacgaggcagcggcacaacgcattatcgaggtgtggcgcgatacagctgtggtcgatcgtattattcgagccaaatctcccgaacaccccaatatcagcgtcagacagtgacgctaaggtagcaaccagccacccgacccatgaaagaagtccaccgatgacgtatcaggttgatgaacgtgaagcccgcaaggcgtacgtgcgccgccgccagaccatcgtcttttccatcagcggcgcggtattggcagtagtgctggtcatagccctactgttcaatttccacgttttcggcctcggcgaagtggagactccggccagccagccgaattacggcaacgcggcgccgtgcgcggtcaaggacagcagcggcaaagcgcaatacgtgtccaacgcttcggtcggcattcgcgtgatgaacggcacctctcacggccaattcgccaaggccgtgggtgaagctttggccaatcgtggattcagcgtgcagaaaatcgataactattccagcaccgacgttgaacgcaccaccatctacttcggcaagaacgccattaatcaggcgtatacgctgatcggcaatttcaccgacgccaccatgatcatgacggctcgcgaggatcagctcatcgatgtggtcatcggcgccacgttcaacgatctgcaggacaccaactcctccccgcaatccggtaagaccatcaccaatatcgagggttgcaaggccgccgatagcatgaccaagctgcccgccgacaccaaacacgacgcatacacggcgcagtaaggcgcatacagcttcatcttcgcgaaaaaccgtacgctgacacgtattcagcgtacggttttttggtatcggactagtatcggactactgaatctcggcgtaccagcgcttgagttcttcgacggccacatcgtggtccaccggaccgttatccaagcggtattccagcatgtgcttgtaggcgcggccgatcatcgggccgggctccaggcccagcaactccataatttcgttgccgtccagatccgggcggatcgcgtcgaagtcctctttcttcttgagttcgcggacgcgctcctccatctcatccatggcctgggagaagatcatcgccttgcgtttgttttgtgtggtggcatccgcacgcgtgagcctgttcagccgctcatagaggtgcccggcatccttgacataccggcgtacggccgaatcggtccacggctcgtccacatagccgtggaagcgcaggtgcatattcaccagttccgagacgtcctcgaccagatggtggtcaaaacgcagcgccttcaaacgcttgcgggtcattttggcacccaccgcgtcatggtggtggaagctcaccttgccgcccgactcgaaccggcgggtcttcggcttgccgatatcgtgcatcacggcggccaagcgcagcgtcaggtcgggggcgggcaccgggccgtccgggccggtttccagggcgatagcacgttcgagcacaatcatcgtgtgctcgaagacgtccttgtggcggtggtgttcgtcgatctgcaattgcagggccggaatttccgggaagacgatgtccgcaagaccggattcgaccaacgcctcaaggccggcgcgcggacggtcggagagcagcagtttggtcagttcgtcgcgcacacgctcggcggatacgatgtcgatgcggtcgcgcatcgaggtaatcgcctcggccgcgtccggcgcgatacggaagcccagctgggccacgaatcgcacggcgcgcatcatacgcaacggatcgtcgtcaaaggactgtcgcggatccaccggcgtgcgcaacacgcccttggacagatcactggcaccaccgaacgggtccacgaattgcaggtcgggcacgcgcagagccatcgcgttgacggtgaagtcgcggcgggacaggtcgccctcaagcgtgtcgccataattgacctcgggcttacgcgagtccggatcgtacgtgtcagagcgataggtggtgacctccaccttgacctcggtgccgtccgggcggcggcgcatggcacccagcgtgccgaacttgcgccccatgtcccagaagccgtcatgcccccaccggcgcagtatcggctcgaactgctcaggccgtgcggatgagcagaagtccaaatcgtggctctttctatggagcagcaaatccctgaccgggccgccgaccaatgccagctcgtaaccctgttcggcgaacagtcgaccaagttcgatggcttcaggccatacttcgaaatccaatgggcaccttcccgcgtgcgacgtttttctgccctaccagcataccgttaccccacctgcacacggggttgagtaaggtggagaatatgattacgcccgccgaccttgcccgcatgctggggcaaacaccagattcggcggatagccatacccaagaccacctgctgtatacgtccgaaactccgcatcattccgccgattcgggcgattcttccgatgtcggcggcaccgcgagccactccaccaatcaggccgttcatcaagacgaagtagacgcagtaccgactgcgcaacattccggtgtgcctggcacacccgcaacgcccgccacacccgaaccatccgaatccgaaatatcggacgccaccagcgacatgcccgcaccgaagccgatgatgcccacaccggccaccgtcttcggcatgcatgccaccgtcaccatcgccactaccagcggcactatcgaggggcaggctgatggtatcgccggcgaggccggtgccgagacgattgccgaggtcgagccgattatcgccacagcacaaacgtccgtaaccatcgtcacgaacgatcccgcggcgaccgctcacgcggccgtagatgctgccgttgcggtcgccaaggccgccgccgcgcacaccacagcgataccgactccgcgcgacgtgctgatgccgcctgcggcacgtaccgcaccggccgcaacgccggtcaccatgccggtctcagcgccgtctgcagcaccagtgaggcccgcaacgtcagcgcatcccacgccggccacggtcttcggccggcacccgtccggagatgttgcctcgccggaaccggcagtgccggtagaaccggtgacaccatccggcccgactccggccatgatgccgcaacgccgtacgtcggacggtccgaccacattcgcttcactggatgcccaggaactgccggtcgtacgcgaatattcggcaggcggtctgattttcgatgaccagaaccgcgtggccattatcgcccgtcattcccgctccggccatctcgaatggtgcttgccgaaggggcatatcgaaaaaggcgagaccccgcagcagaccgctgtgcgcgaagtgcatgaagagaccggcatcctgggcgaggtgatcgattccatcgccaccatcgactactggttcaccggtaccacgcagcgcgtgcacaagctggtccatcacttcgcgctcaaacagaccggcggtgaactgacggtggaaggagacccggatcatgaggcggaagacgccatctgggtgcgttttgaagatttggatgacgtgttgagctatcccaacgaacgcaaaatcgcgtggctctacgccaggaagaagaacaggcaggcaaacgagtgaacctacccggagtcttacgacattgcacacgtctggcacacgcactggcggctggcgtcgccgttgtggcgatgctggccgctccattgaccgtctacgcgaacgatacgacggacacgactgattcatccgatacgacggacgcaacgggcaatcagaccgagaatcagcccaagcagagcattgccatcacgcaaagcacccccatcgtcacctccaaatcgggctatcgtgtcaccgcggtcatcagcaatacggacagcacggccacgtcaagcggcacactgcacctgaccaccaatgcgttgttcacctttgtctcgcgcaccgatattcagaattgggccgagaacaacgcccccatcccaacccccaacgagttgggttccgttgacgtgccatcgattcccgccggcggcactgccaccgtcaccatcgaggtgaacgccaatcagcagacccttgcctccatagggagttggggaccgaaaccgctgatgctgtcgtatatcgttggcaatcagatactcgccgatttgccgagttttctgacccgatcttcggatgggctcaacaccgcgacaacaccggccatgaacctgaccgtggccatgccctacaccgccagcggctggcaggtcgataataaggccatcagcaatcgcattgccgaaaccaccacttcctcgacatcaacatcgtccaagtccaacagcacggacaaggccgacaagtccgataacgccgacgccagcaacgcggccaaagccactgatacgcaagccatatccttatccgaacaggatgccgataccgcgcgatcccttgggcagacattcgccaagcaccgctcgctgcaagtgatcgcggatcctctgtattggcgtcagtccgcagtgcaaccgtccattgccggcatcatgcagcccgccgacttcgacatcaccgcctataccgcactggacgataccgcggcctacgaaaaggccggcatcaccactgagcagtggaacgccaagcaggcggccgcatggtatgccgacggaggcgactccgaaacaccctccgcgtacgcatggcagggcaacaactgttggacgttggatgcgctgaccgcagcacgcgagcagggctatgacacggtgattgccgatgcctctttcgatgccgaccagactgaagccgtacacacaggcacctacgtggtgcatacgcctgccggcgatgtcaccgtgctgaaggagcaatcgaccttgggcacgctggccaagggccaagccaccagcacggacgcgcaggccgagtccagcgatgccggtcggttggcccgactgatcgctcagagcgcgttctaccagatggaacagccctatacatcccgatacctgcttatgacgttctcccgcaccacggaggccagctggatcgatcaggtgatgagcgccttcgagcaggcgtcttggttgaatctgacggacctgaagaccatggccaaggccgatccgtacaatgtcagcgattcggtcaatcccgacaatgccgatgatgccaacaccgccaatacccggtcggcattgagacagttggccgacagccggcatgacatcatgcgcatggccacctccatattgaggaacgagattgattccgacgaggtctcgtcgttggacccgcaggccctggcccggcaggacgccaatgacaccgcctcgcatagcaacgatccgacgcaatggattggctctttactggcgctgcatgacgatatggcgctgcggtccatgtctggctccccccagccgacagccacgcgaaaagccatggtcaaagccacgaaaacactggccagcgatcttctgaacggcgtacgcatcaacccatcggaatcaatatccgtgttcagcgaatccgcgaaaatgccaatcaccgtcagcaatgaccttccctacgccgtcagcgtgcaggtcaactcactgactgactccatgcagatcgtcacctcgcgaaccgctgacatcgatattccctcgcatagcgacgctcaggtgaccttcaccatccgcgtttccacttccggctcatcgacggcccatgtgtcgttgaccgaccgggaaggcaacagcttcggcaacacgcaggacaccgcgatcaccagtgtgatgcgcatcagtgatgccagcggcttcattatcatcggcttcgccgtgctactgggcattatcggcctgtggcggcagttccatcggaagaaggaccccgacgaatgagttcaagcgtaggtcgtaattccctgatcatggccacgggaaccgctgcttcccgtgtgaccggtcagctccgcacgattcttctcgctgcggccatcggcaccaccggattggcggccaacgcctatcaggccggttccatgattccccaatccgtgttcacgctggtgtccggcggcatcttcaacgccgtgctggtgccccagatcgtgcgcacgttgaaagaaaaagacgcccaagaacgactgaatcgcctgattacgttggccatcggcatcctattggccatgaccgtggtgatggcggcggccagccctctgcttgcccgcctgtacgtgggtagcgacgatcaccagatgatagccctgaccacctcgttcaccctgtggtgcatgcctcaggtgttcttctacggcctgtatacggtattgggtcagatcctggccgccaaagaccatttcctcacgtatgcgtggagctcaaccggtgccaacattattagttgcgccggttttactggctttattctgctgttcagcaaggccaatgaacagcccctcgaattctggaccgccgacaaaatcgcgcttaccgcaggcacctggactttgggcgtggccttccaagcgctgatactgttcctgccgctggcccgtatcgggttcaagtacaaacccagcttcgggcttggcggctttggactcaggtctatgggtcccgtggcgttaggctctttgggcgtggtgatcaccagtgagatctgcggcattatccttacccgtatcgccacatccgcaccgcagcgcgcccacgaactgacgggtgccagcctgttcagcgtggcaggcaacgcgacctatcagaatgcgtacacactgttcatcctgccctattcactcatcgccgtatcggtatccacggctatgttccccaaaatctcccgttccatcgcagctgcgaatctggatgaggcacggcacgacctggtcagcgcactgaataatgtgggcctgctcatcatgttcttcgccgccgccatggtcgtgttccccgaaccgatcatccgtgcattgcttccgtccgtctcgatggacgagactatgttgatctcctatgcgcttatcgccttgtctgtgggcattccattggggtcggcgttcctgttaatccagcgcacgttctacgcctttgaggacggccttcaccccttcctgtccgcggtgatgcagtatggattcacctcaatattcatgatcatcggcatgatggtacttcctcctgagcattgggtactcggcatcgcctgctcggtgaccctcggtggattactggcgttgccgctgacgttgatgatgttgcgccgcaagttcgaaggcaatcttggcggtcgggagatcacgaggacatatgccaaggccattgtggcggcactggcttccggagttgtggtctggctgatcaaacgaccggtagtcgcactgctcggcgcggatattcgaccagtaggcgggcacatgagctggtggtctgcgctggccatctgcgtggtgctcaccattgtgctggccgtagtatatgtggctgtgttgtgggtggtacacaccccggaactcatcagcgcctatcactcgatactggcccgtctacacaagactccggccagtgaggacgttgctgtgacagcccagccggaaaaaagtcgacgctacgtaaatcaatcctgagacggagcccgtcaaggatagccccgcacgtagaatatctaagaccaatctcgaacaccaatcacacggagccgaacgcactatgaaaccgcaactcggagacacgattctcaaccgatacaccttggtatcatcgttgcgtgaggagcctggcattcaggcatggaaagccaacgaccgtgtgctggcaaaggattgccagctgttcatcattaccgatcgcagcgctttcgccgcaatcgatgagctcgctggtcgcatcgccgccactcgccctgatcgtgtgattcccatactgaaataccgtatggaatccgacgtacttctcattgtcatgccggtggatagcggccaatgcctgactgactacatggtagataccgccaagccgctcagctacagcgccatccggtcgattatcggagaatgcgccgacgtgctgcgcgaggtcattgcggatactcccagcggcatcgtcatcacaaccgacaccgttcgagtgactacctccggtgtgcaaattgccgatgcaccatgtgccacgatgctggccgatacgtccgctaccgatctgcgcacggacggtcctgaacggtatgcgattcgccagcttgcggcattactctacaccctgctgacacgcacgccaagccaagcgacacccacattcaatctgcgtgccttgccgcaagacacccctggcgaattccgcgtgatttgcaagcgtggattggccttgagcgagcccgacgatcatacgttgccaatggctgcccttgtagaactcgatgccttgttgggtaattggaagccgctctctgaactgagcgatgctgatattgctttgccgagcgtggaaagcgattgctcgattaccaaggcgatactgaagcctgccaacgagactgatatcgtgcctattcccagcacgttgattaacagcagcagtcttccggaattgtctattaccccttccctgccggttcagacggccgccgtccccgctccgcacgcgatgtcaccggttcctctgcctgatgggtccagtactgctgacggtaaccagtctcagtctgatgcccgccgtctgtttgacttcaacctttctgacgcctgggagcacgaaaatctttccggtgaaggcaccggtgactggtacagcgaaatgaatccggcccccatcggcggtccgggtgataatactcggttgacagtgcctattgttaccggcggtatttccgatgccgccgtgggagagacaaccagtcgtattcccgtgttcgacgccagcggccgtgctgtggctcctggtgaggaatcgctgcgtgccttggaagaggagcaggcccgcattgccgaagtaagcgccattcctccgagcttcacaccgaagaatgtgccggatgacgaggttgacagcaagctgcccgatgaacatctgttcggcaaactgtcgaccaaggtcgttgccatcattgtggctctgatattggtagtggcagcggctgtttgggcagtgcatgcgttccgatcctccggagacaatcctgccgatgcttccagcaactccagtgaaggtgactggcctgatatcaatgctgacgctgtgccatttggtggcagcgagaacgcgacgaacggtggcaccactgacgattcttcaaaatcgagtgatgccactcagagcgaatccaaggactcggcatcagacaagtccaagaagtccgagactgctgattcgtcgtccaagaagaccaaggccaagaagtccggcgataaggattccagcgctgttccgcaaccgagccatgagaacaacacggcgtttacgatttccagcgccaacttcctgtcgaatcctggcggccaatccgggtacgcatactacatgcaccttgaccagccgcaggatgcgtaccgcatggttatcaccatccgcacatccggtggtaagggctatattcgcgcaaataccactggggaccccactcaaggcaagcaggtggccgaattcacctttgctgaaggtggcactactgaggtgaagttcaccaaagccgtcaagacgcaggatctgctgctgtgggtgccatcggatagcctgccgcagaaccagctgtacatcgaaaaggtggaggtcttctaatcggcatctatgccgatgactgacccaagaaggggcggtaccgttcgcatacattcgacgataccgccccttcttcgcatctggctgaatgacacggaatatcgtatggggtgtgacaatgtttcacgtgaaacataacgtcatcattatcggttctggtcccgctggctacacggccgccatctatcttggccgcgcaggtctcaatcctgttatggtcactggtgcgttgtcgccaggtggacagttggtcaacaccactgaggtggagaacttccccggattcccggaaggtattcttggcccggatcttatggatcgcatgaaggaacaggccaagcgcttcggtacaacctatatcgcagacgatgtctcttccatcgaggcgtgtgagagtgattcggtcaagccgacctatcgtgtaacactctccgatgactcccaattggaggcatcgtcgcttatcatcgccacagggtcgtcattccgtaagcttggggtgcccggcgaacaggagctgtccggacatggcgtctcgtactgcgccacctgcgatggcttcttcttcaggaacaagcctatcgtggtcgtaggcggtggcgattcggcttttgaagaggcattattcctgacccggttcggttcttcggtcaccttgattcaccgacgcgatagcttccgcgcctcgcagatcatggtggaccgagccaaagccaatccgaccatcactctgatgaccaacacagtggtgacctccattaccggcacctcctcccccacacagaacaccggtgcacctattgccattcctggcttgacgctcaaacgaccggctgtagcaccggccagtgtcagcagcatcgccgtacgtaatgtggtgaccggagaagaaagcacgctggacaccaacgccgtattcgtggctatcggtcatacgccagccactgattttgcggccggtgttgtggaccgtgacgatgatggatatgtcgtggtgcagggtgccagcacggtgaccagtgcgccaggcatctttgctgcaggcgattgcgtggatcgtacttatcgtcaagcgatcagcgcagcgggcatgggctgccgtgcagcgctggatacgcaggcctatcttacggactgatggtggcggactgatggtggcttgctgttctggctgctgcctgtgacataggagcaacgctaggtcagtgttacagcatgccgcccttggatagtacgtatcggtcaaaggcatagaaagacccctcaggcgacggagaatcacgatgtgtgattgtccctccagcctgaggggttttctattgcgacaggggctacaacgcaggcatacgcccctgccaggaatcacgcagaggctataacgtcttgcgcatacaacgcactgcacagcaataatgccggcgacaacacgaatgttcttatcgtgttacacccatttggaatcggcatcgccttggctcggcaccagcagctgcaggatgcgatccatatcctctggtgacgaaaagacgatttcgatgcgaccatgcttggtgctgcccttaatcgacaccttggtatcgaaatgattttccaaactctgctggatggcggaaccaacccaaggattggtcttagacgtcttaggcttcttcggctgctcccccgacgcaatcttcatggcgacgatttcttcggtgctgcgtacagaaagaccttccgcaataatacgagaagccagcttgtccatttcctccggatcgctcaggcccaatagcgcacgcgcatgaccggacgatagcacaccggcagccactctcttttgcacagaagccggcaggttcagcagtcgcaaggtattggcgatttgcgggcgagacttggacaccgacttggacagttgtacttgtgtcaacccgaactcttcaatcatctgctggtaggcagccgcctcttccagcggattcaaggccacacggtgcaagttttccagcaatgcatcgcggagcatatcatcatccgcagtggttttgacgatggcgggaatcgtctccaacccagccaactgagaagcacgccaacggcgttcacccataatgagctcatacgggctgtccaaatgaccggcaaacggattcgtgctggattccgtctcgtcgtgcttggcggctttggccgcagcaatctggcttgccggacgcttgcgcacgactatcggttgcagcacaccaacttccttaatggaagcagacagctcattcaactcatcctcgtcgaagatggtacgaggctgatgtgcattgggcccgatatcagacagtttgagttcagccagataaccaccggctaccggcttgagctcgtccttcttatctgtgtcagcggtctttgccgccgatgcagtcaaagatgtttcacgtgaaacatctttgacagtgacggatgtacgatgtgccgtctgagacgcagacgacttgccgccctgctgaggtgcggcgaccttaccggtttgaggtttctccgtaccgaaaaacaggtcgctaggatgagtaatggtgtccaatgcgggcatggatgcgcgtttaccggcggctttcttgactgccttgctggacgatatcgtctgaggcacggcaggttttgattcctgctgggcagtaaccttcttggcgggggttatgtcagcagtggcctccggagtagacgaatcctccgcaatcattgcgggctgctccgccaccggctcctcccctggcaatgtggggaacaaagcgccaaggcccttaccaagtcgtgattttgatgccattacttgttcctcctcgcatcaatggtgtcaaggacttgttgcgaacgctgtgcgatttccaaagctgcttcaccatacgatatggcacctatgccacgaggatcataggcaatcaccgattgggagaaactcggcgcttcggagatcttgactgaacgcgggatggtggtattcagcacaatgctgggatagtgtcccttaacctcgttatatacttcacggctcaataacgttcggcgatcgaacatcgtgacgagcatggtggacaccagcagtacgggattgaaatgctcttgcaccaaaccaatcgtgttaatcagctggccaagaccctccaatgcgtaatactcagcctggataggaatcagcatctcggtcactgcacacatggcgttgatgaccaagaggcccaagctgggcgggcaatcaatgaacacgtaatcatagtgtttatctgattgacgcaggtagaggtccaaggcctccttcaacaatgtgtttcggttgggcagatcagccacttccaactcggcaccgctgagatcgattgatgcaggcacaacatcaagtgtgggaaaatcaggacagaccgtgataacatcacccagatcggaacgcccctcgataacgtcatagaccgagggctctcccgatgcatgagatacacccaacgccgtagaggcattgccctgcgggtccatatcgatgaccaacacctgcgcgcccttgttcgccagcgccgcagcggtgtttaccgtggatgtggttttacccactccccccttctggttggccacggcaatacgacgggtacgttgaggtttggggaaatcggttttcttgagtacatcgtagcgtgagctttcatcagccatctggctgccaagcactgaaccgtgaccatcgaatattcgctgaagcgtttcggaagccgattctataggttccgactgatgatccttggtggacatcgctcctccttgcacagacgtaagttccagtgttctcattcgtatggacatgatgctcgttatccacaattgcgatatacaatgtggataagtgtggataagtgtgaatgacgttgagtgttagattatgtattcgcagacgaaaaacattgaaaaatcagtgttttcatcattctgcacatcgtcccgtaaaaatgtggataacttttacgcacatatggaaatgtggataactcaatcagtactccactcatcgcttatccacaatcaccacgtgggtaggctcaagatccggtccgacagccgcctcaacgacgcgtggacgacgaccaccgaattttgcaatctccttgccagccttgtcgatttcagcctgagcagaccgtcccttcagtgcgatcaactgtcctgacggtttcagcaacggcaacgtccagccagagagtttggtcataggagcaaccgcacgacacgtgacaacagcgaacggatgaatttcccgcttccgtacctgctggatgacggcatcggagcgtccacgaataatctcaacgttctgcagttgcatcaggccaacacattcatgcaaccattcgattcgccgctccatcggttcaatcagcgtgaagtcatgatccggcaaacacgcggcagccaccaatccaggaaaaccaccaccactgccgacgtcggcaactgttttgaagcgaataccattcgtcgcattccgaacgtacggcacaatcgcagcggaattcagaatatgccgttcccaaatgatatcgacgtcacgggggccgatcaatccacgaggttcaccctcttcggcaatcttggcatggaaacgctccaacttcggcaacgcatcacccaagacctcagcaagtacaggtgacccctgcagctgatccgtcatagccatctccctcaccatgtttcacgtgaaacaatcaacatggagaatggcgccgctcattacgacgccattctccatgcggtcactttagtttgttcaaagacgacatccgtcgaacgtccctgtcatctcaaaaaaactcgccgagcaattactcctgatcaagctcgtcgtcttcggcggtatcctcgactctattcttgagatacaccgtcacgtaacgatgaggctcctcaccgtgcgagcgagacttcagcccctcttcccgaaccacatcgtgaacgactttacgttcgaaggaattcatcggcttcaagtcatacggctcgccggaatccttcactgcgtcaatggcatccaaggcgatatcacggaggtgctgacgcttgcgcttcaggaaaccgtcgacatccacaatcagatgagaacgctcgccggtcttctgctgtacagccagacgagtcaattgctgcagagcatcaacgacttcaccattacggccaataagatgtttgatgtcagtatcgtcatcagcaacgatttgcacggtggggcggtcattacgcacgcccatctcaatgtcgccctcatagtcggcgatatccagtaggccttcaaggtaatccgcggcgatgtcagcctcttcgttgagctggtcgatcgacttcacgtcatcctgtgccatacgctactccttcatgtcgtgtttgaattccaagtctaagccctgctcccccgaacagagaaagtaatgtcggtgcgtgttgaatgtttcacgtgaaacatcgaactcgcaccgacatagtcgtcacttctttttgcgcttacgcacgggctgttgacgctgatagccctgagtggccttacgctcggcctcttccttggccttggccaatgcttcttcttccagagagggcaggccggcctttgcgcggcgagcattctcattacgatgatcgcgcttctccttgtccgccgcagccggagagccaggggtcgggaatgcgtacacctgccacaatgtgcggcagaggttgcacacgttgttggtcagccagtagaccagcacggcgaacggcatggcgacaccggagaagatgtacatcaccgggaagagccacagcatagccttctgcatggtctcggtctgcttgttcatcgaagcagctgccatgttgcgcttcatgctgaagtactgcataaaccacaggcagaaacacatcaggaacacgaagataccgatgaccgccttgccactagcggcagcactggtgaagttatcggtcacgctgacaatgccgaacacatcggtttgggtgaattgcttggcggttgctacgtcgaacgcgcccaacgcatcgcgtttaccgttggcaatgtatggaatggccgacagcgtatagaacatggacatgaacaccgggccctgaatgagcataggcaagcaggagccagccggattgacgtcattgtcttgatacagtttcatggtttcacggctcatggcctccctggaagcctgatccgtcttgcctttgtacttgttctgaatacgctgcatcttcggcgccaatgcctgcatcttgcgcatcgacttcatctgcttgtagaacagcgggaagatacaagcctgcaccaccagcaccaggatgataatggcaagcacccatgagacaccaatcgggctcacgcccagcatcacgaagaagtcatgcacgatcttcatgatccaggtctgcaaccactcaacgggagtcaggattttatatagaaatccccaaaacccgctatcaagcagaaattcatttgagttcatcgttgggcctctctttgggttgtggccaatggtgtcagtcgaggctcttcatgagccttcgaccacgaaaacctgtaaaaaacggaataccgttgtggaacatcgtcgattcccccacgactccacggccggcaacgcagtaatctcagcacggcgagcactccccctttgaacgcgccataccgttccaatgcctcaatggcataattcgagcacgttggataatacttgcaacaaggcggtgtgtttgccgagatgtgctgttgataccagcgcaccccaccaatcatcaccgccttgaaagaagctgtcatgcctcagccaccttatgcgccaccgtggcaaaagccttcgcgatctgctgatctagcgaagcgaacgatgcggtcgctgcactgggcttggcgcgcaaaacgatatcgcaatgcgcgggcagcagatcctcatgggctctggccaatacacgaaacctacgcttcaccgtattacgggtgaccgcatgtcctaccgatttggagacagctaatcccaaacggcgatgcaccgtccggtcgtcatcatcatgatggtcgtcgggcaccaaatagtgcacgacgatatccttgccacctgctttgcgccggcgtttcagcacggtgacgaaatcacgatggctttgaagcctctccacctcgactatgcctgtggcactgatcggaatgatcaggcggagagggtcttgcggcccttggcacggcgacggttgatcaccgcacggccagaacgggtgcgcatgcgcaggcggaagccgtgcttcatgtggcgacgacggttgttcggctggaacgtcctcttcataatccattgctcctaggtctattcggcaacgcttcgcgctgccctcacgtgagtcaagctataccaaagtactctcacccctaccctcaagtcaaaacggacggagtattttcacatttcgacacgttgcgagacacgccccaaatctcttataatcggcggaataccaaccattcacggccaaaagttatccacaaattacatgtttgttattcacaatccagttatttcaacacgcgacacggtggataacttgtctaaaccagagtaaatattatctgttgtacgtatttcgccacagcgacagaaggggccaccatggttaacgcttccggcgaccccgtaatcgaggccgcccacatctggtcagacacgctgacggtgctcaaacacagcgcttcgctcagcccacgagaaaaaggctggttggaaggcgttgttcctgaaggcgtcttcggttcgaccatcgtgctgtgtgtggacaacaacgacacgcttcaagccattcagggtgatttgaacgattccctgcttcaggcattgcgtacggtaaccggcgaaaatatgtttcccgcgttcaaggtcgtgccgaaaaccgagcccgaaccgctttcggaggcaaagccggcgcagccatatccttcggaaatttctccgactgtcgccgaattcggtaaagaatcctatggtgcaaagccggcagccgcaccgcgggaaccgatgcccgccaccgagccgcagttcccggtcggtcagcagaagatgaatcgcgatcccgagactcatctcaataagaacttcacgtttgattccttcgtgcccggcgattccaaccgttttgcccgtacggtcgcactggccgtggccgaaggttccgggcaggatttcaacccgttgtgtatctatggcggatcgggcctgggcaaaacccacttgctgaacgccatcggcaactatgcactggtcaaggatcccgggctgaaggttcgatacgtcacgtctgaggaattcacgaacgaattcattgacgcgctgcaaaacccgaaccaaagccaggggcagattgctgaattcaaccgtcgataccgacaggttgatgtgttgcttattgacgatatccagttcctcggcggcaaggaagccaccttggatcagttcttccatacgttcaatgcactgcatcaggcaaataagcgtattgtcattgcttccgatgtagcgcccaagaatttgaagggtttcgaggctcgactcatctcgcgcttcgaatccggcctgaccgtagacgtcaagccgccggatctggagacccgaatcgccattcttcgcatgatcgcctcgatgaacggctcgaaaatccccagcgatgtgttggacctcatcgccgaacgcttcaccgagaacattcgtgaactcgaaggcgcgctaacccgtgttacggccgtggcctcgctgagtaatcagccggtgacccgcgccttggccgagcagacgttgcaggacttcttcaccaccgatgtggaaatcaagcccacggacatcatcagtcaggtggcgaagtacttccacctgacgtttgaggatcttgtcggtaaatcacgaaccaaaaacgtggctgttcctcgtcagatcgccatgtatctggctcgcgaaatgaccagtatgagcctgatggatattggccaggtctttggcggacgcgatcacaccacagtaatgcatgcctgcactcgaatcagtgaccgaatgcagcaaaaacaggagatctataactacgttatggagctcacggttcgcctcaagcaaagcaacaccaactgacacaacgcttctgagagacgaaaaacggcactttttggactgactttccgaaaagtgccgtttttggttgctcaggcggattctggtggatacgtcgaggcaacggattcgagacattagattcctcatggctcccctttgtgaggggatctgtcggcgcagacgactgaggggagtttcgaaggggaacacgcaaaaaaccatgaaacgagagaatcgattctgaggaccgattttgcgggtttgggcgagcgagacggaaaaagtgccgaaaacggtctccagaatcgattctcctcgacgaaaaaacagtcttcaacacgccgtgcgaaagtgcgaaaaccaaaaaagttatccacatagttgtgcacagatgtgggtaaactcggcggataactcgtggattacccactgttttgttgtggaaaactcgtgcataaccgcgacctcgatgtggaaaactcaaattcgacgaactggctgtggaaaactcgcccacttatccacaagccatgcagaatttgtccacaattttcagggacttatgaaccgttgcagttgtagggctcagccctacttatccacactatccaccggccttattatggcgattacttactcagttacgtgaaaagcatcatcgccatagtaacagccggtcatccagcgtacgtaagttcgccacctaacggctagaatatttctcagccaatccgacgaagggaacaatcacacatgaaagtcgaaatcgatactgcagccctggccgacgccgtagcctggacctcccgagtcatcgacgcacgtccctccaacccgattctcgctggtgtcaagctggaagccattgacggaacgctgcaattctccgccttcaactacgagatttccgctcgccaccacatcgaagccggcgttgacgaagccggttccgtactggttcagggcaagctgctggccgatatcaccaaatcgctgcgttcggagaaaacgtacctggtcaccgacggctccacgctgaccatcacgtccggcaagtcgaagttcaccttgcagctcatgcccgacaccgagtacccggatctgcctgtggtaccggccatgctcggccaagtcgatgccccgactttcgttcaggccgtgaaccaggcgtgcgttgccgtctcccgcgaagaaaaccgcccggtactgaccggcgttcgcatgcaattccaaggcgacaaggtcgtcatgacctccaccgatcgcttccgtttggcccgcgccaccttcacttggactccgcagaacccggacgtcgacaccaccacgctggttcgcggctccctgctcaaggatgtggcccgtgctcttgacgagcaccagaacatccgccttgatttcgatgccgatagcccgacgctgctcggcttcgaaaacgccggccgcgtctccacctcccagctcatcgacggtgaattcccggcggtcgaccgcctgttcgccgacgaatatccgattcaggccgtagtcaacaagcaggatttgctcgacgccatcagccgtgtggctttggtcgccgaacgcaatgctccgattcgcatgaccttcaccggtcaggaagtggcgctgtccgccggatcggtcgacgaggctcaggccaacgaaacactggacatcgacatggatggcgacgacatcaccgtggcattcaacccgtcctacctgaaggagggtctgtccgccgtaaccgaaccattcgtgcgcatcaaaatgacgaccccggtcaagccggtcgagttcaatggccagcaggaagctgattccgacgagtccatggactaccgatacctgctcgtgccgatgcgctttaacaactgaaatccctgaatttccaacgattcgctaatgcacatctcccgtctcgcactcgaccactaccgctcatggagtcaggtagtggtcgatttcgtaccaggcgtgaatatcctgttcggcaagaacggtctgggcaaaaccaatctggtggaagccgtcgaagtgctgtccaccggatcgagccatcgcacgtccagcacgttgccgctgatcgaacgcgggcagaccacggccaccatccgcgcgaacgtcgctgatgatgccggtcaaaccactacgtatgaagcgtcaattcatgcgcgtggtgccaaccgagcccgcatcaactcggggtcgtcgctgtatctgcgcgatatcatcggcaagattcccagcgtttccttcactcccgaagatcagcggttggtgtccggcgatccgggagcacgccgcaccatgatgaatcaggctgcggctctgctcgagcccggatacatgcagacgttgcaacagttcacgcgcatcgccaaacagcgtgccacattgttgaagcaattgaatgccaatgtcaacaatggccagccgatggatgcggttctgagcggtttggaaatctggaccggccagttcatcgaagccggtgtggcgttgacccgtatgcgcgctcatgtgatcggtctgcttgccgagccatttgccgcgatttacgccgacttggccggtgccggcgagcaggtgacgctcacttatgcgccttcattcgacgaagtgctgatgttcgacgatccgcatccgcagattagcgagcatttccaacgcatctaccccggtgaagtggctcgcggcgtgaaccttatcggtccgcagcgcgatgacatgaaccttgagttgggcggtattcccgcccgcgagttcgcttcgaacggcgagatgtggacgatggcgttggccttgaaaatggcattgttcgaaatagtgcgtgaccggttgggattgcagccgattgtgattctcgatgatgtgttcgcccagcttgacgacagccggcgcacgcagattcttgatttcgccagaaaacaggatcaggtgctgattaccgtggccgctgaaggcgatgtgcccgactatgaatcggcccatcgcatcgacgtggccgcactggacgaaccagcttccgtgatattgccaactctgggcaatttgtccaattcgcgggaaaatgagagtttgggtgggtatgacgaaaaaaccgcggtggacagcgcgtccgtagaacggaaagtgtcatgaacccgccgatcgcccgccaactcaacctggacgagaccaaactgccggccgaaatattcgagcggctctcccgtcgcggggcgaccttgaaggactacagacgccgccgtgaagaggccatcgaaaacttcggcaaaccggggcgcgatccggctgaactgggcagcgtgatgaccaccatcgccggcaacggcgtctggacggcgaatatgaagcttgcgcaattgcgcaaccattgggaccaagtggtgggtcaggccatcgccagccattcggcagtcgccgatttcactgacggcgtactgaccatccgcgccgaatccacggtctgggccacgcagctgacctaccttatcccccaactcaccgataccatccgtcgcaatctcaaaggattgaccatcaccgagattcgcgtgaccggcccggccgccggatacacacgcaaatgggctcggcggcggtagccaagataccaaacaaattcgcagaagcctcgctatggcgctcgtcgggttagacgagtaaaatcacatgcagtatggtcaaatggctagaagagccctttacgggcctcgtaagccatatcacctccgtgaatgaccttcatgacggaggttgaccctgtagtcacggaaggaagcctgttggcagacgaaaccagcaaagaggagcagctgaaggcggctgcggaacgcatcaacaatgcggaattgaccgaaggcgaacttgacgaatccatggcccccgagcattatgaggcctccgatctgagggtgctcgaaggacttgaggccgtgcgtatccgccccggtatgtacatcggttccaccggcccgcgcggtttgcaccacctggtctatgagatcgtcgacaactcggtcgacgaggcgctggccggatacgccagccatatcgagatcaccattctgccggacaacggcatccgtgtggtggacgatggtcgaggtatcccggtcgatgaggtgcccggcgagggcgtctctggtgtggagaccgtgatgaccaagctgcacgccggcggcaagttcggcggcggcggttatgcagtgtccggcggtctgcacggcgtgggcatctccgtggtcaacgcactctccacccgcgtggacatcgaagtgcgccgtcagggcttccactggacccagacgtacatcgaccagcaccccaccgcgcccttgaagcagggcgagccgatgaccgaaggcgagtccaccggtacgtctgtgactttctgggccgacccgaagattttcgagaccaccatctacgacttcgagacgctgcgttcccgcttccagcagatggccttcctgaacaagggcctcaagatcagcctgaccgacgagcgtgagaacgaccaggccggcgacgaggtggccggcgacgccgcggacgagcccggcgcaaagcaccagaccgtcacctaccagtacctcaacggcatcaaggactacgtcgactatctggtcaaggtgcgcaaggccatgccggtggaagaggacgtcatcagcttcgaggccgaagacctgaagctcggcatctccgccgaactcgccatgcagtggaccactgcctactccgaggccgtgcacaccttcgcgaacacgatttccaccaccgagggcggcactcacgaggagggcttccgcgccgcgctgacctcgctggtcaaccgttacgcgcgagacaagggcatcctcaaggacaaggacgagaacctctccggcgacgacgtgcgtgaaggcctgaccgccgtgatctccgtcaagctcaccaacccgcagttcgaaggccagaccaagaccaagctcggcaactccgaagccaagaccttcgtgcagcgcgtgatgaccgacaagctcggcgactggttcgatgcccacccggccgaggccaagaacatcatccagaaggccatcgaggcatcccgcgcccgtctggccgccaagaaggcccgcgagaacacccgccgcaagtccatcttcgagtccgccggcatgcccgacaagctcaaggactgtcagtcgaacaacccggaagagtgcgagctgttcatcgtggagggtgattccgcaggcggctccgccatccagggccgcaacccgatcacgcaggccatcctgccgctgcgaggcaagatcctcaacaccgagcgcgccagcctggaccgcatgatgaagtccgacaccatcgaatcgctgatcaccgcggtcggcggcggctacggcgaggacttcgacatctccaaggtccgctaccacaaggtcatcatcatggccgatgccgatgtggatggtgcgcatatcgccaccctgaacctgacgctgttcttccgctacatgcgcccgatgatcaccgccggctacgtgtacgtggccatgccgccgctgtatcgcctgaagtggaccaagggcccgcacgacttcgtgtacaccgacgccgagcgcgaccgcgtgctcgccgaaggcaaggccaacggacgccagctgcccaagggcgaaggcatccagcgctacaagggtctgggcgagatgagctaccaggagctatgggagaccaccatggaccccgagcaccgcattctgaagcaggtgcacatcgaggacgccgccgcggccgacgagaccttctcgatgctgatgggcgatgaggtcgaaccccgccgcctcttcatccagcgcaacgccaagaacgtgcgttggatcgatgcgtaacggaatcctccaacctccctcgtcagagggaggtacacaacggacttagacaactaaaggaacaacagtggcagatgaaaacaacaccggcgacgagcagttcacgccggacggctcgatggagccgttgagcccgcaggaggcggacactaccgactacggcctgatggacaccggcgaacgcatccagcgcaaggacctgcagcaggagatgcgcgagtcctatctggcgtatgccctctccgtgatcgtcgagcgcgccctgccggacgtgcgcgacggtatgaagcccgtgcatcgccgcgtgatctacgcgatgtacgacggcggctaccgccccgatcgcggctacaacaagtgctcccgcgtggtcggcgacgtgatgggtaagtaccacccgcacggcgactccgccatctacgacactttggtgcgtatggcccagtcctggtcgatgcgcaacatgctcgtcgacggccagggcaacttcggctcccccggcgacgacccggccgccgccatgcgttacaccgaatgccgtatggccccgctggccatggaaatggtgcgcgacatcgacaaggacaccgtcgacttcgtgcccaactacgacggcaagacccaggagccgaccgtgctgccggcccgcttcccgaacctgctcgtcaacggctccgccggcatcgccgtcggcatggccaccaacatcccgccgcacaacatgcgcgaggtggcggacggcgtccactgggcgctcgaccacccggacgccagccgcgaggaactgctggaaaacctgatccgcatcatcaagggaccggacttccccaccggcgccaccatcctcggccacaagggcatcgaacaggcctaccgcaccggccgtggcctgatcaccatgcgtgccgtggtcaacactgaggagatcaacggccgtatgtgcctggtggtcaccgaactgccctaccaggtcaacccggaccgcctcgtcgtctccattcgtgaggccgtgcgcgacggcaagatccagggcatcgccgacatgcgcgacgagacctccggccgtaccggccagcgcctcgtgctcgtgctcaagcgcgacgccgtgccgaaggtggtcctgaacaacctgtacaagcactcccagctgcagcagaccttcggcgccaacatgctggcgctggtcgacggcgtgccgcgcacgctgagcctggacgccttcatccgccattgggtgaaccaccagctcgacgtgatcgcccgccgcaccgcgtacctgaagcgcgaggccgaagagcgcgaccacatcctgcagggctatctgaaggccctcgacatgctggacgaggtcatcgccctcatccgtgcctccgaagacaccgacaccgcacgtacgggccttatggggctgctggacatcgaccaggtgcaggcggacgccatcctggccatgcagctgcgcacgctgacccgcatgaaccgcgacaagatcgtggccgagcatgaggaattgcagcgcaagatcgccgactacatcgacatcctcgccaagccggaacgccagcgcaagatcatcggcgacgagctcgacgagatcgtcgccaagtacggcgacgaccgccgcaccaagatcctgccgttctccggcgagatgaacgtcgaagacctgatcgccgaagagaacgtggtggtcaccgtgacccactccggcttcattaagcgcaccaaggccgacgaataccgctcccagcaccgcggcggcaagggcatcaagggcaccaagctgcgcgaggacgacgtggtggatcacttcttcctgacctccacgcacaactggctgctgttcttcacgaacaagggccgcgtgtaccgcatcaaggcctacgagctgcccgagggctcgcgcgactccaagggccagcacgtggccaacctgctgcagttcgcgcctgatgagtccatccagaccgtgctgtccatcccgaactacgaggtggccaagtatctggtgctcgccacccgttccggcaaggtcaagaagaccccgctggccgagtacgattccccgcgccagggcggcctgatcgccgtgcgcctcatggccgacgagaacggcgagaacgccgacgagctcatcggcgccgcgctgtgcaacgccgaggacgacatcatcctggtctccaaactcggcatgagcctcaagttccaggccgacgacgagcagctgcgcccgatgggccgccagaccgccggcgtgcagggcatgaagttccgtaacgacgacagcctgctggccatggatgtggtccctggcgactccgacaaggacctgttcgtggtcaccaacgagggcttcgccaagcgcaccgccatcagcgaataccgtctgcagggccgcaatggcctgggtatcaaggccgtgcaactggtcgagggccgtggtgctctggtcggcgcgctcgtggtgtccgaagacgatcaggtcatggccatcatgaagtccggcaaggtgattcgctccaacgtggacgaagtcaaacgcaccgggcgcaacacccagggcgtgacctttgccaagcccgacaagggcgacacgattctctccatcgcccgtaacgaggagaaggacgagcccgaggatggcggcgatgccgcggcgaacggcaccgccgagaccgcacaatccggcgagaatgtgaacaacgcggacgaggcgtgagcagcgtcctgaaaagctggtagcctcgcatacagcagaggctaccgccaagcctgttaaggagaaacgatgagcgagaatctcgaagacaacgagccccggatcataccgccggcagtcggcaatacgcagaacgagcatgtcgagccgctgatcggtactgagcacgctccccgcgtggcacgctccgtgtccagcgatccggaagaatccgcgttgccttcttcaggtgccgccactcccgtgcgtccggcacctcgccgtagcgcccccagggctcgccgcatgagcttgtcgctgacccgcgtggatgcttggtccgtggccaaggtgacgttcatgctgtccatcgccgtggcgattattcaggtcgttgcctccgcgatcgtatgggtgctgcttgatgtggtcggtgtattcagccagattacgcagattgtgtcttccaccggtcttgatgcaggcggtttcgatctcaagaacgtgttgtcccttaccaccgtggtctccggcgtcaccatcttctcgattgttgaagtggtgatcttcaccctgctggccaccattgcggcactgatctacaacgtggtcagctcgctggtcggcggcgtgcacgtcacgctcggcgacgactgatatagctatactgacggaactcccctcagtgaaccgcaccccggttgttggactgaagtaattcagattcgatgatcggaggtgcggtttcttatgtgtggggttcgtaggcgtcgttgctgggccgagacttgggactccggcgacgctgggggtggcaggcgtcggtgttgggacaggttttgtatctctgacgacgctgtggagggcttaccgtcgtcagcggtacagatcttggagttctgccgacgctgagggtgcgttctgtgtcgtatgcgtccaattcttggccctctgccgacgctgggcacagcaagcgtcgttgctgggccaagttttggactgccgccgacgcagagaatgcacacagtggtgttggtctgccagcgtgtggcagcttggcgccgctggggggagtcatgagtcccattccaactccccttattgaccacttaggggtgcatcccaacacatggggtgcaccccttttttcttgttgtgctacggggttccagtcgcatttttttcggtgatattttgaacgcgaagacaggctgggaaatgcccgatagtcgtgttcccctcagcaggtgaagccctgctttcaggctgcaaaaccgactcgggtgttccgaaagcggctttcgttgttgtacatcgatacataagagagaacacccatgaaaaacaccattattcgtgctgccggtgtgctgttggctgcaagcatgatatttggcggtgcggcagccactgcatcggccgcggaagcaacgtcgccgagcaccggcaccaccagcagcacgcaagccgcggaatccatcaatcgcgaatgggtgctgaatcccgcgaacaacactgagctggcggctctcggcactatacaaggcggatcccagacgttcgacgggctgaccatcgatgccactgcaaacggtgccaagtttgcgccgcgcgccaatgacacccagatcaacgccggaaccatcatcagcatcccggtgccagcccacaccaatacagccaccatcacccttgcgttgtccggcggcaccaccactattaccgcggatgccggtgaagtgagcagcgacaacacagttatcgccttgcctgctgcggagtcggctcgtacggtaaacgtcaccttcactgcccagacctatctcaacggcatcgcccttgccgaacagcagccggaacccgagttccccggtacgcccacggtcgcggccaaagacacgaactgggacttcacggaaaccggcatcgatcgaccggccgtgcagggcctaccgacaactaccaaggcgtcgccatcgacgctcgggcgcaaggcgccaagttcaacccgcgtactaccgcggcaagcggcggcagcgatactcaggtgaacgctggaaccatcctgtacattccggtcgcacaggccgagggcggcgctacagtcaccgtgaagggccagctgtacggtcctacgctcaagctcgacggtacggacatcaccaccggcactgctgtaaccatcgcaaccgacagcacgcgctacgtgccgctctccgttgaaggcacgggcagcctgtacctgaccggcatcgccatcgactacgcggccggctcccccgccgccaccagccacacggtcaccgtgggcccgaacggccagtaccggaccattcaagccgctctggatgctaacgactcttccgaaaccgaccgactagtgctgaagatcactccgggcgactatcgcgagaagatcaccgtgaccaagccgggcgtcaccttcgccaacgccgacgtgaccgccaagcgcgcggtgacgattcgcgccagctactattcgtccaacacattcgatgccgacggcaagtttgtgccgcaggatgaattcgaccttggcaccaacaagtgcgccaccgtgaccattggcgcgggtgccacaggtttctccgcctacggcatcaccttccagaacgattacaacgtggtggatcacacggcggcgggcgagcagacgccggccgtggcgctgaacacccaggcagacaaggtgtacctgaagaacagccgcatcatcggccgtcaggacactctgtacgtgcagggcgccggcaaccgcgtgtacgtggacggcggctacatcgaaggcacggttgatttcgtgttcggcgacgccaacgcctacttcgccggcaccgagctgcacatggccgcgttcgccggcaagaacaacggctacttcaccgccgccaacaccaagaagtccggcgtgggcctggtgtttgaccgctgcaacttgaccgttgccgcagcatatgacgacgatgccaagctttcgctgggccgcccgtggcagacgttcgcgcagtacacgcaggtgcgtaagggcgacggcagcagctatgtgaccggcgtggatttgggtacgaagaactcggcgtatacggacacttcctcggccgtgacctacctcgacagcacgatgtccagcaagatcaccaagaatcgttggaatgtgtggaccagcaagaaccagagcggcaaaagcgtggacgtgaccttccacgatgatgtgcgattcgcggaatacgccagccacgatgaaaccggcgcgctgcttgatccggctgattataagaacgtcgtgctcggctcgatgtctgctttggatgaggctcaggtgcaggcgaagcgtgctgaattgctcgcggcactgggcttcggctcggcggctggtcagtgggttgtgccggatggcgcgtggccattcgcttacgacccgaactactcgaccggcactgatgtgcagccgactcagccgggcggcaacgcctcgcctaacgcggattcggcggccaaggccgacaccatgccggaaaccggctcggccatcattgcggtggttgtagtcgccgtgccgctgctcgttgctggcttggcgctggtagcagtgcgccgcaatcgccagcagtgattgaaagcgttgctgcgaaccggacctggtgaccttgtagacgggggctatctccgttgaaagaggtacattgatggctttgcagaaagccaactgctttcaaaggggtacctgaaccacgaaacctcgagtataagcgttgcaatgacggcgtttatactcggggtttcccatattcagtacccctctgaatgcagttagcttggatcgatgatcatatccaagaattcactcgtatagtggtgcgtaatgcttacgtatttgggatagcacttgttgctcgttgtacatatagcaatgcccttgcctcctcacggggaagcaagggcattacgctactgcttagtactgcttagtattgctcagcactgctcagcgattgctcagcggcaagcgtcacagcacgccctgggcaaccatggcgttggcgaccttgacgaagcctgcggcgttggcaccgagcatcaggtcaccctcgtgaccgtattccttggcggcggccagggagttggcgacgatttcttccatgatggacttgagcttggcgtcgacctcttcgaaggtccaagacaggcggtagctgttctggctcatctccaggccggagacggccacgccaccggcgttggcagccttggccgggccgtacagcacgccgttcttctggtagacctcgatggcctccggggtggacggcatgttcgcaccctcgacgaccacggtcacgccgttgtccacgagcttctgtgcggattcgccatcaacctcgttctgggtggcgcacggcagagcgatgtcgcccttgacggtccacacgcccttgctgccctcgtggtactcggagcccggaacgcgctcggcgtattccttgatgcggccgcgctcgacttccttgatctgcttgacgacctcgacgttgatgccgttcgggtcgtagatgtagccgttggagtcggagacggtgacgaccttggcgcccaactgctcagccttctgagcggcgtaggtggccacgttgccggagccggagatcacgacggtcttgccctcgaaggagtcgttgcgcagcacgcgcagggcttcctgggtgtagtagcacacgccgtaaccggtggcctcggtgcgggccagggaaccgccgaattccagacccttaccggtcaggacgccggagtactcgtcgcggatgcgcttgtactggccgaacaggtagccgatctcacgaccaccgacgttgatgtcgccggcgggaacgtcggtgaactggccgatgtggcggctcagctcagtcatgaaggcctggcagaagcgcatgacctcagcgtcggacttgcccttcgggttgaagtcggaaccgcccttgccgccgcccatcggcagcgtggtcagggagttcttgagaatctgctcgaagccaaggaacttgacgacggactcggtcacggtcgggtggaagcgtagtccgcccttgtacgggccaatggcggagttgaactggatacggtagccgcggttcacctgaaccttgccctcgtcgtcaacccaggccacgcggaacttgatggtgcgctccggctcgacgatgcgctccagtacaccggccttctcgtactccgggtgcttctcgacaaccggctgcagggtctcgaagacctcgcgaacggcttgcaggaactccggctgatcgccgtcacgggcaacgacctggtcgtagacacgcttgatgtactcgtcagtgagcatgattctcctcgatttgctagggaattaagacggttttattctatgcgcgcaggcccttgctgcatagagtctcgctcggataacgggaaagctatcggcgtggttatggggtggttcaagtttccgtttgttagatttttcggcgattgctggatgtctgtctgtgcgtgaatcgggtcgaaatggaagctgcatcacaccgaaggtgcgttcatatagtggacataaaggtggacttgggtgatgtcggatgtgcccgttgggaatcgtgcgccgtaggggccgaggtcttcggcgcgcaggttaccgggttcgcggtcagtgcgcgaagtaggtctgcagaatcatcgtggtctcggtgcttaccggcaccgtgcggtggatgagattgagcaattcctcaagggcggtggggaggccacgcgtaccaccagtacgaagctgggggcgccggccaccgaatagcaggagacgatgccgtcgatattgttcagcttgtccggaatcgaggattcggctgagtagtcgagcggggtcacgttgacgaacgcgctgatgggcaagccacgctgctcttggtcgatgatggccttgtatcccttgatgatgccgcgcttctccagcttctgcacgcgcgactgggcggcggagacggacagtccggtcgcctgggccagttgcgcgagcgtggcgcggccgtcggcctccagcatggtgaggatgcgctggtcggtctcgtcaatcgcggtcatggtgtcttctccgttcgttgtgctctgtgttcactgtacctgttgccggaatgcgatggctttccgattttgcctggtaatttcagtagttcttcctgtgttttctgttgtgtggtggaatgtttatgcctaaagtcctaattgaatgtaataattccttctgaaataagagaacgacgaaataattccattgaggagggatgatatgcagaagttttccaacatgcctctgtccgaagttgcatctgctgctgtgcctgctgccagacgggttgctgtgccgaccgccaagcccgcgagcttgtccgccgaagccctgaatatcccgcgctccggcatccgagacgtattcgaccgtgtagagcgcgtgcctgacgcgatttcactgaccgtgggggagcccagcgccacggccgcgccgcatatcgtggcggccgcttgcgaggccgcacaggctggccgcactcggtacaccaacgtgctcggcgtccccgaataccgcaaggccgtggccgattactccgcccgtgtgaagggactcacttatgatcccgaaaccgagattcaagccgttgacggtgccacgattggcctgtttctggcgctgaaagccgtggtaggcaccggcgatgaagtgattattccctcgccgttcttcacttcctatgacgccgaagtgatgctgtgcggcggccgcccggtcaccgtggcgctgcgtccggagcacggcatgcgcgtgaacgcggcggacatcgaagcggcgatcaccccgcgcacccgcgccgtaatcatcaactcacccggcaatccgaccggcgcggtaacttctgccgctgaactggcgcgtattgccgaagtatgcaagcagcacaatatttgggccatctccgacgaggtttaccatccgttcgtgtttggggaaacgttcggggaaacgcttgggggagaggcagccgtggcaccatcgattgccgcggtgccgggcatgaaagaccgcaccattgtggtggaaagcctgtcgaaaacctacgcgatgaccggctggcgcatcggctacctgctggcacccgaagcggtcatcgaacagaccggtaaaatcgccgaactcatgcactcctcggtgaactccttggcgcaatacgcaggcgtggcagcactggccggtccgcaggatcatgtggccgccatgcgcgaggaataccgcgccaagcgccagatcgtgctggacggtctggccggatgcccggtattgcgcttgattgaaccgcaaggtgcgttctacgcctttgtggacgtacgcctgactggccttgactccggtgaattcgcagaccgtctgctggacgaagagcacgtggccgtggtccccggcgaggccttcggcgaggaggggcgcggcttcgtgcgcctctcctacgccggagatgccggcgagctgcgtgagggcgtcgcccgtctgcgcgcattcgccgaacgggtatggaaccccatcaccggccaccacaccgccacctatcaccccatggaggtgctggcctgaggcttaaagcgaggctaggccgccattcggcctcgtcggcgcgagcgatggcctgcttcttggctcgcagcaagatgtagccgagtaccagaacgttggccagagctcgatgttggcatcgcgtcaaaacaaccgcattaaggctgccgcgtttcgtatcgttacgcgtaggggctggctgaggcgtaatgctgaagagtaacattgaagcaatggcaatcaagccgatttgaggaagagaagcacacgatggcgtactgcggccactgcggaaatagagttgataggccggcacgattttgcccggcatgtggagcgtctgtagacagcgcaccggttgcgtctgtaccagtgccggccgcatcgtcagccgtaccgactgcgtcgataccggcacctgctgtgccagcgccttcagtaccaccatcgataccagccgcgccggttgccccatcggtttacgccgcgcccgctgccccacagccggcaccaactgctcccttgccagctttgccgattcccgctcctgccgcatatcaggcgactgatgcaaccgccgtcctggcaccgccgcgcaaatccagcaagaagctgatcgccgttctctgcgcattgcttgcgacgattctggtggcggccttggcattcatcgtccccaacttcaccgccgtcaaagcgatgctgggcttccagcccaccaatccgctggtcgtcaccttcgacgcgatcaactcgctgtccactctgcgcagcaccaaatacgaactcagaacccacagcagcactgacgactcccttgacgcgcggatgtctggcatgtattcgctggggcaaaaccaccaatgactcctccgcgtctgtgaccatcaagacagatgaacaggcaacaaccctcgcttggcacaaaggcgcattcgccgggaaaaacgtttggtatgatgacgacccctactacatctactacccggccgaccaatatgaagatgacttaaggaacggcgttggtagtgatgtggcggacttgatattgaacgtcaaggatgcgttggtcaagaacggtgcttgggacatcaccggcgcggagcaaacgttctacgatcagctggacaagatgaacgacgatgggtactcgaacgacatcgaccgggccaagggcacgaaaacgtctgccgaggtgaaggccgaggccagcaaattcatccaacaatatttcggcgtggagctggaagataagaatgtgcgcagccagctgttcccgaatacatcgtctgccaagtctgccggcaatacgcagctgtcgtaccaaatcgatatcaaagcgttgtctcagcatttcgtgaattactggatcagtcatgaagcgcagtatccgcatctgaaatcctgggtgattcagcaaatcgaggatgccggcgtggacgatgctgaagatgagtaccgtcaggcgctcgataatgtgcgcaactgggatttcggcacggatgaagagccggagatgccgactatcaccgtggatctgaactacggcagaaagcgtctgatgaattcgattgccataagcgtgtccggcaaggacgaatacggcgactcctataatggctcgctatcgttgacgctcagtcagcagaacgcggtgtctgtggacgaccccgatttgactgatatggtgagcaaagccaaggacaacaacggactggatttgtcctgaatatggtgcgtgggatgttgcggcggcgctaatttcctcggtgggctatcacgcactcttcccgcttgcagcggtctgctcgctgattggcgcggtgctgatcgtcttcatcaagtcagtgaagtaaacatacttattcatccctcttccttccataacaaacgagcggaggggttgggccattgttttgcggtgtgtccagtctctccgctcgtttatttgcttgattctgtggaatggaaggggcatgctctatgtcaaataagataatgcggaagggctgttctgcgtgcatatatcttgctgaacgtatttgagggtactttctggttaaagacacgccctatggtgggcagaatgctgccgttgtgtctggcgtcggtcgcaggacatgtcgtatcatgagggcccaagcttaattcagccgtcctcaatctgattagtcgtcgggtcgggttggcgtgatcggcttgcagggaatcatccggctcttccggttttggcgtgacccgcagcctcctccacaccggcggcttcagacacaccatacaagcccacctataagcatccccctacacaccaaaaccggaagagccaattatctgccggtaccttccacccgagaggaaggtgtagtcctccgggtccgggcgatatcgccgcaaggcgaaggattttcgtgtaccgttccatgaagacggagcgacaatgaccacgcggttggtctgaatcctcgaggggtggtccttaacaggaccacccctttttcgatggagagggccatggcggactgggagaatccctcgaacaagaacgcaaaaaccctcagaatcggtattattccaagggttgtctgtggagctagccgggttcgaaccggcgaccctctgcttgcaaagcagatgcgctaccagctgcgctatagccccgtgagaaaaaaagagcggctcgcggccgcttcatttttcctgtgggcccgggaggacttgaacctccgacctcatccttatcagggatgcgctctaaccagctgagctacgggcccgatccatacgcttcaaaagcgcacaagtgattacaataccattgaacggcggtatgtcaataacggcgtgtcgcgattgtcgcttgcgccatgattgccggctcgacggtcaatgcccagctacgtaaccttgcgttctcacaccgtaatgctgcggttacacctccctctctgcgcagaaatgtccaatacatatgaggcttctgctgttttcgtgggttgggttcttggttgtggtgggcgtatgtcgagtccgccgcggcggagcatgacaagcgcgatgggattgttcgcgtggtggaagccgtaggccatgcggatggtgaccttgatcctgttgtcggacgcctcgagcctggcgtttgaacagcccaattcgattgtcccgaggatgtcgggcccatgacggcggatcttccgggcgggttcgacgatctcggggatgcggctgtgggacgcccggaacacccggcggttcagttcggtccgggcctggtcgccggtcgtttgggcatcgtccggaggggttccctgagccgccatgaacggtagggccggcccttggggtccgtgtcccgcaggttcccggacgcctcggaccgtctgtcggtcagcttgccggggttcttcaggacggtgtatctgccgccgcgcatgcgcttgacggatttctcgtccccgtcgcggcgctgcgcttcgacggctacacggacggggcggacctgtggcagtacgtcatcgcgaacttcggcaccctctgctgggtgccatcatgctcggctgtctcgtcatggtgtcctcggccaccgcgaaggcggggcagattctagtggtggttgcaacacctgaggtttgagcggccttccatggtcacgttgtcggttgttgaggttatcacgcggcgtcgagcagttcgatgatcttctcgcttggtttcatgaacccgagggttttgcgtggccggtcgttgagttcctcggcgaccgcgtcgaggtagtcctccgggtagacggataggtcggtgcctttggggaagtactggcgcaggagcccgttggtgttctcgttggtgccgcgctgccacggggagtgcgggtcgcagaagtagacggccatgtccagcgaggcgccgatccgtttgtgcagggcgagttccgctccctggtcccaggtcaggctgttgcgcaggagtttgggcaggtgctgcatcttgtcgatgatggcctgctggacgtgttcggcgtcgtgcccgtcgggcaggtgcagcaggatcgtgaacctggtggtgcgctcgacgagcgtgccgatggcgcttttgttgcggctgccggtgatgagatcgccctcccagtggcccgggaccgcccggtcctcgatctccgggggtcgctccgagatcatggccatgggttcgcggaaacggggtttgcggccttggccgccttggggtctgcgggcggttcgcccctgcctcatggcgcgtttcagctcctgcttgagttcgcccctggcctgcaggtagatggcctggtagatcgtctcgacgctcgcgtgcatatccccattatccgggaagtccagcctcagccggttggctatctgctccgggctccaatgcctgcgcaacccggcggcgatctcgtcccacagtcgcgtgccctcggccgccttgcgcggtttggggcgtttgagccggtccgcggccttctgctgggcgcggtaaggctcgtaaccgccggactcgggattcctgttgcgctcgacctcgcggctgaccgtgccggggtcgcggcccagcaggcgggcgatggcgcggatcgaatcgcccagacgcagacggtccgcgatctggatgcgctcctcctggctcaggtagcgcggatggagggtcttgggtttgtccatggtggaacgataccagtccaccaggggtttctcgtttgtatttagtcaagtcggtgtttcgtgtttcgtcactaatttttttcggttttcggcatgaggagtgccggccggtggtttgttttactggttgtccgtcttgccgaacatgagggcctggctgacgcgtcggctggggccggtgaattcgatgaggcgtccgtggtggacgatgcggtcgatgatcgcggcggcgagtttgtcgtcggcgaagatcgtcccccatttgctgaactcgatgttcgtggtgaagatgatgctgcgccgctcgtagctgccggcgatgatctggtagaggaggcgggccccgtcgatgtcgaagggcacgtagccgaactcgtcgaggatgatcaggtcggcacgggcgaggtctttgagcaggttgtcgagggcgccgtcgcgtttggccttgccgagctggagcacgagctccgcggtctgccggaacctcacgctcctgccttgctcgatggcgagcatgcccagggcggtggccaggtgggtcttgccgcgtcccgtcttgccgtagaacacgaggtcctgcgccttggccacgaaatcgaggccggtcagctgctccttggtgtatccgtcgggcaggcgcacgttcgcgaagtcgtagccgtcgaggcttttgggcaccgggaaccgggcctggcgcatgagccttgcccgtttggaggcctccctgttggccagttccgtggcgagcatgcggtcgatggcgtccagttggcggggcgtggcccattcgagcgtttcgtcgatggtggcctgcgagatgaacaggctcctcgcccgctcgcgcagcgggccggggtcggtccgtccgttcttctggttcactcgtcctccttggtgtaggcgatgtcgtattcgctcaggtccacggggtcgtcgtaggccacgggtcccaggcccgaggcgtggcgtgccgcggccagacataccccggcccggtccgtgcctccggtggattcgaggatctcgagcatgccggccacggccgcccgccagccgctctcgccgtcggcgtgcagcagggcacgcaggctgtcgcgccgcgtggcctcgtcctgcgcgtcgatccattcgcgaagcgggtcgggcatcgcgtcgcgcacccggctgttgcgccaggccgccggccggtcgcacaacagcccgagctggctcgacgggtcgccgctgtcggtcggcttgtccccgtaggacctcggatgcgtgatcacgcgtttgccttcggcatcgaggatctccacctccagggccctcaggccgacgatcatctcatggccggcgtgttcgggtccggccgcgtaccggtggcggccctggacggtgacgtttccgtatttgtcggccttcatcctcgtccacgtgaccacgtcgaacggcttggcgggcaggggcagcagcgccttgcgatcatcctcgaacaggccggcctggctctcgcccttcctgtaatggtccttgtccccagctcgagacagcggtcgggaaggcgcaggttgaagttgtcgaggctccacacgctgggcaccggcacgaacagccttcggcgcacggccccgaccctggcctcgaccgcgcccttctcgtggcccgagtacgggttgcagaacgagtactcgaacccgtaatgggcctggaacgcctggaacaggcgggtcaggcggatctcgtcgaaccgtcggcggcccacgccggcggcattgtcgtacacgatgcgccggggcaccccgcccagccattcgaacaggttaagcaaagcctgacacgtgcattccgcgttctccccgggcatcagctggcacggcgagatgttcgagtacgggaaatccaacacgaaatgccgcatccgcgtcacgacgccccggtagcgcacgtcgacctggccgaagtccgcctggcattcgcccggatgccacgacaggtccaggaaacccatctcgcgctccgccatgaactcacgcttcaaccgggccaccgtccgggtcaccgtcgacaacgacgcctccaccccgtactcgtcacgcaaccgctcgtggatgcgcgtcgccgtgtgacgttgcttgtgccaggtctcccggtcctcggcgagcatgccctcgatcacgggaatccactcgtcgagcaccgagccacggcgtctccttaccggaggcctggccgacaggtcgtcggccttgagatacttgcgcacggtcggctcgctgaccttctcgccgcgcgcgatcgaggcgacggactccccattcctgcgcctctgacggatagactgtattttgggcatgctgatcatttgcctttccggccctttcccgaatggattcgaagcaccatcaggctaaggcccacgggtggtcggcatgcctttctgcctaaacccgaaaaaactacgtgactaaaacctcaactccctattgaacacatacactcgttccttcccgtggcgcgcgtcctgccgttgcgccacgccttgccggtgcgtttcgagacgccgaccgcgtgcgcggcctgggtgaagttcatgccttcctcgtccagcaggcgcacgtactcggcgcgtctcgcctcgcacatcagcttcctcgtcggatattcgacgccgttgaacgtccaacggtgttccccgccacggtcttcgtttcggtggcttctggtcacctgaccctccttgcggtaggtcaggtgttgcaacgatcactagaacccgcccggtgttcgaggagtgggggggggctgcgttccggggcatttgccggccgtccggcgtcacatcgtcaggctgtccgggttgaggaggaaatcgtagacgctcatcgtgaggatgccgtgttcgtcgcggacgggtttgaccacgtcgcgtacgaggacgatcttctggaagctgtcgtcgatctcgagcagcgaggccttctcctgcgcgaccttctccggtgtgggcagttggtatgcggattgaatgtagcagcgccggttgccgaggttcgccacgaaatcgacctcgaggcgtttgcggtacggcacaccttcgctggtgccgcgccggtcgaccacgcccacatcgacgttgtagccgcgtgttcgcagctcgttgtacacgatgttctccatgatgtgcgtctgctcgatctggcagaaccccagtcgcgcgttgcgcagccccatgtcctcgaaatagtatttcttcgggctgccgatgtacttgcgtcccttgacgtcgaaccgtctcgcctcctcgatgacgaacgcgtcctcgagatggccgatgtattgcatgatggtgttcgtgctgatgccggaatgcagcacgctggcgaacgtggccttgatcttgggcggattggtcagggctccgatggaggaggccagcacgtcgaccaggtcgtcgagctcctgcgacctgcgcagcccgttgcgcgagacgatgtccttgagataggtctcctcgaacaggttcttcagatagagggacttctgctcgtcgcttctcatggacaaggtgagcggcatgccgccgaacatcacgtattcggcccagccgtgctggacgtcgccgtcgtacgcctgcatgaactcggcgaacgacagggggcggacgcggacctcgtcgccgcggccgcggaactcggtcatcacgttggtggacagcatcttcgagttgctgccagtcacgtacacgtccacgttgcgcatgcgcagcagcccgttgagcaccccgtacagacggggcggctcctcgccgcgcatctcctcgtccgagatcgcgtactgcacctcgtccagcagcacgtagtacggttcctcgcgattcgtgatacgggatctcacatagtcggacagggcgtgcgcgtgggggtaaggggcggttgccgattcgtgaggggcggcattgtgtgccgcttgttgtccgccgttgtgcaagaatgacttgcatgccttatcgccgtcgtcaatccaccgctccgaagtccggtgcgccgaaatccgttcggtccgctgccgccgggcagtcgttggacattgacggcatccatctgcacctgacgcgcaaacccatcaaaaacctgtatctgcgcatcaaaccgccgagcggccgcgtcgaaatctccgcaccgatgcggatgagcgagagtcgcattgcggatttcgtcaaagagcgacattcgtggattctcgcccagcagcagcgcatggctgaggcgcaacggcgctccatcatggcattgaacgagggcgccggcttcgagaacggaggtcgtggtgtagctggtgccagcggccatgatggaggcgttgccggtcgtccgaaaaccggtgatatcagtcgtccgggaattggtgacgccgggccaggccaagccggtacgaatgtccaaccgtattttgaccgctcccaaatctggaccgacgaacgcaaacgacaagcggcggccgcgatcaacgccgcgttgccacagctgctggccaagtgggggccggtcgtcggccggcagcccacgcatatcacgctacgggtcatgacctcgcgctggggatcgtgtacaccgcgaaccggccgcatccgtctgaaccttcaattgggactgatggaaccgcaattcctggaatacgtcttggtccatgagatgacgcatttgtgggaaagcggccacggtgccggattccagcgccgcatgaccgcctacctacccggctggaagacgctgcgccgcgacctcaaccgccgcgtggtgctgtgacgatgacgggtcaggcttcagtgccggcgatgtggctgatggcctgatcggattcgtcgacgatttgccgcatggtccgaatgcgccaccatctcgatggccgccggacacccgctcaccgacgaagaccgctggccttggctcgacaccatcgccgcgtggatcgacgagcgcgtggccgccggcgagcccgccgtggtcacctgctcggcgttgaagaagatctaccgcgacaagctgcgccgtcaaggcgtggtgttcgtctacatgcagggcacattcgacgaggtgatggaacgcctttcccaccgccaaggccacttcatgaagccgagcatgctgcaatcccagtccgacattctcgaagagccgggcgatgacgaaattcacgtcaacgtacacatcggccaggccgatcccgaacacgaggccatggccgtggccggtgccctcggcctgtgagccatctctcggttccccttagtctcacttcgccacacgtgcggcgcatcgacgaactcgaacggcgcatcagcgaacttcagctggagctgaagcagtgtgaaggccagcaagggcgaaccggatcggtccaaacgggctactcaggccgaccagcccagccagtccgttcagaccgacctaactgatcagagcgggccctctgaccagtccgaaccatctgaccgacatgtacttgttgactaagtgtgcggcccgtcattcgttatggaacatgccggccatgtatacaggcaggtaggttacattcccttcgactgagacgttgcacgggccaagcacatagcctgtattgagatggtattcagggtggacgagcacgttgtccattgcgcgatggcgtttgtaggatttgccggacttcacctcaatcggcagcacgtgatcgttgcggtcttggatgaggaaatcgagctcgccaagcttcttactgttgtagtagtacaggtcaaatccgtgagcgcgtagctcttgggccaccgcattttcatagattgaaccgtagttgatatcagggttgccgtcgagtacgtcgagcgcggttttcttgagaaacgagccggtaagcagacccacgtcgttgtaaaagagtttgaagaggttacgttccttgctcatctccaacggtgtgcacggttcgtccacgttgtacgcggcgacggctacatccgcattgaccagccaatcgaaatcggaagcaaccgattggaatctcatgttcttttcgattttggcgaaggtaaagcgcttgtttgggttatttaactcgctgggcaccaaatcgtagatagcgcggatatgcagccggtcttctttgcgcgcgtattggctgatatcgcggcgatattcacgctttatgttctcttgtatagtgcgcacgtccgcaacgctgccgtttgccacgaacgagtcgactgcggcaggcatgccgccgatgaccagatatttggagtatagctccatgagcctttgatgaatgaactcatccacttcctggtgcttggcaaagcattcggcaagcatatcgaatacgtcgttgccgatatgctgcgaccagcagaactcttggaaatccagtggatacatatccagctcggtcaggtacccgaccggtaccgagcgtatatcttcgagctcgactccaagtagcgagccggaaagcgcgtaatcgaaccgaccatcatctacaaggaacttaattgcggtgaccatttccttgcaacgctggacctcgtcaaagaaaatcagggttttgccgggtactaatggcgtatttacggccagttccagcctcatcagtaggtttttggcatcgcggggccgatcgaataatgcaacgaggtcagggttctcgatgaaattgagctcggcgatatggtcgtaatgctgttgggcaaagtgcctgatgatataggttttgccaatctgacgggctccggtgaccagcagtgcagtgcgtttcggcgcggatctccaagcttccagctgtgtctcgatttttcttcgcagcatgagaatctccagtcatttgtaggccttgcatctatgctgggcacgttttccaactgtttatagcgcatattttacacttttccaaccataagaatgcggttttggctacgttttccaacctcaaaatggggagttttatacacttttccaacttatgtatgtggagactctctatttcacgtgagacgaaagtggctcccctctttgaggggagccacggaatactgcttttacttatgccaggtgagagcgcatgaaccactggaacttttcgagttcctgcacgtggtcctggatgatgttggagctgatcacatccagctcgtccagctcggcgatggccttgcggtcgtcggcgatgaaggcgtcgtagtactcgatcagcgccttgagatactcctcggtgcccacgcggccctcagcgtcgaacgatttccacgtgcggttgcgcacgatggcgtcagcacggccatccggggtgccgcccagagtggcaatgcgctcggcggtctcgtcggcctgggccagcacggcctcgacctcggggtcaagcatctcgtgaacggcgatgaagttcgggccggtcacgttccagtgtgcgtgcttcaggaccagagcggcctcctgctcctggctcagtcggttctgcaggatggcgatggccttctcactggccgcttcatcaaggcccggcacaacaaatgcaagtgtcataatgttccttctttcagtaggtggaacgttgccctttcattctacgttttttggttatgccccgggccgaacgaataggtggtgaatatcacgcgactatttggcatcgtcgctttgtgattcggccggcagcggcgcatggtccggggcgccggctttgcggacttcgatggtttcgatgcggcggccatccaccttggtgacgaccatgttgtagccgtcgtcggaatgcagcacgtcgcctaccgctcccatcttgccggtcttggacaagaagtagccggcgaccgtctcgtacgggccgtcctccaattcgatgccggtcagatcggcgaagtcctcaatggtcatgctggcctcgatcgtggccacgccattgacgaacgcggtgctggtggtgcgttcgccgcccttctcgctgggcagatcgtactcatcgcgaatatcgcccacaagctcctcggtcatatcctcaagcgtcacgatgccgtccgtgccgccgtactcgtcgatgaccacggccagatggatgccgcgcttacgcagcagttccaggcttggcagcagcttggaggtgccgggcagggagatgccttcgcgcaccacatcgcgcacgatcttggcgttcggatcgcgcacgtccagcagatcgcgcacatgcacgaagccgatcacgtcgtcgaaatccttgccggtcaccgggtaacgggagtacggctggtcgcgtacgaacgcggcggcctcggccaagggctggtcgccctcgatgaagaccacgtcggcacgtgggcgcatcacctcggcgacgatggtttcggacgcgtcgaacacatcgtccagaatcgtgcgttcgtccttggagaggttggtgttggagctgaccagcacgcgcagctcgtcgtcggacacctcggactcggtctgctgcgggtcgaagccgagcaggcggacgatgccgttcgtgttcttgccgatgagccagatgatcgggcggcagacggcggcgaaggcgtcgatggcgggcaccacggcgcgcgcgatctgctcggtgcgctgcatggcgatgcgcttgggcaccatctcggagatcacgatggaacagtaggagatgatgagggtcaggatgatgttcaccaggccgccggcgatgccggggtgcacgccccagctttcgaccgccggaatcaggtagggggcgatggaagaggcgccgaacgaggcggacaggaagccggagagcgtcacgccgatctgcacggtggacaggaaggtgttcgggtcacgtgcgattttggcgactttggcgccgcgagcgtcctcctgctccatttgctcgatctgcgagccgcgcagagagaccaatgccaactcggtgccggagaacacggaaccgataacgagaaatacaaaaatcaggaggatgttcaaaccaagtgacatggcttcaactctaggggagtggcacgtcaaattggggtgtgctggctgggcagtaagaaactcggcaaagggaagggcactcttatcattactgcggccgacgtgtcgaccggtgtttccgatgcgttgctcgccttcgacgatgccgtatgcgctccagcgctggacggcattactagtgcagagaggctgtttctcgcggctatggccaaggattcgccaaatcccacgcaggttggcgatgttgcggatcgcacgctcagaagctcagcacttctactttgccggaatcgagctgatagcgggcgccgacgatcatgagcttgtcagcggcgagggcctgctggatgacaggagactgctccaccaaagtttcaataatgtgggccacatgcacgcgctcgatatcttcatgcgcgtcgagctcggcttcgcgcgcctgccagacggacatgccggcctggcgcagaataatcgattcggcggcggcgatgtgctcgtcgaggtcgtccatcgcatccgcggcctccagtgagccgtcggcttcggaagtgatggtgtgcatcaggtcgtccagctcctgctcggcggcctcgattgcgccgcagtgctcgtgaccgagcacacagatcaggctgacgtgcagtttcttgaccgcgtactccagcgaggcgataaccgcgctatcgatgagttgcccggcggtgcgcacggtgaacaggtcgcccaggccctgatcaaaaatgatttccggaggtacgcgcgagtccgagcaggagagcaccgcggcatccgggttctggccatcaagcaacgtttgacgggtctcctgatcctgccatggatggtcgggcttgccctcggcaaagcgccggttgccttgcagcatgcgactccacgttgcgtttgcggtcgattcctgttcaaagtctgactgagccatgaaacctccattatcagcgggctgctgattgccatattagcgagtattcgcgcatagtcgtgattggggcaacggccatttgggcacaagggttgcgggtggtgtgataaggctcatacgttacacccgcgcgagccgtggctcaccacattacgataggtggtggtaaacgcttgaagattaacaattcccgaaaggaccgatgatgactcttctgcagcatgaactgaccgatttcaaggtgaacgcattccagaacaatgagttccacgaagtgaccaaggacgatgtgctcggccactggtccctgttcttcttctacccggccgacttcaccttcgtgtgccccaccgagcttgaagacctggccgagaactacgccaagttcaaggaaatcggttgcgagatctactccgtctcctgcgacacccacttcgtgcacaaggcttggcacgacgccaacgagaagatcgccaagatcgagtacccgatgcttgccgacccgaccgccctgctggccaaggatctcgacacctacaacgaggccgatggcgtggctgagcgtggcgacttcatcgtgagcccggagggcaaggtcgtggcctacgaggtcatctcctccaacgtgggccgcaacgccgaggagctgctgcgccgcgtgcaggcctcccagttcgtctacgagcacggcgaccaggtctgccccgccaactggacccctggcgaggaaaccatcgagcccagcctcgacctcgtcggccagctgtgatcgacactgaataggcggtaatcttggcccccctttctgaggggagctgtcgctgaaagcgactgggggagtgctcgcgagagctagcctgatccgatatgctcccctcagtctcactacgacagctcccctcagagaggggagccagtgtatgtaagggagttttcatgactcagaccaacaatctctatgacgtcgtcgtcattggtggcgggccggctggcctgacggccggcctgtacttggcccgcgctcgctaccgtgtgctgattcttgaaaaagatgatttcggcggccagatcaccatcaccaacgaagtcgtcaactatccgggcgtgggccgcaccacgggccgcgcgctcacccagaccatgcgtcagcaggctcaggactttggtgccgaattcctctccgccgaagccaccggtctcgacgtggatggtgacatcaaaaccgtgcacacctcacgcggcgacctcaagaccttcggcatcctcatcgccaccggcgccagcccgcgcaagctgggcttcgagggcgaggccgagtacgccggccgcggcgtggcctactgcgccacctgcgacggcgagttcttcaccggcaaggaagtactggtggtcggcggcggattcgccgcagccgaggaatccgtgttcctgaccaaatacgcctccaaagtcaccgtgctcgtgcgcgaaccggacttcacctgcgatgccgcagtggccgccgaagccaagaacaacccgaagatcgacgtgcgttatcaggtcgagctgaagggcgtcaccgccggccaaggaggcctgcgagaagcctcaatcctgaaccttgccaccggccagaccgaaacgtggaagcccgccgacgccggcaccttcggcgtcttcgtgttcgccggctatgtgcccgccaccgatttggtgcgcggcgtggtggagctcgacgaccacggttacgtggtcacgcacgactacctcagaacttcggtgccgggcgtgtacgcggccggcgatctgcgcgtcaagaacctgcgccaggtggtcaccgccaccgccgacggtgcgattgccgccgtggaactggagcgttacgccaagcagatgagcgagaaaaccggcttggtgccgccgcgtcccactgcttccgcttatgaggagtccgaggccaaggccgcctccgccgcctcggccgctggcacgacgcccgccccggctcccgccaaacgcagcgccgatgccgcagccgcagccagcgccgccaagaagcccggcgaactgttctccgccgccgtcaagcagcagcttggcgtggtcttcggacgcatgacccgcccggtcacgctcgctctcgaactggacggcactccgctttcggcggaattgcagggtttcatcggcgagatggttgcgctgtccggcggcaagctgaactcggttgccgttgatgccgcagggctgatcacggcggtggatggtgcttctgtgcctacttctttggtggtcggcgaaccgctgtccgtcaccttgccggacggcaccgaactgcccacttatggttcgttggacgattccggccgcgccacattcgacgtcgccggcgtcctgccgctcgcccgcccaactgtgcgcatctgcgtgccggctgagggcgacggcaaggccggcaaggacggcaatggttcactggtcttcaccggtctggccttccacggcgtaccttccggccacgagttcaactcgttcgtgctcggcctgtacaacgcggccggtcccggccagccgctgggcgatgacctggtcgaacgcgcgaagtccatcacggacccgctgaacatcatgatcctcgtctcgctcacctgcacgatgtgcccggaaaccgtgcttgcttcccagcgcattgcctccctgagcccggccgtgcgcgccgaagcctacgacgtctcgcacttccccgaacttaaggaccagtacggcgcgatgagcgtgccctgcatcgtcatcacccacgccgacggcacccagcaagtcgaattcggcaaaaagagcatcccccaaatgctcgaactggtcggcgcgtaagccgcacgacctcaggtactcaacagcaacaacaacgattctgccaaaatcgtgacgtacatcgattgatgcgatcgatgcgcccgactccggcagaatcgttgttttgcggcagctcagcctcggtcttcgacggccttcgtgacgtttctgtcgccgaggtacttgaccaagctgatgctgatcagggccacgacgaacaggccggtgagcaccggaatcagcgcggcgtagcggtgggcctgatcaggcgcgtgggcaactacgaacgaggccaactggttgccggacagaccggcgaacgcccaggcgctcagcgtcagaccgtgcgtggtggagacggttttggtgccgaagtgctgatcaagcagcacgggcagcgtcgagaaaccgccaccatagcccgcgttgacgaggaacagcatggccagcacggcccacagcagagcgttgccgatgctgttggtgaagatctgcagcaagcacacggcaatcgacatgatgaagattacctgatagacggtctcgcggcgcttcaggtggtcggagagtgtggagaagcccacgcggccagccgtgttgaacacggagtccacggcgagcaccagtccgatgatgccggagatggcggcggcaaacttggcggggctcaggttggcatactgcgggaaggccctgagcacatcgtgcaggatgtccttctcttggctgatgagggccaggccgcaggtgatgttgatatagaaggctatccagatgccccagaacacgggcttcttgaggattgtcttgcggctgacgtgtgaggtcgcgggatcgtacacccagccggccggacgcttgatgagcaggaagccgacgaacatcatcaccgcgtagaccgcggcgaggatgaagaacatgctgaccaggccaaccgtgccgatgagatattccatcagtgggctggcaatggccttggccaggccgaagccggcgacggcgatgccggtggcgaggcccttgttgtcggcgaaccaaagcatcaggttcttgaccggagtcagataaccgacgcccaggccgatgcccatgatcgcgccataacagatgaacacgcccggcaggaagttcagggcgatgctcacgcccgtgccggcgaagccgaccacgaagcagaccatggagacgagtgcggatttcttgatgtttttctccaccattggcccggcaaacgcggcggacatgccgaggaagaagatggcgagtgagaagccccattccacggaggcggggctggcgtggagacggtcagcgataagctgcttgaacacgctccagcaatagacggtaccgattgggatatgaatcagcagtgcagggataatcgcgctggtccaacgattctcggtaaaccttgccatatatgggcggatcctttcgtaactggtgtacgatggcctgccggcccgaacgagagtcgtatcgcccatatccacgcacatcacgacggcatgcccctgtgaaccatccgggctgcacgaatcgaatcaaatcgaatcgtgcgaactgcgaacaattcgctaaacatccttggtgtgcatttcatcggcgctgctggctcttgtcgacgccgacaaacagaactataacgctgttatggggttgctgtggctgatttctgtggtcggaagctatgagctttctcacatcgaaaacagttatatgacggtatcggcgtgattgatacgtgacgtctgcccgtggacgcggcatatccctctcggaaaacaatgactccgtcatgtccatttcttggtttgacatgttttcgtttgcagcgtcggtgctcaccacggtgaccgcggcgttcgagtcgccgggcagggcctcgaccgagggtctcatcctcggctgagatgtgggcggtactatggattcttatcgataaggttcgtgatatgcggagatggtaacgatggtgaccttaaaggatgtcggcgaactggccggagtgaccgccaccaccgcctccgcggccctgcgaggcaaggattacgtcaagcccgaaaccacgcaacgcgtgcgtgacgccgcccgcaaactcggctataaaatcaacctgtctggccggtccctgcgttctgggcggtccgataccatcaccttccttacctcgggcctcgagggcgactatttctcccatctggccatgtgtgtggctgaggaagtgcacaagcgcgactcgcacatgctcatcgaactgtcccggtatcttaccgacgacaacgatctgtcgtacacgttttcggacggcatcatcgccatcaatgcgccacgtgcggtcgatatcctgaagcggcacccggccgtcatgctggaaaactacgacaccagcctgcccgtcgacaccgtgaacgcgccgagcgacgccggctcacgggcggcaatcgaacaccttatcgcgcgtggctgtgcgcgcatcggcatcgtcggcgacaatcacgatcccaacaatcccaacatcattcccggctcgcgtgatattcgtatgcgggccgccaaggagacgattctcgcggccggactgccgtttgacgagcgccgtgatttcatcaaatcctcgtggtcgattgacggcggtatcgaggccgggcgcggcttggccaagaaaggcaagtgcaagtacgacggtctgtactgcctgaacgacggtattgcgctcggtattctgcgtggtctggcggacgatggcgtaagtgtgccgggcgatgtgcgcgttatcggcttcgacggcctgagccagagcatgtacagcgtgccgactttgaccaccgtggccaccgatttcaagggcatggcggataccgcgctgaccttgcttatgcggcgtatcgagaacctggacgacgagttcttcccgcagaccgtgaatgtgggctataagctcatcgagcgcgaatccactgcggcgtagagtctttggccgtgttgagcttcaattgggtgattggactggcaccagcggctgatatcagatatgccgaaagcagcgatgatcggatttaagttgctggagatgacaggatggattgctctttacccctttcaccatcttgcaataattcttacatgtaagaactctctgttaacatgtaagaattattgcaagatggtgaaaggggatgctcatgttgccggccaaagaaagtttgacggttgagttcaagagtgagcagaagcgccctcaatcgcatgatgaaattgttgacaacgtagtggctctagccaataccgaaggcggcacactgtatctcggtattgaagacgatggcactgtgaccggcgtatgtgacgagcatcgcaatatcaatggacttgcggtactaattttcaataagactgttccgcagcttcccgctcgcgtggcgctcttgtatgagaacgaggtgccgatagtcagtattgaggtggataacagtcagcaaatcgtatctaccagtcaggggaagacattgcagcgccggctgaaagcagacggctcgcctgaggtcgttccgctgtttgtttcccaattcattagccgtttatctcagcaacggttctacgatttcagtgcgcaacctgccccagaggctcggttggacgatttgaatccagactcacggaacaagttgagaagccatattcgcagtgccaatgcgcaaaactcgttgttgtcttttactgatgaggatttcgatcgggcacttgagctggttgttgatggcccgtatggattgcagccatctgttgctggtctgctcaccattggttcggttgatgctattcatcgatcggttccagccgcatcggctgtttttcaagtgatgaaaggcatgtctccaaaggtcaatatggatccgttcgtgttgcccttggtggatatgtttgatcgtgtaggcgagctgatggagccgtggaatcccagccacgaagtcatgagcggcttgattcgggtcgatctgccagacttcgatcgaggggcattccgtgaggcaatgattaacgctttctgccatcgcgattatgcacgaatgggttcggtgaggttcctggttgatgatgatgggttgaccatagccaaccccggaggattcatagagggtgtttccgaagataacctgcttactgcacaaccgcgttcccgcaatccgcagcttgccctgattctgaaagctgccggatatgttgaacgcaccggacgaggcgtggataccatctatgccgggtcgattgcggcaggcggttctttcccggattattcacagtccagtgctgaggaagttatcttgttcttgcgccgcgtggtacctgacgaggcattcgtaaccatgattggcgacgaggaacgtcgacgtggggctccattgccggtctggtcactgattgtgctctcgctgctgcgtgagcatcgtaggcttaccgtggtccaattgtgcgatttttctcatttggagcatcgacgcatcgtgtccgctgttgagaatctggtggaagctggtttggtagagggggtcggtagcgggagctctcgttcgtatatgctgagtgcccgagtgtacaaacgttcagaggggctggcgtcttacgtgcgccagcgtgacatcgatgccacccggcgcagtggccttgttctggagttcgccgaaaaaaatgatggtgtcgtcactacggcggatgtcatggatttgtttggcctgagctatatcagtgcataccgggtgttgaagaagctagaggatgcgggcaagttgcgccgcgaggggaatggaccgtcatcccgatacgtgttggaatgattggtacgcgtgaaagtaagttctttcatcacctttcaataattctttcatgtaagaactctctgtttacatgtaagaattattgcaagatgatgcaagatgcacacaaaacggggaagctctgcttgatgtgagcggggcttccccatatgcgctggtgtgtagatcagcctgtgttctgcaggccggcagcgacgccggagacggtgcacaggatgaggtagatgaatcctgcctgttggctttgcgagagctcttccttgtccaccttcttgcgcagcgacctgagggcgagcacctgggtgacggacagcgcgtccacgtacggggagcggatgcggatggcctggccgagcacgtggcggtgctgcagcggccacttgtcgcccacgatgcgctcaagttagtccggtcaatggctttggaaaatcatggggagtgcggctgcgcgggttcgctcctcgacaaggtgacttgatttgggaccgccgttaactttcgtcagacacatcgtaaatcccgtccaagtatccgtatcgtccgttgtgcttgtccttcgagaattcgacgatattgatgttatcgtcaagaggaatgccagccatgtgattcgtgttttcgataatgatgatttgttgtgaaaccgcttgtttcgctagataggaaaacaggcccactttcatggatgagtcttccaggggtcgtattccttcgtcaaacccatgcagaggcgtatcaataagcagccaacccggagtatgctttgactgttcattgagataatcatgaaatgcgagcataacaacgctgttaagaaatgcgcagtatcccttgccttgttcatcagccttggaataccctgctatttcgacatcaaaagaagatctgctgaaatctgcagtatcagcaccttgaaaatgacattgttgcagaatgctgcgtatggtgttattcatggaataccagaaatcactctggaaacattcgcgtggcttgtatttttcatcattctgtgttgcttgaccagcgtcatcgagtgccttgttgaaacgagcatgcagcgctatgagttccgcatattccgcatgcaattgttctgcatgggcaatttgctcaatatcttgttgcatgtgctgcgctgttggttgaatgtcggatttgagcgaatgcatattttgccgatgctgctgtttctccagatgcagctcctgttgcacctcatcggctttgtcgacgaggatggctagatcggtttcaacgtctgcttggattctgtggatatgctcaatttctgttgagacgattagaatgtcctgttcagtcggcacagacatgtggatggggctgtggcaaaactgacatgtggcgggataggcatgtgtgcgggcatgtttcattgcctgtagttgcaaatcaagacgtgcagcgtctgattcgtattgactgataagtaccttacgttggcgaataagtacctcaaggtgctcatattgttgattaagctgagagatatgtgagatggtatgggcatctcgattgaggagagtttgtctttgctgttctacgtgtaatgcttttttgtgaaggtcttccaaataggtgtgaatggtcttcccctcatttgttgcgatatggcgcatctcctcaaggtgtctgatgcgaggctctatatcatccaactgctgatggatgaactgttccacggcttttctgcgggcgtgacgttcgctggcactctctgtctgtatggagttgtcgatttttttcatcttgaactagcacgagcaacgaggacagactttgtgtgagagttgctagagaggtacttttggggaaaagaatggaggggcgtgcacgtcctatttggtcctcggggacaatcatgagatgtctgatggcattccatgtgaaagcaactgtatggtaggtttcgtttgtcgctattctacgggttgattcaacgcctagtaaggcaagaagaaccgtattgattgatttaccggcacgtgatgaaacggagtaggaaccggggacgatcattgggttgctggattttacatggatagtgttctgaacgtgaatcgaacgactaagcgaaacctcaccgccgttggtcacgaacgtgacctgtgcaatttcataggcagttttatcggtaaaggggagctctttccctccgcaggcaaattccacggtttttgcgattctggttttcccggtgttcgaagcgccgataatgcagttcagcccgcatgtgagattaatggcggattccactccgtcctttctgattgccgaaattcgacgtatccatgtgtttctcataactggttgttctctttcgttattcggttcatgatggtttcataatcgttttttatcaagagctgaacagcctgtcgataggaggcagcgtaatcgccgtgcaatgcttccgaatattggaaacattccggagtggcgcggtacaacaggcaagtggaatccacggttgctgctccaacgattacgagttgggctaatcctgcttgtattcgtttgcgacgagcatcatattcggctaaagcatgtggaccatcgccgtgaagattgcgctgtccgaatccgaatgttttcatataggtggcgataaggtcaatggctgtgatttcgtcaattgtggaaggtctagaaagaaggggaaggcataatgtcaatcgtgttgctgtttcctgtgttgtgttaaataatgaattattcattttcgtgtacccactccagcatatggtcgttgaccagcatatgacacagccctttcttttccgctgccttaatcattgatgggaattgggctataactgaaccggatagggggaaaccggctgcctgagatagcgttgctcgcatgcgtaacagtccatcggcgtaatcagatgcgcaggtatcgcatattccgtcataaagatcaaccttcagtgcatcaaattcttgctctccgttttctataacatcccgtagattcctgcgcattccttccgcatcgtaaaaatattcacgttgcttggcgtattcaggacgacatgtctgaggaagatcgtcggaacagttgattggcttgtgcaagtgatcggcataggcggcttgcatctgcgtgaggtatgtcttttcaagatgatcatctggtttatccggtggaattggataagccttccaggggaccgaagagcgcccaaggtgcaatttgccgttgttgatgcgaccagacgccagaggtaagttttcgaaaatatcgaatttcggctgaaagcttatgccgtcgatgagaatgtcacgtccaccggcattcgcctggagtattgacagaagccattttcctgtggcagaaggaagctcactgatatccgtaactctaatatttgccttgataagctccttttgaaaatcggcaagggcatcaatgctgatatcgcagcaaagacgttctactttcgagatatctaggcgctgataaaactcggcggctttccaggcaggaatcttcttgcgaccgttataaaaacgagtcagatcagtatcgttgattccagaccagaccccggtggtaatagtggtctttccgggtttgcggtttcgatgatgttggggaagtggatttcttagaccgtcatcctctaacacagcatcgaagaaatccttcataaatccctttttgtggtggtctacgccagatatataagggtttacgagctgacagaagactcccagagcataggtagcagtagtttcggccaagtgagtctccttctcgtctccatttgtcttcatccgtcgccttcccatgaggtcactgttcctacgatggaagccagattcagacgaataagccggtaaaacactggaatatcgccagtatacgccgcttacagctggatcagagaagcgcaactttcgtctattgaaaggatttgagaccagacacatcgtaatttcttcttcaactcgatgtcatgcgataaccggttatagaagtagggcattgggctgttcatccgttgtgccgcagtgaagctgactggggcttttaactaatcacatgcatgagatctgcctgcttattcatggtgacgcgtcggttttctcctgaactgacgcgtcatgcttatccagcaggttggatgctcatgtggtggcctatgcaagcaggtctcgaagacccaataactgggtgggatcgagactggaatgagaatttcattgaaacatgaggcaatgcgcgccggtaatgtgtccgtaactgatatatacaactgttcggaagtggaattacggacgatggttgaacgcgatagatgtttgcgcgcaatccgtatgggttgttcgccacgtgatattgcactacgtacccctcaaacgatacttcaggaattgtggaatgcggaggaacgttccgctcacgcttattatcgatcggaccgtgtcagcggagttatttgctcctatgaggatttggttggtgcagggcgggaaccccaggggtgttctgcttcttctgaggatattctcttatgcgcggaggatgcgagagaaagagctaactgtttgcaagctatctttgcggagatcgaaaaactgccagcaggtcagcgcaatatcgtcaggggtgtactggtaaagggggcatctcaatcagatatggcacgagagctgggcgtgtcccgagctgcggtgtccaaacagctttcaacggctgtgcgcaaaattcgtgccgctattcgcgacgaaagcaaagaaacgaagaacacgacaacatcagcagtttgtgaaagaaaggagcattaatggttcatttcagtgttatcagagtgaaaggaagcccgtcatatgacttcgatgcatgcggagacattttggctatggccaaagctgtaggtgtcatgacggaaaacatgcgcactgatcgctgcgacaatacacagtgtgatggaagtcgttgtaagggaaacactatgtttcggttggagttagacaccgaaaatcgcagagttcatcgcagacgccatgccagatgaaacgcccgaggttaacacctcgtggcgaaacggcagtgcaggtgagggcagatattgggtctgccttcagcaacaggtcccgaaggaggacatcatgactgatcagatggtgctgcagacgcagcagtggctgaacaagacatacgggaatgatccccgattcaagaaaatcaacccggacggcagaactggttggccgacaatctatgcgcttactcgcgcattgcagattgaattgggcatccagtccactgccgataacttcggtccttccacccagcggttattcaagcagcggtatccgaatggggtgcggcagcaggcagttgcggacaagagcacttccaacgtgtattccatcattcagggggcgctgtggtgcaagggctactccactggtggcaacatctcacagcatttctacgacggaacaggttccgcgatcaggaagcttaaggctgatatgggcatagagggagattccagcgtagacgttgagatcatgggggcgttgctctcgatgaagcagttcgtgctgctggcctcttatggcggtatcgactccgtccgtagggcacagcagttcatcaacaaagcatatcgtccatacacgggcatcattccgactgatggactgtacggcagggagatgaacacggctcttatccaggtgcttcagtcgcttgaaggtttttcacccagtgaggcaacggggaatttcggcaacggaactagatctcgtttgaaaacgataacagcaaataacgcatcctctaatgagtcgtgggtctggctcgccagcacggctttggcgtgtaatgggatcgggggcgggccgaccttcgtatggacgagcacgttcgccaatatcgtgaaagcgttccaggagcgttatgccattgctgtgacgggctctattgattcgaccacgtggatgagcctgttgacatctaaaggtgatcctgaccgtccgtgtgtggcctgtgacactaggttcgaaattaccgacgccaggttggcgacgttgaaggcagacgggtatgaaatcgtgggacgttatctgacggagcctggccagtcgtcgttggcgcccaaggattactttaaggccatccgtccgggtgagctcgagcgcatcactcggggcggcatgcggttcttcccgatcttccaggagtactccacgaagctggagcatttcaccccggcaaacggcgctgctcatgccaagaccgctcgtgaggcggcgcagcgtcttggcatccctcccacccatatctacttcgctgtagacttcgatgcgaccgatgaccaggtgaccagcaatatcctgccatacttccgtgcggtttgttcgtctcttggtggtggatacggagtagggatttacgcgtcccgcaatatttgttcccgcgtcatcggtgcgggatgcgcgagtaacgcgtttgtgtccgacatgtcgacgggattctcgggcaatctcggcttccccatcccggacggttgggtctatgaccagttcaccgagattgacgattacaagggccagggctgggatctggaccgtgttgcctattccgggaaggtatcagcatgcgcttcactgttgcctgccgtgccagtgcctgcgcctgatcccgatcccgtctcgccagaaacggatccgctgctaagatgggtcgccgtcacggagcaggagtgtcgcaaagcccttgccgctctgggtacccaggtagcggtttacgaggacagcatcggtcaattcatcctggaatggctccgcaaacctgaatactggtcggaaggcggtagcgggacacaagcaatgtggcacgcatatactcctgaagtttcgactccgcccgacttggacgcggcgcgtgtggtatgtgccaatgtatgcgaagcacagccttcaattaaagagaaactgccatcgactcgagatgttgcacacatggctgcaactgctctcggatacctgacatggggtatcgaaaacaatccagccaaatatggtctaggcgatttaggtggctggcctctcgacttgttgcagatctggggtgcctatcgccgtgacggcaagcatgccgacttggcagcatggctctataagcaccttgggaaagatgaaggattcgggtacgatgacgttcttgcggatgcagatgcatggctaattgcttctagtatgaggaaacgatccggttcgacggttctttctgctgctatgcgtgaaacgtttaagcagagtgagacccatcgtatcgttcgattctacgacgaacgttttgcatcaagcgcagataatgtggtgagtgcatattcaacaatggcggacggtcttgatgcacttggtttgacaaatattggaatgagcgaaagcatcctaaaaaaggctgccggtacagacaagcttcctgataagcaggaagctgaagtgagtgctcgggcgttcgctgcattcattgatcagccaagacggtagctcgcataatgcattatgtgtgggcagatgtgtcgtctgcccacacattcgctgttgtgctttcgatttggaattcctctgccagatacggggaaacttctaaaaggccgctatgccgaggaagagtcctgtaataccggtggccatcaatacgatgatggtgatgattccggcgaagatgcgtacaggaagggtttcttttccatggtttgatgggctgtccgcaactaatctcattactccagctgtaacccagcaaactgcgcccaggactagtgccaggaattctcgacaccattccgtttcaagtgcgggaatgccgacgattgatgacgggtcgcttgccagtcttggcggaatagcgcataggatacgctccaatatcaggtaaggggtatcaaaatggatcagagtcaaagcgaatgggagctgtagcgccagtcctatccaccacagcgtgcgtcggatggtcgcgagtctgtcgcccggcctagtgtccggcttgccgccttcgccctccgtcccggcaccgtccgcgggcgtgtggtccccctcgtgcgcgtccgtcgtcccgtccgtgtccctttccgcgtccatatgtccccctccgatcatccgagtctgtcgctcggcccgcgcgcccgttccgtgcgcgccgtcgccggccagtctagggccgtgcgacgcgaacggggaggcccgcgccgtcaatcggcacggaacctccccgttcatcaagcggtcggacagccgcggatcagcccgtgttccgcaggccggcggcgacacccgagcaggagtgtcacaaagcccctgccgctctgggtacccaggtggcggtttatgaggacagcatcggtcaactcatcctgcaatggctccgcaaacctacgtactggtcggaaggtagttccggcacgcaggcactatggcatgcatacacaccggagccggttactcccagcgaattggccttgtcgcgtcaggcatgcggtgtcgcatgtgatgcacagcctgtcatcaaaggcacgctgcccaatcgggacatcgcccatatggctgccacatccttgggatacttgacatggggcgttacgaacgatccaatggactatggtctcggtgatctgggcggatgggctctggatttgctgcagatttggggaagctacctggcgaataccccgaaagaggacctggcgtcatggctgcacgctcatctcggcgagcaagacgctcgtatgggattcagttacagcgatgttctcgcggactgtgatgcatggttgctggcgcggtccatgcagagcaattcttccgaaaggtctttgtccaccgctatgcgggacatgttcgcgcaaagcgagacgaatcgaattaaacggttctatcagtcccggttcaagggaagtgcggacaacctggtcatcgcatttcgaaagcttgttgatggaatcgatcttggaatattcgataacgtatccggaagtaaaaaagcactgctcattgcgtcacatgcagaccgactcccgagtcaagcggaggctggtatattggcattatcctatgctgaatctcttgaaaatccgaaccgttaatcaatcatgattgtgatcgcattgcgtggaatgattcagccattccacgcaatgcgcctctggtaaaacgtcatagagtcattagagcggaaagtagcgttatcacaagaacgggaaagaccatgaccagcacgagaaacgatatgattcccacaaggacatgcgaggcggaagaggaatgatcacgaagttccggatatacagatcgcatatatgaacgcacgccaaagatgacaagcgccgcaatccagcagactacccccataatcaatactaaggtaagtctacgtacatactcagttgccgtagttaaattcatgcacgaagaggaagagaacgttaagactctgcagattatagtatcatcatcgccattggcgccccattccgcccacaaaataagtgctggtgaaagcagcagtaatcccagccaccatagcacgcgtctggccttgcccaaagccacatagcatctactcgccttaaggaatttggtagctgctttcggtgccaaagcatatttcttgccggaaaaattttctgacgtatcttccaggccatgttttttcccaatgtcatcgatcatagccggattcgctttgcaaatgtggcgttcgtttccggcatcgccctccgccttgatgccgtccgttggcccggtgctcccgcgctcattcgatggcttgtccatgtcccctccgatcatccgagtctgtcactcggccagcgcgcccgttctatgcgcgccgtcgccggccagtctagggccgtgcgacgcgaacggggaggcccgcgccgtttatcggcacggaacctccccgctcgcttttcccgatcggtcggccgggaatcagcccgtgttctgcaggcccgcggcgacgccggagacggtgcacaggatgaggtagatgaatccggcctgttggctttgcgagagctcttccttgtccaccttcttgcgcagcgacttgagcgccagcacctgagtgacggacagcgcgtccacgtatggggagcggatgcggatggcctggccgagcacgtgacggtgctgcagcggccacttgtcgcccacgatggccagaacccacttgcgggtgagctccatctcgttgagtaccttctcattgaggtcctcgcggtcgccgagggcaaggtacatcctggcgatgcgctcatccgtcttggcgatggacatctcgatgttgtcgatgaaggtggagaacagcggccattcctcgtaagcctgacgcatggtctccagatcgccgaacttctcgcatgcggtgccgagaccgtaccaggcggccaggttgatgcgggcctgagcccaggagaagatccacggaatcgtgcgcaggtcgtcgagcgacttggcgccgaggccacgcttggccgggcgggagccgatcggcagcaggccgatttcggtcagcggcgtaacgatcgagaaccacggggcaaagccgtcggtgttcaacaggtcgaggaagcggttgtgcgcggcctcgtcgagctgagcggccatgtcggcatacttctcggtcatctcggtgttgcgcttctccacgctcggcgcggactgcagcaaggtcgccgcagccacggactcgacgtggcggatggccagcaccgggttgccgtaacgggcgaagatgacctcgccctgctcggtgagcttgaagcggcacttgacggaaccgaccggctgggcgagcaccgcgcggttggcggggccgccgccacgaccgacggcaccgccgcggccatggaacagggtcaggtcgatgtcgtgcgactcagcccatttggcgatgcgctcctgagcggagtgcagggccagcgtggcggaggtcgggccggcgtccttcgaggagtcggagtagccgagcatgacctcgagcttgttgccggtggccttcagacgagcctgaacctcggggatcttgatcatttcctcgagcacgtccaccgagttctgcagatcctcaagctgctcgaacagcgggatcacgtcgatggtgggcacgtcctccgggtgggagaaggccaagcggttgagctcgtagacatccttgatgttctgggcgctcttggtgaaggagatgatgtagcggcgggcggccttgaggccgttgcgcttctggatggcaccgagggcgcggaaggtgtcgagcacctcgtgcgtcatcggctgcagttcgccgcgctcgccgtgcaggccgtgctcgcggatatccgcaagggcgcgggcgtgcaccacggagtgctgacggaactccatctccaccatgtggaagccgaaggtctcggtctgccagatcagatcctgcagcgggccgtaagcggaacgcttggcaccggcggcggccagcgaacgctggaccaccttgaggtcggcgaggaagtcgtcgcaggagtggtacatgaggtcggcgtcgcgctcgatggtgtagtgcagacgatcggccatcaccagcatgaccgcgcggtgcatctccttggtggagatcagggcggccttgtcggtcaggcgctcgctcatttccttctggtggctccagaggctcttgagctcggcgctcggcggcgtggtctcggcttccatcgtgaggttgcggcccacggtgcgggtggcttgctcaagggcggcgatcacgtgatcggagaacttgcgggccacggcgcggctcaccttggcggtgacgttcgggttaccgtcgcggtcggagccgatccagctgcccgggtggaagaacgcggggcaagcgggctcgacgagaccggccttatcgcccaggacccagtcgtcgaagcgacggtagaccttggggatggtgttgaacagcgtgttgtcgaagatgtcgagaatcgtgtccgcttcctcaaccggggtcggcttcttcagcgcgatcggagaggtgcggaacagggcgtcgatctcgttgtagagacggcgcaggcattccttcttatccgagccgccgaggcgcttgtactcctcaagcaattcggaaacgcggcgaatcttgccttccacggccttgcgacgggcctcagtggggtgcgccgtgaagacggggtggaattcgagctggttgagcagttccttggccttggccgggccagtctcattgatgagctggtggtaggcgacggtgagctcgttgatcgggtcgaccgcctggtcaacgggcacgttgttctcgcgctcgtggagcacggaaacgcggtagttctcctcggacaggtttgccagatggaaatacgtggcgaacgcgcgggccagcagctgggcgtcgtgcaacgtcatgttgtcgatgacgttcacggcctccttcaggccatcctggtcggggttcggatccttcagctcggcgaaatgctcggcgctggcctccaccgcgtaatgacgcacggtgtcgaacgtagacagcagttcggggttgtattcgcccagtacgttacgcaggatctcaagacacagatccatgtcgtacttcaggctttcgggaagatcatgctcctccgggccctttcggccggtcccggtagtgacgatggcggcgtcagcgggagtgatctgttcttcaggtgttgccatataacctcctttgccgaataacaggttgctcggtctactggtcgtctgcggctcctccgcagttgttgagaccagtcgttgcgagcccacagcccatattcaacgtggttgttgtgtgggcaatagtgtatccccgcgaaatcgctttttacgttacgaagtccatatagtgcgccaagttgtccacctatagagaccgaatatcggacagcatatgagacactgtccgattcgcggaagatttgagcgccttacgattgctggcggggaaggcagggagtagtaatgaaggatgtgagcgaacagaagaaaaaaagtgcgcccgaagcgaaaggcgcaacggctgtacgtaaattccacacccactccattccgctggacatggaagatattgcacgcgattgggaaaaaccggtggtggacgccggtatcgccgccaaagccagcgtgattgtacgagtcggcatgttggacctgggagccggcaccggctccttccgcgtgcgtgaaatgatgcaccgcatcgcctacccgctgggcgtgcacgtacgcgccgacgtgaacctgacggatatcgaggccacctgcacggatggtcgtaaccgcatcaccgaagtcgtggatttgccgagtaccggcgtgaacaccgaacgtatctggctgctggaacatttcgccgactggttctccgtgaatctcggcaaggggtcgatgtatcacgtcgattcgcaactgtccgatggcgtggtcaagcatttggacgaacgtgacgcttcgcagtattcggccgatctggccaagcgcctgcgcgaacgtgccaaggtcgaggctgaggcggccaacggcagcgtggacgaggcgctggatcttgcgtcgaaaaccaaggtactcgtgacctccgtggccaagtccttggacgatgacaatgaagaagcccaccgacttttggcggacagcgcggaagtcactccggtcgaagacaaagcggccgaagagaaggcctacgacgatgccgaagtgtttaccggtgactccaatgagtcggttgaatcggcgaacgcggcgaacggcgcaaccgccgaaagccctgctgcaagcagtacgaagcgtaagaatcgcgtgcccaaggaatacgccgaacacttcaacgagcgctccgacgaagagaaggccaagggcggtatcaccgtgcggcaggcgcacgagcgactcgatctgattgagcgccgcaagccgctgtacaagccgtggttctccggtctggcctccgccctagcctgcgcggccttcgtgttcctgctcggcggcggcccatacgacatgatcggtgcgttcgtgggcgcgggccttggccagtggatgcgtcgccggctgtttgcataccatctgaaccagttcttcgtcacctttgtgtgtgtggccgcggcggcgctcgcctgcaccggcaccctgcgactcatcggcattttcgacccagtcgcgctctcgcacgatacggcctacatcggcgccatgctgttcgtgatccccggtttcccgctcatcacaggcggactcgacatggcgaaaatcgacttcccctcgggcatccagcgcgtggcgtacgtgctgtgcatcatcctgatggccacgctggcaggctgggccgtggccgtgatggtgcacctgcacccggaaggctttgagccactggggcttgacccgtgggtcaacggattgctgcgattcgtggcggcgttcgtcggcgtgtggggcttctccgtgctgttcaattcgccgcagcgcatgtgcctgaccgccgccctgatcggtgcgatcacggacacgctgcgcttggaattgcaagacttcaacgtggcacccgagatggctaccttcatcggcgcgtttctggcgggcattctggcatcggtgtggcgttcatccgtgcgacgtggctggctaccgccgcacctcggctacccgcgcatctgcctgaccgtgccgtcgatcgtgatcatggtgcccggtctgtatatgtatcgtgccatgtggtacctcggcagcttccagaccatgaatgcgctggactgggcgttccgtgcgttcatggtgattatctgtctgccgatcggcttggcgatggcccgcgtggtgaccgacaagtcctggcgctacgacatctgaccgtcatcttggctctcctcaggtggggggagctcggataaaacagcgtctcagtatggaaacggtggaaggtgcttgagcccttgtatccactaccatcaggcgaagtgcgttgcggccgtattcacggctgtgacggtctgtatgacgccgctccggcgtcaatcgcatatcagcacatagttctgccatggcggtagccgcttggcgtcatgattgaggaggggcgcagttggccaacgatttctggattctgctggccatggtcatctattttgcggccatgctgtccatcggattcatctactccaaacgctccaactcctcctccaaggaatactttgcgggcgggcgcggcgtggggccgtggctcacggccctgagcgccgaagcctccgacatgagcggctggctgctgatgggcctgccgggcctggcctacttcactggtgcggccgacccgatgtggaccgccgtcggactggcgctcggcacctatctcaactggaagcttgtggcccggcgactgcgccgctactcggtagtgaccgacgatgccatcaccattcctgacttcttcgccaagcgtttccatgacaagaagggcgtgatctccaccatcgcggccgtgatcatcctggtgttcttcagcgtgtacgtgggcagctgcttcgtgaccgtgggcaagctgttcgccacgttgttcggtttcgactaccacgtcatgatgatcatcggcgcggtggtcgtgttcgtctacaccgtggtgggcggctacttgtcggtggtgatgaccgacttcattcaaggcatgctcatgttcttcgcgctcgcggtggtgttcatcggcaccgtggccagcgcgggcggtgtcgacaacaccgtggaattcctgcgtgccatccccggctacctgtccggcacgcaggtggccgcgcccaagctggacccggccaccggccagcagctcgtcgaggcgggcaaggccgtgttcggcgcgccctccgactacggcatcatcaccatcatctccatgctggcgtggggcctgggttacttcggtatgccgcaggtgctggtgcgcttcctgtccatccgcagcgtggaagaagtgcgcaagtcccgaatcatcgccacctcctggtgcgtgatttcgctgggttgcgcagtgtgcatcggcttggtggggcgtgcgatgatgcccaccgaactgctgacctccaccgatgcggaaaccatcttcatcgtgctggcgcagaccctgctgccgagcttcatgtgcggcgtggtggtctccggcattttcgcggcctcgatgagctccagctcctcgtatctgatcatcggcgcttcggccatgggcgagaacatcttccgcgggctgctgcaccgcaaggccaccgacaagcaggtcatgattgtggccagggtcacgctggtggtcatgttcctgttcggcattctggtggcatacgaccagaactcgtcgatcttccaggtggtgtcttacgcgtgggccgggcttggtgcctcattcggcccgttgatgctgtgctcgctatactggcgtcgcgccaacaaggccggcgccgtggccggcatgctgtccggcacggcggccgtgctgatctggcacaacctcgtcaagcccttgggcggcgtattcgccatctatgagctgctgccggcgttcatcatttcgctgctgttcatcgtggtggtttcgttgctgaccgccaagccgaacaagcgcatgctctacgaattcgaccactacatggacgatccgctgcccggcaccctgccgtccggcaccgtgctcgtcgacgagcccatggaagccatggagtccgaggtccgcagcggcaaatgacacgtgcctgctgtgcggtcggctcgtatggcagaggagtggcttttttgtggttcggcaggaaccattgaggccaaaacggacttcgaggggctgatttgacgttctggagagatctacttccgtttcaaggggctgatgcctgagtagacgcggctccaaaacggcggaatggcgttgacgtaagggcattgatacacgtggtctaccggatgatcagccccttgaaacggaagtagacctccggcggaggccaaatcagccccttgaaatgggttttgaataccgtagcgcggtgcggacggtgcggactgactctaccgggcttattattcctgcgtcgtcggaataattggcagcagaggctcgaatttcagccgtttgtacagtggaatacggcgtagctttcggacatcgctaatttgctgggtagtttgccgcatcgtgagctggactgttttgcccgtaacctcctgtatcctttcggcaactcttcgggcaagggcctcttctcccgcttcgtcgccaatatctaatttggtgacttgaatgtacttccagccagcatcttcgatcatctggcggcgtctcgcgtcattcagccattgcccggcatgatgagagccttcgtattcgatacatatcttgaattcagggtatgcaagatcgagatatatgggtctggtgttgtttcctacgaatattggataattcacctgcgggcaattcagaccgtatttcaagagaaccaaacgagttcgtgtttccatggaggaatctgtgcccgcgcgcgccaaaagtagggcgcgacggcatttgttatacccgcggaacaaatacgaattggtgccattctctttgtcggctcgcacctgggcctcggcctcatcgagatacagagaaagggcgtcgatggttgttctgcagagccttcgatctcgtcgcatcatggaatcagcgagaacgatgagttcttcaagttcgagatacgtggagaacatggcccatgtgcaagctggtgaagtgcatgtgaattgtccctcgattatgaccgtgtctagtggaaaaggccatacaaccactttgacccccacaatgtgccgtttgtcattggcgtgtggaaccgcaacaatggttgtagttgcaaggcctctgtgtttgcttgatatgcggggtacttcaattgacaaaagctccaacgctgttgtcagggcatagggtgggcgccatgcgcttcgtcgttgaacatctgcgcacgtctgcattcgttggtacttctgcattgtcagctcggtcaatgccgttgagctacccatgatgatcaccccttcgtgatgttcgctttgtcctcgcagtgtagagtccggctaccggccctgtctaccgccccaatttttcggtggataaatgtggataagtcggtggataaactatgggtgttcatcgcagttgcaggccatcccgcaattacatggaacgtaggggtttgcaggcagccagcgggaatcgccgtcgacggcgcgattcaacttggacgaatctccatggcgttcatgcaaaggtggcatgatggccggtatgagtagcttggtgcgtattgtcaatgccggtgttccggggtctcaggaccgcgtggatgtggtgcttcgcgatggggttgttgcgtctgtcggccctgctggaacggtctcggcttcggacagcacgatgcagactaaggcgcatacgacatcgttggaatacgcgacgaatgccattgcttctggcagcgtctcaatcccaacgtcggccgccgcacccgccgacgaaaccaccatcgacgccgacggcctgtgggttattcccggcctgtgggactgccacacgcacttcacgcaatgggctaagacgctgggccgactggacctcatcaatgcccgttccgccgccgaagcgatggacatgttgcgccgtcatctggatgagcgccgcgccgccgacacgcttgacccagatgccttcgtggtgggcatgcgattccgtcactcgctgtgggccgacgacgagcagcccacactggccgcaattgacgccgtgaccggcgaacagccggtggccctctccagcgcggacatgcactgcggatgggtgaattccgccgcggcccgcaggcttggcgtacatgtggacgaatccggtctggtcggtgaactcgaatggttcaacgcctacaccgccttcgacaaggcgccgggcgctgctgaagagactgaccgtctgctgcgcgaggccgaacaggacgccgcaagcaagggcgtggtgggcatccgcgattatgaaatggccgaaaacatcgatacatggatcaatcgtttcgcggccggcattaacggtttgcgcgtggacgccggtgtataccccgagcggttgcgagccgccattgacgcgggttggcataccggcaaggaattgccgggcagcgccgggcttggccatgtgggcgccatgaagctcatctcggacggatcgctcaacacccgctccgcctactgctccacgccgtattcgggcatcgagccgctgacgtatggcacgctgagctacacgccgcagcaaatcgaagactatatgcgcctagccaccgagcatggcttcgacattgcctgccacgccattggcgacgaagcgaacaccattgcgctcaacgcagtcgccgccacgcacgtacatggatcgatcgagcatgcgcagatgctcaaacccgtcgatatcccgcgtttcgccgagctggggctcacggccagcatccagccgcagcacgccatggatgaccgcgacgtcatcacccgtttctgggccaacccggccggcatcccttatccgttcagggccctccacgacgccggtaccacgctgcgcatgggctcggatgcgcccgtggccccgctggacccgtggctggccatttccgccgccgtgctcggcaccgaaagctctgaccgcgagccgttccagcccgagcagtgcctcgatgtgcatacctcgctggcagcctcgaccgccactggccgtgaccgccttgcatccggcgacccggccgatgtggtgttgctggacgccgacccatacgccgccgatactccggaagccatgcgcgctatgccgcaacacgtcgtaatgacattgctgtgcggggagcgtacgtattgatgcaagccatcggcatgaagtgaacagaggtccgtcttgatagccgcgttgcacggaaaaacaagaaatccgcccctcgaagtgaagataggacacagcagacgccgcaatacaaaaacgccgtgtcagttgcccagttggggctgacacggcgtcttgctacgagcggcgggaaaatcagtacttcatgcccatggcctcgcgcacctggtcgagggtctcctcggcgatggcgttggcgcgcttgttgccgtcgtgcaggatgtcacgaatggaatccatgtccttggccagctcggcgcggcgctcgcggtgcggggccaggaactcgttgactgattcgatgacgtatgccttgagcgcgccggcgccggaatcaccgatctcctcggcgatgtccttcgggtcgcggccggtcaccaggccggcggtggtcagcagggcggagacctgcgggcgggcaaccgggtcgaaggtgatgcggcgctcggaatcggtcgggctcttcttgatgagcttggcggtttcctcggcggtggcgcccagcatgatggagttgccgtacgacttgctcatcttgcggccgtcgagacccggaatctccggtgcctcagacagaatggcggccggctccgggaacaccgggttcttcttggcgtaacgctcgttgaaacggcgggcgatggtgcgcgtgatttccacgtgcggcaggttgtccttgccgatcggcacgacattggccttgcagaagaggatgtcgcacgcctgatgcaccgggtaggtgagcagcagaccggtcagcgcgtggccggacgcctccatctcggacttcacggtcgggttgcggtgcagctcggcctcggtgaccaaggacaggaacggcagcagtagctggttctcggccggcacggcggagtgggtgaacatcatggtcttgttcggatcgatgccggcggccatgtagtcgagcaccaggttcagcacgttgtcttggatgtgctcggtggtgtcgcggtcggtgatcacctggtagtcggcgatgatgatgttcgtgttgacgccgcgctcctgcatggcgacacgctcacggatcgagccgaagtagtggccgaggtgcagccggccggtcgggcggtcgccggtcaacatggtgaaggacgacggcttggcctccagcttggcgagcgtttcgtccgaacgctttttggccgcgaggaagctcgcgctcatctcattgcctgccgctgtcagttgctgctcgtcggtcatgcgaaaatcctttgaatatgccctaaataaacgctttttatggtaaaagtgtgagccgacaacgaacaagccactattagtggtactctctattgttgatgaatcgaacagcacagtaatcgcagggggtcagatgggccgcggacgtcaaaaagcaaaacagcagaaaattgcccgaaagctcaagtacctgaccaccgataccgactacgatgagctggcaaaagagctgagcgagcaggagccgggaatgggctctcctgacccgttcgccgacatcgatgaccagtatgcggacaaggatgtggattccgctgctgatgaccacgcttccggtgccgccgaggcagctcccgctacgcaggaggatgacctcgacgagtacgccaagtgggctgccgaagccgccgcaaaggcgaccagcggcgagttcccggcctccgcgcctgccgcaccgaagccggccccgcgcaagccgattccgatgcccatgccttccgcgctcaagcccaagaagagctgaacgccggtcttctcgtaataatccccttgtgcttggttgagcacaaggggatttgtggttatggctgatggtgccgccgctggtggcttacttacgcttcgcgcctcacagcggcagcaggtcgctcaggtcgtcgcgctcgccgaccgcgctgatgtggccggcgtccttttcctctgcccatgtggtgatgccgcaggccagccgcagccagacttccgggtccagctcgatgacgtccggcggggtcaggttatgcgggtccgattccgggccgtccaagattttgaccgcccccacggcgcgacacgcacctccacgccagggccgggtgcgcgccgctccagcagaaacagcgagtagcgcacggccatcgcccacaccgggcgtggcaagacaggggagacggtcagacgatgtggtgtgttgtccgccagctcccgggccgcggcacgccattgcaccagcgcgtcatgcccgcgtttcaggtctttttcaagaattactgccatgtatcccatcatggcaccggagccggaagatcttccataatgcaaacgatggcatacggtgtgatgcggaatatcggggcatgtgctacgctctaaatgagaacgtatgcaagaacgctccgccatcgtcgttacggagagttcatgcttacgtttgtgcgacgatacctatcgcgcggcataataaacacgggcacttatcccggaaggaaagtcagaatgaccgaaatcaccgcaccgaagtctcctgtcacggcggaacaattcgccgacgagattcgtgaacaactgaaatacactcagaacgtcaccaccgagcaggctacccctgctgacgtgtatgtcgccgcatccaaggccgtgcgcaaccaccttgccgactcctggttcaagacccaggccgacaccgtgaacggcaacaccaaggccgtcggctacctgtccgcagaattcctgatgggtaagcagctgcgcaacgcgctgctcaacgccggtctgaccgagcagttcgacaaggccgtggaagccctcggcttcaaggtccaggacgtcgtcgacgccgaatacgagccgggcctcggcaacggcggcctcggccgtctggccgcctgcttcatcgactccctcgcctcgctgggcgtgccggccttcggctacggcatccagtacaagtacggcatcttcaagcaggagttcgacaaggacggcaagcaggtcgaaaccccggactactggctggccaacgaagagccgtggggccacatcgactacaaccgcgaccagaaggtttccttcggcggcaaggtcgtcgagaacgccgacggcaccaagacctggcagcccgcatggtccgtgcgcgccgtgccggtggactacctggtccccggctacaagtccggccgcgtgaacaccctgcgcctgtggagcgccaagagctacgacgagttcgatctgctcgccttcaaccgctccgagtacatggaagccgtgaccccgcaggtcaaggccgagaacatctccaagattctctacccggaagactccaccaaggtcggcaaggaactgcgccttgagcagcagtacttcttcgtctccgcctccctgcacgacgccatccgcgtcttctacccgggccaggacaagccggatctgacgactttcccgaacaagatcgtcttccagctcaacgacacccacccggtgatcggcatccccgagctcatgcgcatcctcatcgatgagtacggctacgactgggataccgcgtggtccatcaccaccaagaccttcaactacacctgccacaccctgctgccggaggcccttgaggtctggccggccagcctgatcggcgagctgctgccgcgtcaccttgagatcatcgagaagatcaacgcgcagttcgaggacgagctcaagtccaagggcgtcgacaagaacaccatcaaggacatggccatctacactggcgacgccgtgcgcatggcctacttggccacctacggcggctcccacgtcaacggcgtggccgagctgcactcccagctcctgaaggacgtcactctcaagaacttctccgacgtctacccggacaagttcaccaacgtgaccaacggcgtgactccgcgtcgcttcgtcaagctcgccaacccgcgcctgtccgacctcatcaccgagggcctcggcaccgacaagtggctctccgacctggagatgctcaagggcctcgagccgctggccaaggacgatgaattcgtcaagaagttcgccgccgtcaagaaggccaacaaggtcgacttcgccgcctacgccaagcgcgagtacggcttcgagctcgacccgaacaccatgttcaacaccatggttaagcgcctgcacgagtacaagcgccagtccctgaagatcctgtccgtcatctccacctacgccgacatcaagtccggcaaggtcaaggccgaggacgtcaccccgcgcaccgtgttcttcggtgccaaggccgccccgggctactacctggccaagatgaccatccagctcatcaacaacgtctcccgcgtggtcaacaacgatccggacgtcaagggcaagctggccgtgtacttcccgtggaactacaatgtgcgcctcgcccagcacctgattcccgccaccgacctcgacgagcagatctcgcaggccggcaaggaggcctcgggtaccggcaacatgaagttcgccctcaacggcgcgatgaccgtcggtacgctcgatggcgcgaacgtcgagatccgtgagcgcgtcggcgccgagaacttcttcctgttcggcatgaccgtcgacgaggtcgagaagaagtacgccgagggctacaatcccgcctcctactacgaggccgacccgcgcctgaagcacgccatcgatatggtggccgacggcaccttctccaacggcgaccgcaacgcctactccccgctcgtggccgactggctgaccaaggactggttcatgaccttggccgacttctccgcctacatggacatccagtccgagatcgaggccctctacgctgatgagctcgaatggaaccgcaaggccctgctcaacgtggccaactccggctacttcagctccgaccgctccatggaagactatttggaacgtatctggcacactgctcctctggcctgacggccgccggagcggcgcgccagctacgtgctggtttctacctcgcggctgtcgccgctcggcgtcgcctacgggaagcccaccgggcttcccgcttaacggctccgcgtatctggcacactgctcctctggcctgacggccgccggagcataagaagccccgcaaccgacatccatcggttgcggggcttcttgcgttgaaagaccgccctatcaggcttcggccggggcggctttcgcctcgtcatcggcctcatcctcggccttattcagacctaggtcgaccggcgaggagctgttctcccacggctcctcccacggatcgtaatccgggttctgctgcttgtagatgtacaggccaacaagcgcggcgagcaatccgccgaacagcagcgcgaagaacttccaaccgttagaagacttgttctccatgacggctcctttccctagggatcgtctggtcggtatgcccattcagaccgactctgctccctattctaggccgctgtttgtgacgattgggtggaatgacattcgtgggcgattcatccgcgcccgtctgcccttggccggctcggcatcttcgcggcgcgtggaacgcatccgagaccttcgatacagtgggctgcatgcatattcctacacaacgggagattcgataccagtgggagcgcggtggtccggtgatgacctgggcgctgattgttgcgtgcgtggcagtgtggctactggaggtattgttgggatttattgccccgggcctgagggcttggttgatgtacctcggcatggcggctccggtcagactggtggctgagccgtggacgctcatcacctcgatgttcctgcatgcgccgaactcgctattgcatatcctgttcaacatgattgctctgtattccgtgggcccagtgctggaacgaatgatcggccactggcggttcttgggactgtatgtgatttccggccttggcggctccctgggacttatggtgtgggctgcggtggctccgggaggcatcggctggcagatggcagcctatggggcttctggagccttatttggcctgtttgcatcattgctggtggtatatcgccgtatcggcgccgatatccgctccatgttgatctggatggcggtgaacttcgccttgccgttcgtggtcggtggcgtggcgtggcaggcgcatgtcggcggctttgtagtgggtggaatactcacatggctgctggtgggtggtgtgccggcgtggcgcggtaaaagcctgaaatggcgcatgcaggtgtacggctgggccatggtggtgctggtcattgcgttgattctgttgtgcaatatggccaatccttacgggtggatgagtttcggctccctgcactgatatggcttgatatggctgtaaaaaaaaacgattgatgccgggtattgcggaacatgcagtgcccggcatcagtgtatgtgcggaaagcggcgatgtggatatcgtcgttcggcgagtgggtgtgtgccgtatgaagatatccacagtaatgagatgcgcgcaatgacgagttatccacgataatgagttatccacaatggtgacttgtgcacaagtgtgtagaaaagtgcataagactgtggataacttatgtggataagttaggaatgccgcggtattattgggtttgttgcagtggataactcgggtgtataactgttccctcgctgtggcgatgtatgccaagccaaagttatgcacgagatatacaccgagaaacgccgcttatccaccacttatccacatggttttccacattcggtggaaaactacatgggtgtaattcatccacaggctgtggataacgtagtggataagtcgtggataagtggtggatagctgtggatgaacaggctaaggcacgaaaaaggccgacctccgcatacgggaggtcggcctttctcataagaattaaggacaacctaacgatagaaaaaaacaatctaccgatagataagcgcaacgagccggaactcagcgccatcccatcgtcatcaggaatccgatcatgatcagggcgaagccgatgccgaggttccacgcaccgatgttcggaatcggccaggaaccggacggggagaggtagtacaccacgcaccaaatcaggccgatgatcataaacgcgcagaacagcggcacgaaccaacgcgggttcgacttggtgcccttaatggtttcttcaacgcgcttggtgttctccgcctggcggttcatcatacgctgcatctgcggggtcagcgtggccttatcggcagtggcgttgagcacggcctgcacctgctccatattcacgccgtaagccgcgccttcctcggcagaagcgttctctgcgttctgctcggtgtctttgctggcggtctcgtcagcaacggtgctggatgaggtctcgctctgccagtccttctggttgttcgagtcggtttcgtgcagctcttcgtcagccatcagcatagtctccattcaataggctaaaagtcataatagtggctacactcgaaagcggcgaccagagtcggcaagaagacaggaaattcatggccagacatgtaggtaagcacggtgcacggcactccctatggggtggtgtcgcggtattcgtcgtcattgccttgaccggttttctgctgagcaccaacgtgagggtcaatcgtacggttgccgccaccaacgatacggccgatctggtggagcaaggcgtggacgaggccaaccagctgcagcaggacgtcagcgatctgaccaaacaggtcgccaatcttacggacgcgctcaaggccgatggcaccgatggcaccgacagcacacagaaccaaggcaaggactccagcaatgtggattccagcctgatgctgcccgcgctcagcggcagcggcgtaacggtaacgctggatgattctccgttgtgggagaacgcagtcaacaacaacggcacgaccgccaatatcaacgattacgtgatccaccagcaggacgtcgaatcggtggtgaatgccttgtgggccggcggtgccgatgcgctgatgattatggatcagcgggtgctgttcaattcggcggtcatctgttccggcaacgtgctgtcgttgcacggtaagaaatactcgccgccgttcaccatttccgcgattggtgaccctcaaagacttcgcgcagcgttgaacgactccgaagccattaccattcttaagcaatatgtgaccgcgtttggcattggctacaaggtggagaatgccgaggaccttcagttccccgctaccgccgccttgctgcagcagttgaaatatgccacggtcgatacgtcaaagaccacagatgaggagcagactcagcaatgagacacggcaggcacaacagcggcgtaccggcgcccattgatctcgcgtccgtgtcggacgtacagcccttccccgaggacgatgccgcacgaatggcggcagacccggccaacgccagtagggcaaggtcccgtcgtgccgcagtacgcggcgcgtcttcgccccagcggagcccggtctggcaggcactcggcatctgcgccgaactgctgattaccgctgccgtgatttgcgccctgtacatcgtctggcagatgtggtggaccggtgtcgaggcggagcgagcccagaacgaaaccacccagtccgtcgactggagcgaccccagcaacaacgggggaacggtcaccatcgccaaagcccaggagggcgatgcgccggtacagccgaaagacgcgaaatatggcgacttgattgcgcagatctacattccgcgcttcggctcccaatggcaccgcaacatcgtggaaggcaccacgctcgagcagctcaatcgccacggtctgggccattacgacaccacccagatgccggggcaggtcggcaacttcgccgtcgccggccaccgcaacggctacgggcagccgttgggcgatgtggacaagttgcaggaaggcgatcccatcatcgttcgtaccaaggattactggtacgtctaccactacacccggtacgagattgtgctgcccacggacgtgcatgtgatcgcccccaatccggaagactccactgccaatcccaccaaacgcatgatcacactgaccacctgtgagccgaaatactccacccccacccatcgatggatcagctatggtgagttggcgtactgggccaaagtgtccgacggtgtgcccaaagagctggctactactgattcgtccggtgcagtgatgttctccaccaccgaaacccctcgatcgcttcccgcattggctcgctggacaaggtggtattcggcgcgctggtagtgtggctggttctgttcattgccgctgcggtggcatggcgctggccggtgctgcgcgagattcgcgcgggtgagcgtcgccgtccggatgccagcatctatggcggactgttgcgtctgcagcccggcgtggcaccgattcgatggttgctgctggctctgctgctgttcgcagccgccgcggcgctgttccagtggggattcccttgggccgccgccaatatcccattcctacagcagatgtcgaacttcgtggcagcgagctgacggcatcctagtactatggcttgcagtacacgtccctcaaggagagccctatgaccgattccgcgcatattttggtggtggataactacgattccttcgtctacacgatcgtaggctatctgcaaacccttggcgccactgttgatgtggtgcgtaacgacgctatcgacccagccgcgccgggtgtactggacggttacgatggcgtgctgatttctcccggccctggtgctccggccgaatccggtgccagtgaggatatgattcgcctgtgcgcggccagcggcgtgccgatgtttggtgtgtgcctgggcttgcaggcgctcgctgaggtgtacggctgcactgtggaccatgcgcccaccatcatgcatggcaagaccagcttggtggaacatatcgatgacgagattttcgagggcgtggccaaccccatgaccgccacccgctaccattcgttggccgtcgagcccgattcggtgccggatacgctggtggttaccgcgtggacgcaaggcgaccacattattcagggcgtgcgtgtcaagggcaagccgatgtacgccgtgcaattccatcccgaatccgtgatgacccaggacggctaccgtctgctggccaactggctcaaggtctgcggccaagacaacgccgtggccaagtccgccggcctccagcccaaagttacgaagtagcttttccgcgcggcgatactctccccggaatgtgtcgctagaacgaggcttgcgtactggttttgcgacgcttcccgggattgttgcgctgggatagctctttatacagcaaaggggaggggcgcagaagcccttcccctttgtgttgcgtgtatgtgttgcgctatttgcgttgcatatgcgcaacacatacacgcccggcgcttacttgctactcaccggttcactcaccggttccgcccccgttgccagtaccgttgccaccgtctccggtaccggtaccgccgccagtgctgccggccttcgtggtaatggtgacggtcgatcccgcatctacctggctgccagcgccaggattgatgctgactaccacagcggtgctgccggttggaccattggcctgagccttgaggcccacggccttgagcatgagttcggcggtgacgtagtcagtgccagcggtgatattcggcacagcgaccttctccttgcccgtggacacccaaatggtgatgaacccgccctgtgcgatggaagagcccgaatcagggcttacacggataatcagaccggcctccaccgtatcggagctctcctgctccacagtgaagctgaacttgccctcatactgctgtagcacgctgtccttcgactgaccgaccaaattgctcggtacggtggtcatgccggaagaaacatatatggtgatggtggtgcccttgggaaccgactgaccggcggcaggatcggttttcgtcaccatatccttggcgatgtcggcgctgtcttcggttttgacggcggcgttcaccttgaacccggcgctttccagaatgctgcgcgcctcttcctggctgcgttccttgacatccggaacctgagtggactgcgggcctgcggagaaccacaccttcacggcagatcccttggccaccttggagccggcgtccgggctcatcttggtgcaggtgccttccggctcggtggagtcggtgtcttgcttttcggtcatcttcaaacccgatgccttgagtttgagctcgatgctgtccttggatgtggaagcgttgcacacctcagggatggtgacggtgtcttccgaggacttgttgccggagccgttcatggcgaacacgatgcccacaatgacaagcactgcaacaatcgctgcgatcaccgaaccgatgatgatcttcttgcgcttcttggccttggccgccgccgcacgctgctgcgcacgggactgcaacgccgctgagttggcaccattggccggtggaatctgctcgaactgaccggtcaccgggttgaatgcttgggtgggttgctgatgcggttccaccggcgtggtgggcaaatcacgttcggcttccttgcgggccttcatattcgacaggtccgtcaacgggttgaacgcggccgccaccggcacgccgccgttcatgtaggtcaggatgtcggtcttgaattcggaggccgtggcatagcgattctggcggtccttggccatggccttggcgcagatcgaatcccacatcttcggcagccccggcaccacggcggatggcggcgtggcgacttcggaaacatgctggtaggcgatggccacggcggaatcgccggtaaacggcgggcggccggtgagcatctcgtagagcacgcagccggcggaatacaggtcggaacgcatgtcgacggtctcgccgcgcgcctgctcgggagaaaggtactgtgcggtgcccaccacgccctgcgactgggtcatggtggctgcggaatcgtccagagcgcgggcgatgccgaagtccatgaccttgaccacgccctgctcggaaatcatgatgttgccgggcttgatatcgcggtggataatgcccatgcgatgcgaatagtcgagcgcgttaagcacgcccaacatcacctgttcgcagtcgcgctggctgagtgcgccgttgaccttgatgatgtcgcgcagggtctggcccttgacgtattccatgacgatgtatggcagacgctcggcatcgccgctttcggaagaaaccagttcttctcccgaatcgtagatgttcacgatgttcgggttgttcatctgggccacggcgtgtgcttcgcggcggaaacgggccaggaagatgtcgtcgttggccagatcggcgcgcatgattttcacggccacggtacggcccagacgggtgtcaagagccacgtggacctcggccatgccgccacgaccgatgagctggccaagctggtagcgtccgccggccaatgcggtgggcatactggtgctcattgcttattccctcccaatcttgaggccggggcctccaaaacaatgcgtggcgtgctggtcactcggcgcggcagtcgattgccggacgtggccatggcggtgtcggccatttcggtctgctgatccagcagacggcgttcgatgcgtgccagcgtacgggacaccaccagcgcgtctttcgggcgatccaacgggtccttggccagcattgacatgacaaattcgcgtaactggacgtccaccgagtccggcagcggaggcacgggattgttcacgtgcgctgcggcgatatcgaccggagtggtgccggtgaacggacgatgcccggcaaggccctcgtacgccactacgcccagtgaatagatgtccgattgcggcgtggcctgctggccctgcgcctgctcgggggagatgtattgtgcggtgcccaccaccatgccgtcctgggtgatctggccttggccggtggagtagctcacgccgaaatcggtgatcttcacttcgccggtgtcggaaaccatgatgttggccggcttgacgtcacgatgaatcacgccgtgcgagtgggccacgaacaggcctcgcgcggtctgaatcaggatgggcagcagttcgatgggatccatcgcgcccttgctatggaacagatccgccaacgatttcgaggggacgtattccataatcagaaagccgatgccgtcatgctcgtagtattcgaacaacgcagcgatgttcgggtgcgccagattggcggaattatgggcttcggcacgcaggcggcgcaacttggcctcggcgttggtcacgtccgagcgcagcgccttgatggccacttcacggccgagctgaatatcgtagcctttccagacctcgcccataccgccttgcgcaagacgcgaatcaagacgatatcggcggtgaataagctgtccttcgataagtttcactgctgcaaagcctcctgcatcatcgcgcgcatgatcgggccagcggcgagcgaaccgtatacatctgtgttatgcaccaacaccgcgacggcgatttgcggatcgtccgccggcgcgaaaccgatcacccagccgtcgatggcagagttgtcggtaccgatttgtgcggtaccggttttggccgccaccttgatgccgtcgatggccagctgcggattggcctcggacaccacgctttccatcatcgtggtgagcttgtctgcggaatccttgctgaacgcattggccatggtctgcggcttggtctgcgaaagcacggtgagatcggcggcgcgcacacgatcgaccagcgtgggctgcatcagtttgccgttgttggcgattgcctgcgcgaccatcgccatctgcaacggcgtggccgtggtgtcgccttggccgatggacgccagcgcaagcttgtcgtcggtcggatcagaggggaatgtggacgcggtggccgtcatcggggtgcccgtggattcggtgccgtcaatggtgatggtgctgccgaaaccaagcttggtggccatgtccgaaaccttgctcgcgccgagtttcacgccaagctgggcgaacgcggtattggacgaccatgcgacggcctcttgcagggagatctgcccgttgacgccatcggcctgtgcctcggcgttcggcaactgtgtggcggttcccggcaaggtatagctggcgcccgcaggaatcttcgtgtccgtctgataatcgccggtttccagcgcagccgaggcgacgatggtcttgaacgtggaccctggtgggtacagctgcgaggtggcgcggttgattagagggctattttggcccgcagaaagttcgttgtaggcctgagacgcggctttggtgtcatgggtcgccagtttgttcggatcataactgggcgtgctcaccatggcgaggatacgaccggtgctgacttcgatggccaccgccgcaccatcgcgcgtaccgagctgatcgtaggcaacctgctgcagcttggggtcgatggaggtttcgatggacgcgccctgatccgtagcgccggtgagcatggccttggcccgctgccagatcaatgaatcggcctcaccgttgagcagcatgctgcgggaggcttccaggccgcgatcggcggtctggttgatggagaagaagccggtgaccggagcatacagcggaccgttggaataggtgcgcaggtatttgaacgcgtcgttgaccggctcggatttggccatgaccgtgccgtccgaggccagaatggcaccgcggtaggcgccgagctggtggtacagcgaacgggcgttgcgcggatcgttgttcagcgcgttggcccgtaccgccatgatgatggtggacgacaggccgagaatcacgaacagcgcgaccacggcggtgaaaagctgacgaagatatttgttcatacgcgagtgcctccgttaacgggaggaagcgggggaatcgtgccggtaggcgtgtacggttcatcggcttcggcatacgacggagtggtggtatccacgatggggtcgtcaaacgatttcgactcggactgcgacgccgtagccgacgcgctgcgaggctgaacgatcggctcagtggcgcgggcccgggcctcaagttccttgttgcgcagcacggccaaagcctcgtactggaacgtatccgaggtcagctccggctcgggcgcattggccgaattcgagatgatgatgagcagggtcgcgagaatatagttggcgatcagactggagccaccggccgccatatagggcagggtcagaccggtcagaggaatcaccagcgtgatgccgccgaccacggtgaacacctggaaggccatggtgaacaccagtccggaagcgagcagcttgccgaagccatccttgattttcatggcggtgataaagccggaggcaatgatgagcaggtagagcatcaaaatggccaggacgcccatcagaccgagttcctcgcccagagaggcgtagatgaaatcggagttcgcaaacgtaacgagcgaaggatggccttggccgagaccggtgccgagcatgccgcctgatgccaggccgaaaatgccggtgaccagctgccaggagccgccgggggtcttgttgtattgctcgttgctaaacgggtgcagccaggcatcgactcgctgacccacgtggctgaacatgcctgcggccagcacggcacccgcggcgaacgcgatcagaccgatgatgatccagcttttacggccggtggccgtgtacagcatggccacgaacatggcgaagaacataagcgaggtgcccagatcatgctgcatgatgagcacgcccatcgaggcgatccacaccacgatgatcgggccgagatccttgatacgcggcagctgcagaccgagcatcttcttaccgcccacggccagctggtcgcgatgatcgaacaggtaggcggcgaagaagaacgcaaggaacagcttggcgaactcgcccggctggaactggcccagtcccggaatcctgatccaaatgcgcgcgccgttcacttcctgaccgacaaacggcagcatcggggcgagcagcagcaccaagcccaccaccatcgacacgtaggagaagcgccgcagcacgcggtagtccttcaggaagatgatgagcagcgcggaaagcacgatggcgatgcacagccagatcagctgacgttgggcaaccgcccaaccttcgctctggtcgatgcgggcgatcatggtcacgccagtggcggtcagcagtagcacgcaaggcagaatcgactggctggcgtacggctggaagcgcacaatcagcccccacagcaccagaaacagcactacgaccaatgccagcatgccggcgtattgcatagggaattcgccggcggtgcgctggaacatctggatgaacgccaacgcactgattgccatggcaatcagcaacaaagaaatctgacgtagacgggtagcgatcattgagaatctcccgtggccgcgttgtcggccgctccgataccggatttatccgaggaatcggatgagcttgacgaaccggacttgtctgacgaggagccggactggctggacgaatccttggtgccgtccttggaatcgctctgggaactgtctttggaactgtccggggaattggacgcctcggccttcttggcggcgtcggcttcctgctgcttggccagtttgcgcatttcggtgcggataatacccacatgcgactgcgcttcgtccaacgaaccgactgtgatgccttggctcagctggtcacgccatgtctgaggcaggtccgcggtggcgatattggtggtctgcacttcgtgcgaaagctcaagtccaaagagattggtcggcacgccacgataaatggctacggtgccgttgctatctcccacgtagtagtgcgtctggctccacgtgtacgcgccccagccggcgccggccaatgccagcacggcaagaatgcaggtaataatcaccgcaagcttattgcggcgcttcttggtgcgcgtggccttcttctgctcgacctgctcatcgcggatggctttggccacatccgggtcgttggggtcggcggacaggcgcccatccggcttttgcaccaccggaatctcaccggtatcgggattggctcgttcaccggtctcctcgcggacggtggacggctgcaccacgcgtgtggacgacggtttggccgtggtttgcgtggtctccgcctcgtgcgcgctggcgggctgaatcaatgctgcggcgcgctgggcgggggaatcatcctcacgcagtgcgggcgcggtagccaccggctcgttgacgatgtcggcaatcggctcaagattacggctggcggcaccgccgaccaacggcgtttggtgcggcaggtcgaacgcatcggcatccaacgccaacgtggcatccgcaataacggccgtgacattatcggtgctgcccgcccgcagtgccatctgcaccagacgctgcgcgcattcgccctgatcggacagcgtggtcatcgtctcttcgatggtggaatcttccagcacaccgcacaggccgtccgagcacagtagccaacggtcggcggggtgggctcggcgaaccgaaatatccgggcgcgggtcaatgtcaaagtcgccaagcacgcgcatcacgacgttgcgctgcgggtggttcttggcttcggacggggtgatacgaccggtgttgatgaggtgctgcacgtagctgtggtcgcacgtgatgcggctcaggcgtccgtcgcgcagcaggtaggcgcgcgaatcgccgatatgggcgatgacccagtagccggccaccaatgccactgcggtaacggtggtgcccatgccggcaagcttgcgttcgcgcttggccttgccgacgatggcgtcatgcgcggccataacggaggtttccatcatgcgggagatcgtctcgacgttgccaccggtgtcatcctgctcgatgtgggccagcgaccggatggcgatggaggatgccgtatcgccgccggcgtgaccgcccatgccgtcgcacatggcgatgagatgctcgccggcgaaggaggaatcctgattgttcgcgcgcacggtgcccacatcggacaccgtggtggaatacaggaacagcggttgtgaagcggcggattttggcatgcggctacctcagttcgaaggtggtggcgccgatgcgcacaggaatacgagcgggcagaatggtggggcggttgatgcgctgctggttgaccacggtgccattggtggagttcaggtcttcaatggcccactgcccggagcgcgtgtcacggtagacacgggcatggtgggaagacacgaattcgtcatcgagcaccacggtgttcgaggcggcgcggccaagcgtgatgtcggcttcggccagcggcacggagctgccggcaagcggaccatcgatgatgaccaacagggtaggctgcgccgaggcggcggacgacgcggaagcgctgggctggcgatgcgggcgcggcgcagctgcctgcggcgtttcggccttggccttatgcacttcacgctcacggcgacgacgcgcgcgcgaaggtcgcggactgaacgtctcgatgtccttgcgcagcgaacgtacggccagccagatgaatatccacagcaggatcaggaatccatacttgagcagggcgaatgtcagttcggtcataagtggacgactttcgggcgtgtgctcgactactcctgggcttgggcggaggcccagtacaggatgcgggtacggccgatggtgatggtgttgccgtcgagcagcgtggcggcgggcacttggtggccctccacgtacgtgccgttggtcgaacccaggtcgcgggcgatcacgccgttatccgtgatgtcgatttccaggtgcttgcgggagatgcccggatcgtcgatgacgatatcgcaaccggaaccgcggccgattaccgtcttgtctttggtgagcaggtactggttgccgttcacctcgagcaccgggctatcctcggtctgcgcatcggtggtgaccggcacggcattgccctgcacggattcggaggtgaggttgaagttgcccttggacaggtcaaggtcttcctcgaagatcacgatcaccggtcccacgaaggcgtaatgctggctcttcgcgtactcggtgaggttatcggccagttcgttggccagggtctcgctaccccatgcctcgatacggtcgaagtcaggagtactgagcttgaaacggtattcattcggggccaccgtgcggtcacggcccacgggcatggcctcggcgtcaatctcgcgctccaaggcgctggaaagatcgacaggctgcaggtctttggagccaaacttggcgaatactccgttgactgcaccctccacgcttttttcaaaacggtcgagaacgctcatagtcctccctttctaatcttcacccatcctacgcggtgatgggaatatgagacaaaaaaccggtctttcacgtgacgatgagtgcaaaatatccaaaaattcagggcggaaatgggtgcggcgcaccacccgaggtgctttaccggtggagcacctcgggtgggatgcgcgtgttatcgatctgtcaggccagcgcgtcgcgcaggaaatcgcgctggagagtgagcaggttttcggccacggtctcgtcattggtcatatgggtgatgcccgtcaacggcaggaaggtgtgcgggcgacccgccgccatcagggcttgcgagaggcgcaggctgtgggcgatggtgacgttgtcgtcggcgaaaccgtggatcagcataagcgggcgctcgagtttcggtgcgtcctgcacgatgccgttgcggtagtagacatccgggtcgaggcccagatagcgctcggtgtagtgcgtgtcgtacagcgtccaatcggtgggcggggcgccggcgcatgcggccttgaacacgttcggcgcgtccagcacggccagtgcggacaggaagccgccgtacgaccagccgatcatgcacaccttgtcgaggtccggcatgggaatcgcctcccgctggcgggaggtggcgcgaagcgccggtgggtggttctcggcgtctgcctgatcgcccgcagccggctgtgccgcacgtgattccacatcggcgttgagccgggcgacggcctcgggcagggcgttgacggcctcgacctgatcggccagcgttacgtccttcatatcctcgaagatctcgcggtcccatgccgggccgcggccggtggtgccacggccgtctgccgtgaccaccaggaagccttggtcggcccaccactggccctcccagtagaaggactgcgaggcgatgacctgctggaagccgggcccgccgtacggcttcatcagcaccggcagcttctcggcgtgcgcgtacgggctttccgggctcggcgcgatgatcgccgtgtacagctggtgctcgcccagtcgcgtaaacgtgacgttcggtgtaaagccgggtttggccgccgtggacgcgatagtggcgctctgttctcccagaatatgccgcatctgggcgcgggcggaacgcatatcgcggccggagaccacgatgccgcgctcgccgcgcgaggcggtccactggccgggatcggtcgtgaccggcgtgatcgtgccgttgtaatcgatactcaccacgtcgaaactgcgggcgtcgtggtcgccgaatacggactcggtggcggccgcatcggcccaagcgtccggcacctcaggcgcgatttcgggcgcgcgctgcaccacggccagcacatcctcgtcggtcacggcgagcaccgtgcgcacgttccagccagccggcgtgaacgggcggccgtccattgtcagacggttggtgtccgtggccatatcgttgagcgagcacaccagacgaccatccggcgtgtaggcgggcgtgccgtgaaccaggtcgatccactgctcgttcgcgtgctcctcaagcacacgcgtggcacccagcgcggccccatccgccgcgactgccacctcaagcacctgatcgcgggtctgacggcggttctgcaccagcaccagcggatcgtggccgcgacgccagttcacggcggccacatactcgtacgcctcgcgatcccaatccacatcggcgttgccggtgatgcccgcgtaccggtcgttctcatcgaacgccagcgtgatcacggtcaggtacacgtcggcgttgcgggtcagcgcgcgcgggtagcggcggccggcgtccggcttctcggggtcggccggatcgctgatgtaccaggtcggctcgtcggcggtgtcgaaagactcgaacagcacatgctgcgaatccggggcccaccagaaaccgtcgtaccggtccatttcttcgccggccacgaactcggccagaccgattttccacgtgttttcggccggattgccgtcctcatcctccacgctcacgccgtagaccgcggtgatgcggtcacctagctcgccgccgatatcgaccagcatcaggtagctgcccgtggtgtacagcacatgttcgccatccggggcgatgcgcgggttcagcaccggcgtgtacatcgccgggtcctcatcgagccattcgccggccagttcacgggtgtgcggctcgggtgcgccggtctcgtcattccaatcgatgtcggtcaggaacaggcggccgttgatggtgaacacgatgcgattgccgtcgtcatctgcggagtatccgacgatgccggtgccgccttcgcgcgcacgctcgcggcgggccttctcctcggccggcacgtcctcgctgtcggcggttgcgcccagcagttcgcgcgggtcggccagcttggtctcatggtgttcgccggactcgtcgaaccagctcagccacattgcggtcaccagatcctcggggccgtcggagcgcaggaacagggcccgcgagccgtcgcccacggtctgtgcggagcgcggtgcgccgcagccgaagcgcagcgtgcgcgcccggaggcgtgggaaatgcttgattgcgtcattgacatcattggtttcgctcatacctcacaacctacgcgcctgtgcggtcagtggcgcgcaggcttgcgacgcattcccgggaatgtgtcgtggtgtgggtgcgaggtgtgggcgtgaggcttgtcctaagatgggagccatgcaggtgacgatgatcgacgaaaacaagtacgccgaaacgatgaccgacgtggtgctgcccgcgctcgaacaatgctgcgaggagggctggttcgatccgtccgccgccgaacgttcggccgggatcgagccgctgtccggcattatggacaccggcggccgctcgggccagctgcactacctgtgctacgactccgccaaattcgacgcgattcgcgagcaaggcgccaccgccaccttccgcggggccatcgtcatcagccacggcttcaccgagttcgccgaaaagtacgacgagctcgtctggtacttcctgcttgccggctactcggtgtgtgtactcgagcatcgcggccacggcaagtccgcgcgcgacgtggacaaccgctgcatggtgtggattgatgactggcagcgctacgtggccgatctggccggcttcgccgaaaccatcggccagcagtacgcggccggcatgccgctgaacctgttctgccattcgatgggcggcggcatcggcgcggccgtgttggagcgataccccaccctgttcgacaaagcggtgctctctgccccgatgatcgcccccgccaccggcatgccgctgggcgtggcccgtgtgctggtcggcgcgctgtgcggactcggcttcggcaagaagcgcgtgttcgggcagtcgggcttcacgccggaattctcgatggaaggcaacgagggcgcttccgaagcgcgtgaacgctggtacttcaagctgcgttgcgagaatagcgaataccagacctactgcgcggcgttcgaatgggtgcgccaagcgttgaagctcaaccgggccatactgaatccgtccgcctgcgccgaagtggagacgccggtgctgctcttccagtccggacgcgacatctgggtactcaataagccgcagaatcacttcgtccaactggtcaaggacggcggcggcgaggcgaacatcgtgcgcttccccgaatcgcgccacgaaatcttctccatgcccaacagcacttacaagccctacctcgaaaagatcctcggcttctacgacgaccccatgattgcctgcgccgcgtactgatgtagctcttcacccattgttcaccgtgcggtcaccttgtggcccggcccgctttagatggcgggagagccatggaattatgggcataatgtcttctctccgccgccgcgccgccgcggttgcggccgcggcatgtgccggcgtgctcgcgttgaccggttgcacggcgttcaataattccgatgacggcacagcggacggcaacggcacgtccgccaccacgcagaccttccagccgtccggcggcaaaccgactgccaccctgagcattgcctccggctccgaaaacaaggaagtcgccgtcgccatccagaaagcggccgaccaatccaacgtagccgtgacgatgcactacatgggttcgctggagattatgaacgcgctcaaggccggcggccaggatcacgacgccgtctggcctgcctcctcgatgtggatttcgatgggagacaccaagcacatcgtcaaagacgcggccagcacctccaccacgccgatcgtgttcggcatcgccaaatccaaggccgtcaaactcggctgggctgacgacaccggtgccgccaagcccgtctccaccgcggacatcctcgccgcggtcagcgacggcaaactcacgttctccatgacctccgccacggtgatcgacagcgcgctcaacgtctaccagaccgcgctcaggaagcccagctggaccatttgggtggtcgattactccggttcgatgtctggagagggcaagaacggcgtggtcaaaggcctgaacgcggcgctcgacccggaccaggccaagaagtcgtacatcgagcccgccagcggcgacgtgaacattctcatcccgtttgaaaccgaggcccaccgcccggtcaaggccactggcacaagcaccagcgacctgctgcatgaggccgatgccaccgatgccagcggcggcaccgatatctatgaaggcctgctgagcgcgctcgacgagctgcccagcgagtcggaagcctcgcaatacaccaccgccatcgtgctcatgaccgacggccgctccaactccgatcatcaggatgaattcgaaagcgcctataagtcgcgcggccgtgatctgccgatcttctccatcatgttcggcgatgccgatcccagccagctgaagtctctcgccaccctgagcaacgccaaggtattcgacggccgctccggcgacctcgccgccgtcttccgccaagtcaagggcttcaactgatgctccaggtaatctgtggattcgttgtcggactgctgctcgccgggctcggtttcggactggtcggcggcggagtgcccggcctgatcgtggccgtggtactggccgcacttgggtatatcgccgcctccacgctcaccgagccggagcgacgcatcggcaaaatgctggtttccgccttgcccaacggtcagaagaccgccgatacgatcgacgcggcgaacgctcaactcaactcgatcgccatgctcaccaagcaagtacgtgacccagccgtcaaagccgaagccaacgacttcatcgccgctaccaaagatttagtgcaatacgtgacccgagacacctccgcctacccgacgttgcgccactacatcaccgtgtacggcgagcagaccgagaaactgttgcgctcctacgtggacgtggaaagttccggcgcacgcgatcagatagccacggcacgaatcgaaaccatcgaggcgctgcaagtgctcgaacagaccgccgccggcgaactcagccgggcggtaagcgccaagacgttgggcattacggccgactccgacgccatccaacggttggcccgcatggatggatacgacgacgtcgcaccttcgcctgtgccttcctcggctgctgatgaaggacggcatgcacccagtcagactccatctggcggcccggctcaccagtcggaccagaaaacggacgcacaatgaaactctccaaatcaaaaatcatcggactgatcgccctgcttgcggtagtgggcgtggtctgcggcacgctggtgtggcggcaatcgcaaccagcaccggccgaaccgaccgaacaggtgagcatcaccggctacctgggcggcgagaaaatcggcctgttcgatgacgccaagttcaaggcgctcgccgccaagcaaggcattgccatcgactatcgcaaggccggatcgccggccatgatggatacggaccggaaaggcatgggttacctgttcccctcctcgcgcgcggccgtcgaatacggcaatgcgaaaggcgtcaaggcccccaaagcgacatcgtcttcaactcaccgattgtgctatacacgcacaaggccgtggcggacgggctcgtgaacggcggacttgtgaccaaggacgattctggcgcgtaccacatggatatggccaaagccgtggacgcgatggtcgccaacacaacctgggccgacgtcggatacacggcaggctacgggcagttccgcatcgactcgaccgatccggtgaagtcgaactcaggcaacgaatacgcggcgcttcttgccacggtgctcaacggcgggcagccggccatggtcgattcggtggcgcgcgacggcaagaccatcgcctccatcttcgccaaatccggctggatggagacctcttccgaggattcgttcaaccagttcctgaccttgggcgtgggctccaagccgatgatggtgggctacgaatcgcagctgcttgatttggccgtgaaccagccggatgcgttcaagcagatcaaggacgacgtggtcatcgtctacccgacgccgaccgtgtggagcacccacacgctgatggccttggacgagaaaaggcggcacactgctgaacctgttgaaaacaccggcggtgcagaagctggcgtgggagcgccatggcttccgcgcggccaacttcgccggcaccgattcgatcagccgattcggcgtggccggcacgctcgaccagatcccggccgtatccgaactgcccaacaacgatgccatgcaacacctcatcaccaccctccaatccgcgcaagccaaactcgtggccgacatctccatgtacgacacgatgtacacgcagaacgcccagcaataccgcgagctgaaaatgaccgtactggccggcaagaaggcgctcgccgacttcaacgccaaccagctgccagcgctggaggccgaggccgccgccagtggcgacgccatgcaggcgcaagtgctgaagaacttcaagtccaagctcgaccgttttgccaagcgactcgacgacctcgaccgcatcagcgtggttaccttgcagaccgcgccgcagatcaaaatcatccagaacgcggaccagaccatcgtggacaagatcgacaccaccatctccaccacgattccggtgtggaagagtcagatggtgatcgcgctgggcctgtccaaccagcgcaaggttctcgacctgcagaacaaggccgacgatgtgaccaacaagctgctggcgcgtaacgcggccgccctgtacaagggtgcagtggacgcggaaaaggccaaccagtgttccgtggtggaaatcgacacgctggagaagatcaacgccgaactcatcgccaccctgaaggagaccgtgcagatccagaaggaaggcgaggccaaccgcgaggccgcccaggtcaagatgcgccaaatcgagtccgacctcaaaaacgccttgctcgaaaacgcccagcagatgtgagccgttcgcgcgccagcatgctcccgttggcggagtttgcgggaacgtgcaaccatgctcccgttggcagaggtatatgagtacgcctactggtgtgcgtatatatgctcccgctggcgggagctggcagccgtaagactggctgagggtggtcacggcgctcggctcggccggctttaccggcagccattcccgccgcaatttctctgtgggcataatcccggaatgattgccgcgctcgggaattggatgaagtgaaggttaaaggttgagagcccgggagggttccggaaccggccacgataaccgctgctagccccgcgatacgggttggcggccggcagccaagccgattctctcctaatcaaggagtaccgattatggcaatgtttccggctttgatgaatgacacgatgttctcggatctgttcgatgatccgttctttgagggttggcgcaacacggacaacacgatgagtgccgtaatgcccgccaacatgatgactaccgatgtgcgcgagaccgacaagggttacgacgtcgacatcgatatgcctggctttaagaaggaagatatcaaccttgagctcaacaacggctatctgaccgtgtccgcctcgcgttgcagcgagcatgaggacaaggctccggccgctgaggacgaggcttccgacagcaagtgtgcttgcgcgtccgattcgggcaagtggctgcgtcgcgaacgctacatgggctcctgctcgcgtagcttctacgttggcgaggacgtgaaggagtccgacatccacgccagctaccggaacggcacgctgtgcatccaggttccgaagatgcaggcccagccgcaagtcgagtccaagcaccaaatcgcgattgagggctgacgatacttgattcgtcccgaagtcccgcttcgagtagctttgccccctctgacgagggggctcccgcgaagcgggtgggggagagataaatcgtaaccaaaccatgcttcccacgccgtctgccctacgctttcaacgccgactaacctgacagacggcgggaaacatagccaatgcaaatgccgggtagggatttaccctacccggcattttgctgtttcaatcaccgaaccccaccctgttcgcgcgccggtcgcgtgccgttctgccgctgtacacatccgatgggtagagtgacttcgaaacgatgcgagagaggcggacatatggcgaacggcgcacagaacgcaagcggcacaccggcaccggcggcaagccattccggcggccacgtcgtatccgcgcgcgccacgaccatcggcctgatggcaatcctgctgtggagcttcatggccggcaccgtgcgcatcgtctccgaaaacttcggcgccacgcttggctcggccctgatctacacggtcggcggcatcctgctgctgatgttccggcgcccggccccgattcgcgagttccccaagaaatacctgattatcggcggcctgttgttcgtattttacgaatcgtcgatatccctctcgctgggtctggcctctaccgacgcatcctcggtggaagtgagcctggtcaactatctgtggcccacgatgatggtgctgctgtcggcgggcgtatcccatcgcaagcacgcggtcgtcaaggtgctgccgggcgcgatcgtggccactgccggcgtggtgttggcggtcggcggtaattccgggctcgactggcatgcggccgtgcagcatatcgccgccaaccctttgccctatgcgctggcgttcgtgggcgcgctcgcttggtcggtgtacgcggtgttcacgccagccatgagtcatggggtggacggcacttcattgttcttcccctgcgtggccgtggcgttgtggattatccacttcgcgtccgggcaggggtggccggccgagccgccgagtctggtcgcatggctgtttgtgttgattgccgcggcggcgattggcggtggttatgcctgctggggctatggcattctgcacgggtctatggagcggctggctattgcgtcctatgccacgccggtgctgtccaccggggccagtgcggtgttgctgggtttagcgctgtcgctgccgttttggtgtggcgcgctgctggtggccgtcggatcggtgcttaattacttggtcagtgcgcgcaaatagcggggtggctttgctcatggggcggtaataatcccatggggcggtaaaaccctcatggggcggtatcccaaaatggctttattctgccgtttcacaatttcttcaaaccgccccatgggccttttaccgccccatggataaattaccgcccgatgggcagcagcaacttactcgccgcgacgctcggacgggcggcgaatcgggtcaagcagcgtattcggatcggagatgccgaacatgctgcgcccgccggtggattcagggtgcttggcgagaacggccagcgaaatcgcccccggaatcataatgatcaccaaaagggccgccaatccccagttcacgaagaatccgagccccagtacgatggccaccacaaccaccaccgtgacgataatcgtcaacagtgctcgacgtgggttggtttccctggcccaagaggtgctggctgcgggctttgctgttgaactggccgcggcgtttgtggctgttgtgccatcagccgtgacggtcgtgggccttgccgccgcgctcgtcgcggggccagtaggggcgtcagacacgttatcggcggcattgccggtcgctgctggacgttgttcgtttgcgtgagtcatatccaccagcatattccctgcttccggctgaagctgggacaagcctgcgcgccgctaatccagcgccgacactggccttgaactgcgggcgccagaccggatgtgaacaggcgctgaacggagtctggggaaaccatgagaactcgcgacaatttttgtgaaattgggtgacgctctatgaatcgcgcgctagtgttgcgtgagcttacaaggcgaggagcctggagcgcgggggtgaaggatgaagaactccgtttggaaaacgttcatggaattgtctctggtccgcggaatcgtgccgcggaccgtgttcggactgaccgcgatcgcggcaatcatactgattattgggctggcattgagcaagagcaagaagcgcggccgcctgcacccgctgattgtctcgctgattgccgccgtgctcgccggcgcggctggactgctggttgcatggctggtgtccgacgtgtttatggtgttcggcgtatcgctgggctggccggtgatcttcaccatcgcgggcggcatcgccggcgtcggcttcgtgatcgccgcagccgtgaccctgcgcggggtccgccgtgcgctggccgtcgtgctggtgccgctggtgctgctgtccaccgcgctcggcgtggactcgatttacggcgaataccagaccatcggcaccctcgtcggctacacgccgtacgcctcgctcggctcaatcgaggtacacaaggccgcgatgagtgtcagcgactggcatagcaaggcgcggaagggcagcctgccgtccatgcccagccaaggcaaggtgctcaccgtcgacattccgaacgccaaatccaacttcacggcccgcaaggcgatgatctacctgccgcccgccgcgctgtccgaccgtccgccggccttgccggtgatggagctgttggccgggcagcccggtagccccagtcgcctcatcgacgccggcaacatcgccgccacgatgaatgcgtacgccgccaaacatgacgggctcgcgccgatcgtgctcgtgcccgaccagaacggcgaggccacgcacaacagcctgtgcgccgacaccacgcaaggcaacgccgaaacctacctcaccacagacgtggtgaactgggccaagaagatgctgcccgtggccaagtcggcccgcatgtgggcgatgggtgggttctcgcaaggcggcacctgcaccacgcagctcgtcccgcgtcatcccgaaatctacggcgcgatgttgccggtggacggcgaactcaagccgaccaacggcagcgtcggcaagatggtccaagagtatttcgccggcgaccgcaaggcatacgacgaacaggtgccggtcaacgccatcgcctccagcggcacatctgagcaggcgctgttcaccggtgctggcgaacgggacaaggaatcgattagcaacatgcgcacgattgccgccgccgcgcgcaaagccggcatggaggtcaccgagctgatcgtgcccggcgccggccacgactggcacgcggtgcaggcggtctggcggcccggtctcgactggtttggcgaacggaccggcttgggcgagatggcgaaatcgttgaaggagtacccacaagtggaggtgttgcaatgagcgaagaatcgcgtaagcacaacagtcatgcggcggaaagctggcgcgaactggccggcgacgtgcgacagtgggcggacggtcatcgactggccatcactgccacggtggcgctggtggtgctgaacttggtggtgtggctggtggtcgcgatggccggattcgcgttcccgctgcggctcgacaccagcatggccgaattcgatttcggcaaactcttctgcacgctgttcttggcgcgcggcgtcatccagctcattcttgatgccgtgctgtggctcgtcatgctgtcaatcgccgagccgtggcttggccgcgcacgtaccgtcggcaccgcgctcgcctgcgcgctcggcggcgtgatcgtgggcctgatcttgtgtgcggcggccggatggctgttccaggactcccaattcgtctcccgcatgcagttcgccctgagcccgctggtgttgccggtcggcgcgcttatggcggccagcgcgttctgcagccatctgttgcggcggcgtattcggctgatcggctacgtggcgattctggtcgcgctgctttacagcggcaatcctggcgattactgcattctcgccgccgcgctgatcggacacgcggtcggccgcgtgatggccgggtcgcccgcgcacgccgaaaccggatggcactggctgcgcagcacctccttcgaggcgcggcgcatgttcgcggccatcgccgtggtgctggcgctggggccggtcatcgccatcacctcgcataatcacgcggggccgctcagcacagtcggcctgctcatgagtccggtctccgtcgacgacggcacgctcgcgcgctgcctggccggcgccacgcacagcggctgcttcctgcaattcgacctgatgcgcgcctcgatgcccggcgcggtactgcgctcgctgctgcccaccgccgtgactctggtgctggcgtggggcctgtatcgcggacgtcggttcgcggccacctgcgccgtggccatcaacctgttcacggcgggcgttgccatcgcctattacctggtcgtgccgctgagctttgcgccggatggcatgacctccctgctgcagcacggcgcgatcaccgcctgcgtgacgaacaccttgccgccgctgatcttcgccatcgccttggctgcggcaatgaagcacttcccgattcgcgtcggctggcgccggctgatcggcggcgtcggtgccatcgtgctggttctgctggcgtgcgccgccgtgtacctgatgtacggcattgcccagccggacgccttctcgccgcgcgccacggcctcgtcgctgttggccgaactgccggggcgcttcctgcccatcggcttcctgagccatatgaagttgtcgttcgtgccgcgtaccccgatggcctcgatcgtgtatcagggcgtcggcctggtgttctggatcgtggtgctggtcgtggtgatccgctggatgagcgacgtgagcgaatcgaacgagcgggcgcaggcacgcgccgagcggctggtcgaaaccggcggcgaatcgatgagcttcatgactacgtgggaaggcaacagctactggctctcgcccacgggcaaatcggccgtggcatatcgcgtgctcaacggcatcgccttgacctgcaccgggccgttcggcgagccctccgagtggatggacgacctgaccggcttcacccagtattgcgtggagcggtcgctttcgccggtgttctacagcgtgcatcgcgaacagcgcgacgcgttgctggaggtcggctggagctccatcgaggtcggcagcgaaatggtcgtggacccgcgcggctggaagacgaccggcaagaaatggcaggatgtgcgcaccgccatcaacaaggccaagcgcgacggcgtgaccgatgtgcagtccacgttcctggaagcgtcgctcgatgtgcgcgagcagatcgaggacatctccgaggagtgggcgcagctcaaggcgctgccggaaatgaagttcacgctcggcggtgtcgaggaactgcgcgacccgcgcgtgcggctgctttacgccatcgacgcggacgggcgcgtgctgggcgtcaccagctggctgcccacctggcgcgacgggcgcatcgtcggctggacgctggacttcatgcgccatcgcaccgacagtcccaacggcattatggagttcctgatcgcgcgcatggccgagcgcctgcgcgacgaggggcttgcggatcctgagcatgccgtggagttcatgagcctgtccgcggcacccttggccggcatgaaccccgagcgagacaatgcccgggaaggtggggtggcggccggcgaaggcacgcaggtgctccaacacgcgctgcagatcgtggccgactggatggaacccgcctacggcttccactcgctgttcaacttcaagcgcaagttccagcccgccgaagcgccggtctacgtgtgctacccggacccggcggcgttgccgcagatcgggctcgcggtggtgcgcgcctacgtgcccagcgtgacgcccgccgaagtggccggcatgctcagtacgctgcggtcgtgaaggtgtgcacacgggtacgcaggctagccgattcgagcctgagacggggtatctgctttcaggaggtacatttggcctcttgcggacagctaactgccttcaaagagatacctaaactctgaaatcccgagtatgagcgttgcaatgacggcgtttgtactcggggtttcccgtattcagtacctctttgaacggagaaagcattctgcagaagcccgaatgtacctctttgagcggcgaaagcccagcgagaagggcgcagaaggcgctatctccgtttcgaggggttgatttggcctctccgggaggtctactcctgcttcgaggggctgatggccgagtattcacgctccaaaatcggcggaatggcgttgacgcggatgggcttttacatgcggtctagctgccgaccagcccccttgaaacgggagtagacctcctgcgaaggccgaatcagcccctcgaaagcggttttgccggtgcagaggtgtcgttgactgcatcgcgagccgcctcgacgtagtaacgtggggcgcatgagcgaacgtaacgaacacaatgacggaaatacgcaaaccgcatacttcgccggcggctgcttctggggactggagcgctacttccagaacgtcgacggcgtcacggacaccacggtcggctacgcgcaatccaccgtcgaatcgccgacctacgagcaggtatgcgcgggcggcacggatgcggccgaaaccgtgaaagtcgagtttaacccggcacaggtcagcctgcggacgctgacattactgttcctggaggtcattgacccgttctccgtggaccagcagggcgaagaccgcggccggcagtaccgcactggcatgttctacacggacgagacgcagcgcgccgtgtatgtggcggccttggagcagctggtcgaccgccagccgcagcgcccggccgtactggtcgaaccgctgcgcaacttctacccggccgaggcacatcatcaggactatctggtgaacaatcccggcggctactgccatgtgccgatcgccgcaatcgcgaacgtaaaacgccgtcagaagtacgtggaacgcatctgggatctgacgcttgagcagttcgcggtcacacagaacgccgctaccgagcgcccgttcgtcaacgagtatgacgaggagtttgagcccggcatttacgtggacatcgtcagcggcgagccgctgttctcgtcgcgagacaagttcgattccggctgcggctggcccgcgttctctcgcccgattgccggtgacttgctgaccgagcatgaggaccaccgcattccgggccgcgaccgcatcgaagtgcgcacgtcggacacacagattcacttgggccacgtgttcaccgacggcccggccgaccgcggcggcctgcgctactgcatgaattccgccgccctgcgcttcgtgccgcgctcgcgcatggccgaggaaggatacggcgactggatttcggttgtggatggggatgagcaggcatgagcatggagaatattgcgggcgctcgcaagcccgccaagcgtgaggatgagcacacggtcgccggcgagcatcgcatgatgcgccgcgcgtaaccgtggcatcgccgccacgttcgtgtcgcataattgctgcccggccacgtcataattcgccgtgccgcgtgggagcgctgtggcggctacgacgagtcgatgcgcggcgacgccaccgccagtcaagccttcatggcccaccccacctacggcgacggcggaatggccgccgccgtacggttgaggagctgatggtcagccggctaaatgccgatagagctctggatcgattggccgggccaaacgcaggaccgacagggtgaccttcacactgccctgtccggttgcgtcaggcttggtggtgagctgaggattctcaaacgcagcgacgtggccaacgtagtagtacttgccatcggcctcttccgccttgcgcatgacgaatagcgggacgaaatgtgtgtggtcccaattcgggccaatgccgctaagcgcccatcggaattccggagactgcggagtgcgtccgttcttgctgaagtatttcatttcctgtgtgctcaggaattcatcctcgtattggctggccgcgtatttcacgaagatgggcatggtgttggtttccttgtcgagcaggtaaccacccacgttttgcggagtgttttccttcttccatccgcacaggcgcatgacgtcagccatggaatatttgcgctcgtacaagaacatgtggtcgaagacctgttgcctggcggcggcctcgcggaacatatctcggcaattggccataccggtgcgcaaagtgtccgcgaagaagatgcggaacgttcggttcgtggcaagtatgtcggcgaatctgctgctcaaccgatatgcggtgtcgcttcctgtgccggtgctgttcaaggtttcgaccaatggctggttgccaaaacgattgcagttcgggccggtgaaatatgaataatcgagcacgctgatcgcagagtcgaattgcgcgtctgaaccatcggccagcgggaattcagtacgaatcgcatcgagcagttcgctgcggccgattgacgagcccgcactccaatgctgaggtacgtcgtcgtcgagccgttcgctgacgaaatggcatagctgagcaagaatgaccaattcgtgcggtcgcaatccgggcagcagcagctccgctgccatcttgagtatcgcgtcttcaacgtcggtcaccggctccaactgatcctcaaatgtcgcttcatgatgtttgcctttgcccaggcttttttcacgggaacgcacgaaatcaagatagttgctgcgcttcgatgcgatggtatacggcagtgaggggtcgtagttatagatgtccgtaagcatggggatgcggcccagctcgtaacggacttggcgatactgttcggacagctttttcatgtcggaccagtcggcggtgtccaaagacttaaggatgcgctccttggcgatcgggtcgaaactgatggacgacaggccgattgactttcgctgcaggttcttgcgagccctgtcgcggtcgccagtgttgccgtataacgccaccggaatcagatagttgttgttgtaattgccgatgaaatcgataaccacaacgctttctttgtgagggaatttgcgcagtccgcgcccgagctgctgcgtgaagataatgctggattcggtgctgcgcaacatgacgatttggttgacggcgggaatatcgactccctcattgaacatatcgacagtgaagagatagtcgagttcgccttcagtgagcttgcggacgtattcgtctcgctgcgcttgggacacgggcctgccgtcatcgtccgtgctggtaacggcagcggtgcgataggggcgttcatcttgttgattccactgctggttaaacagctgggacagcttatgggcttcctcctgtcggctgcagaacacgagtccggtgaccggaatgttgaactgcccatattcctgcaacttgtcaatgatgtagcggactcgcttttcggtggcaagctgctcgatctcgtacttgagctgtttcgagtccttcgcatcaagacccttggagacatcgagacgatgggcgattccattcggatcgtcgtcggagccaaggtattccgcaacgccgtagtagtggaatggacagagcatgttctcgtccaacgccttttgcaagcgaatttcgtacgcgatgttatgcccgaatagctcgaagatgttgatgccgtcggtgcgctctggcgtggcggtcatgccgagcatgaagtcggcatctttgaaatgattgatgacgcgctgatatccttcggctccagcgtgatgaacttcgtcaaccagaacgtagtcgaattcatcggatttgaattgcgccaaaacctccggctgccgcatcgtctgtaccgtggcgaatacgtagcggcggtcctgttgcttgctggtgcctgaatacaatcccaattcggattcatcacagccgagcaccttttggtaagagttcattgcggtttgaagaatcatctgctgttgggcgatgtacagcatgcgcttcggctggcattcgcgtacgtcgaatgcggaaaggtacgtctttccggtgccggtggccgacacgataattgcgcggtgctcgccttgttcacgaagtttcttgagattcgccaacgcctcctgttgcatggcgtttggctgaatgtcatgcccctcaaacgactgcagaatctcatgacgcggtggggcgtatttcttgaaatcttcctcatactgtttgatccactcttcggtcagcggaacggaatcggccacctgtgagtcgatttcatcctggaactgcccgaccagctctccatccgccagcgatgagactttgagattccattcgcgttgcgtggtcaatgcggctccagtgagattggaactgccaacgtacaggtcgtaatagggcgtaccgtctttcatgcggcgagaaaagatatatccctttggatggaatggctgtccttgagccattgcggccactgaggcattgcgggagccttcccacacgcgaacgtcaacaccagtggtgttctgaagatgcagcagctcccagaatgccctgggatcgttgaaatgatttttcgttgaggtaatcagtgtgcccgctcgggtcgctgtttcatggtgacttctgaagtcttcaaataagctgagcacggcctcagccgagacgaatgcgacagaaatgtcgaaggaatcgctagtagccaaggaattgccgatttcctcgcgcatggtcaatccaccggggcgatttgcgatgagggtcggcttatattcgccgggagcatctgagcgcggctcgatcagacctgagatgacatcttcgaggattgagggtgtcgggccaggatcactatgttgcgtgttggccggagagcttgaggtgctggccagattgatagacatgttgtcttgttcccttgcgattcgaattgtttgttgatgactgcatgactgcatggctgcgctatggcgcattcatcggagcgtcagctgtttgctggcgataatcgcgactgcttcgcgatctaccggagcccagttcaatgtcggcatatcggcaggattcagccatcggatatcagtatgctcggtgagatgcggtgtgccggcgatgaggtgacagacgaatgtagtgagccgtacggtcccaaagtcgtaggcgtattcgctggtgcacacttcttccgcgacttcaacttcgcataacagctcttcttcgatttcgcggtgtaaagcctgccgcgctgtttcatgaggttcgattttgccgccggggaattcccagtatccggccaacgacttccccggaccgcgttgtgcacatagtacggtgccgttggtgacgattgcggctcccacgacgttaatgattttgcgttccggatccatgaacaaccaggatacaacgcttcaagatccacaagcgatccacgatcctcgacagtttcgcaagaacgatcctgattcaatcggaactactggaatcgcagtgttctagggcatttgtggaacgaaaagaaaggctgatcaatggtgaatgaacggcagaccgatacgtgtgcggacgtgatgtacaggcgtgaacggcagagaggctgtggcgaagcagggctggacttcgcccctttcattccctcacaggatgaagttgatcagcagatgagcgcattggatgacaagcttgtgtccaaggctcaggaacaatacgcgaaccgagaaatctatcctttggacgagtgctatcagttggacgggtcgacgtttatctcagccgaggcgtttgaagagattcttggcgacgagcaaacgcattatatggcttggaaaaacggctgtattgataagctgtccattgattattgggagatgccggatgtgatggcctatcttgtggagcgcagcattgcggaaggtgacggcggtgaatgctgttatacggatgctcagccgattgattatgcggaagattgtgcgtactcgcccagcgagatgttggagtgcttaggcgccaattggcaagagcagggtgttgccgatgatggtttgagttacgcgttgtacgggcacccgaatatcaatgtcgagaacgtgtccggttcgatgatggtcgtatcgacggagcagcctgggctttcggtgatggttgattatcgcagcggaatttgggtggtccagccgtttgcccatgacgagtcatttgggtctgcgattcagtttggtgagcggcttgcgcccgttgaggctggccttttgcggcccaatgtctatcagcattttttggaggcgaaacatgcgtttgattacgcaatcgcgtggattgaagatgttggggaaggcgctctcgactattgtggtagccaagagaagcgatccgtttccgaggtgagattcgggagcgatccgactctcggcagtgattcatctacgcagacaagccaaaggagcctcgccatgattctcgtcaccaccaccccgtccgtcgacggatacaccatcaccaactaccagggcatcgtcttcggcgaagtggtatccggtgtgaacatgttcaaggatcttggcgcgggcctgcgcaacatgttcggcggccgcagccagggctatgaggaggagctgatgcgcgcccgcaacgaggccatcgccgagatgcagcagcgcgcggaggcgatgggggcgcacgccgtggtcggcgtggacatcgactacgaggtgctcggcgccgacaacggcatgctgatggtcaccgcgtccggcaccgccgtgcagatcgcgcgtacggcctgagtccatcgagcacagcctgggcccggactcgtccatcgagccgggctttgtcggttatcgtgacgcattgcactgacgctcatgaccatacgaatcgaagcatacgaccggctgcccgacgcggcccgcgccatacgcgagcaggtgttcatccgcgaacgcgactggcggccggaattcgatgaatgggatgccgcgtccgcgcatctgctggcgttcgattcggtcgattcgcccgatcgccccggcccgtccgcgcaatcggcctcgcctattcagtccggccagcccgaccaacccgggcgatacatcatcgcgcgactggcggtgctgcccgaggcgcaaggcaggcacatcggctcgcggctgctggccgacgccgaacgccgcatcgcgcaagccggcggagccatggccgccgtgcactcggaaaacgaccactacaagttctacgaacagcgcggctaccggctcactgacgaggtctatgaaggcggtcgtcacggctggctggtcaaggacttgattcttggctccgagaattaagggccgctgtctgtcccgcgccgtgttcaaatcgctgcaatacagcgagttcgaagcatcctgtatgaattgctggacgactacagcgcgcagacaatcagataaatcgccacgacgtggcaggcgtacccgatgaccgtgcccaagtgaaacacctcgtggaactcgaaccagccgagaacggggttcggcttgcgcagcgcgaagcatacagcgccggcgatatacgcggcgcctccgcatgcgatgagtatggtcgcagccggacccactgcgggagccgtccatagctgcggaataagcgtcaccggcgccaatcccagcacaacatacacagtggtgaacacccagttcggggtgcgcagccagacgatatgcagtatcgtgccgatcgccgcggtcacccaaatcaccgtgagatatggccggcgaatcgccgggctgagcgcgaacagcacgggtgtgttggtgccggcgatgatgaggaagatgttcgaataatcgatgccgcacagtacgcgagtcaccttcgcgctgcgccacggcacgacgtgcagcagcgcgctgttgccgaacagcagcatggccgaggcaccgtacactgcgcaggccgctttgaccgagccggccggcgcgatgcagatgagtacgatggacgccgcgatgcacagcggcagggtggcgaggtgaagccatccgcgcagtcgcggcttgcgattgccgaatgcatccacggggacgatctggcgcttgatcgccttcagtgcggccttggcttggcggtagcgcgattgcgcggccctgtatcgggccgatgcacggtccagtgcggtggggttggcgcttgcgctggatttttgactcgcggttgcggaaggcgcaactgttgcggcggaagccatggttcgtccagatggcgtgctgatggaaacgctcatactgatcacctcgctatggccggcgacgctctcccgaccactaacctacgctaccgtaacctagtataggcccgcgcaataatcaaggttgatttcgtaatgcttacagttcttccgtggtgtggtattcggtggtgcggttgcggaatacatcgccgagtctgtgaactcgtattatgcgtgtctgctgggtccgacttgtgtcggttcctgatttcggattgctgcgaatgatgcgcccgacgccgccccgccagttgccggattcgtacggctcggccgttcggccgagctggtcgtcggtgactccagatacttcgttggtttcgtctcggttcatgatgttatgtaatgctagtttatggcggatggaaagttgaggaaagttaaatctgcttcatgggcttctctctgatctgtatttgtcccggttcatatgtcaatcgtttgacctgtcgaccggggcagaatccgctgtcccggtcggcgatttcggcttgttttcgtgaaccgggacactccggtttcctcaactcatatcgtctggcagacggaatcggcggaataaggccgattctggaattggcacgttgtcccggttttcgcataaatcgattgacatttataccggggcaacaaaaattgtcccggtttgcaaagatcgcccgaaatcgcgaaccgggacagcggattctggcctggcttgaacgtcaaacgattgatgcaggtaccgggacattttccgccacgaaagttgggccataagtctcaagtcctaagcccccctgaaaaacggcgcttgcccgaacaaagcaaaagggctggaaccttccgattccagccctttagttgctggtgcgagtggggggagttgaacccccacgagcatacactcactgccacctgaagacagcgcgtctaccattccgccacactcgcagacaatcgactaacttacacccggctgggtaatcatgcaatcttcggcgtgtcgcatgggaggcagggatatatcgcttgtgggtctcctgcgggcgccgtgatctttgagggtggcggcactcccctcagtcacttcgtgacagctcgtccgcaattaaggacgggccttgcctgcaacctgctggttcgactatcgtctcaccttcgactacaaacagcccactgggctgtttgtttaacgtctcagcctcagcgaggggagcagagagaagttcggcacaagccgcaacgaaggagaaaaactcacaaccctggccggcgctcgccgttgccgtagaagtgggccaacgcttcgtcgcggaactcatcaaagtatccgccgtcgatcgaggcgcggatgtcgtccagcagcttcacgaagaaatgctcgttgtgaatcgtggccaacgtgaagccgttgaattcgcgtgcgcgaagcaggtggtcgacgtatgcgcgcgagtagtgacggcacgtgtagcagtcgcacccttcctccagcggcccgaaatcgaacttgtgctgggcgcgcttgatgttgtaccggccggcgcgcgtgtagatcgcgccgttgcgggcgcagcgcgcgggggccacgcagtcgaaggtgtcgccgccgttctccacgcacgcgaagatatcgtccacggaggcgatgcccagcacatggcgcggccggctctccggcatcgcgtcgcagatccaggcgcaagtgtcgccgatgacgcgtttctcgatcgcgccgccgattcccacgccgtcgaagtccagagaggcgatttgcgaggccgcacgtcggcgcagatcctcgtaattcgcgccctgcaccacgccatacaaggcctgatagggcttgcccagccgctcagccgtcagccgctggtgctcgtccacgcatcggcgggcccagcggaaggtgcgctccaccgagtcctcctggtaggagcgggtgttcatcagcgtggtgagttcgtcgaacgcgaacatgatgtctgcgccgattttgtgctggatgcccatcgaaatctcagcggagaaacgatgtgcgtcaccattcaaaggcgacttgaacgtcacgccgtcctcatccacccaggccatgcgctccttgcccttggcgatgatgtcgtccgacttcatgccggtcacgtccattgccagcgtcttcttgaagccgacgcccagcgacatcacttggaaaccgccagaatcggtgaacgtgggcccatcccagttcatgaaacgcgccaagccgccggccgcgtccagcacgtcctcgcccgggcgctcgaacaggtggaaggcgttggccagcaggcactgtgcgcctagatccttcatctgctcgggcaacacggccttcatcgcggcttgcgtgcccaccggcacgaaggcaggcgtgcgaatatcgccgtggggcgtgtgaatgatgccggtgcggccgtatcgggcaccgtctcgcccaagcccgctggccgtggatggcaggcgggtgatcgtttcgaaatggaaggcgctgcggtcgccgggctgtccgggctgtgcgcccaacggatgttcaagaaggctgatcgtcatatgttcactttaggcagaagggccagaaaagggccggaaattgtgaagaactcggtttcgaggggcggatttcgccgctcccgaacgtctacttccgcttcaaggggttcccggtcaagtaggccggctgcaaaaatggcggaatggcgttaaatgagggcccttgatactcggaattgaccgcgcgaacagccccttgaagtgcaagtagatgttcccgaaacaggaaatcagcccctcgaagccgagatgcccataagactctgcgatgattacgcatagactttcaatcaacgttcagaaaacctccagattgactgcctttactactgaggtagcacacgagaagtggcaatgggcaagtgcccgaatagccgccgaacagacgtgataggaatttaggaaaaggagcagcaatggctgacgaatttaacccgcagggcgtcgaccagaccccgcggaataacgaaaaccccaatagtactgccgataccggcaacgccgagccgaagaacccgtttgtgggtggcgactcggttgatgccggcaacgccagcgattccagcgagcagcaagccccggtttcctcggccgccctcgctgccgatcagcagcctacgcaagccgctaccgacactgccgccaccgagcccatcccggactacgcctccgccaagggcgagagcacggtggtctcctcctcgccggcttctccggcagcgccggccgcagaccagacctcggccacaactccgctgtaccgcccggccccggaatacggcgcttatgggccgaccccgactcaggcacagggccagcagggcggccaggccggcaacaatgcccagcccacgcagcaattcccgttcggccagcctgcacagcaaaccccacagggccagcagggcaaccgcaacccctactacaccaataacccgcagccgcagggtaacggcaatccgttcaatccgcccacgcagccgcagcagaacaacggcaacccgtttgccagccagtccggtcagaatggccagaatggccagcagccccagcagggcggtctgttcggtttcggcgttcccggtaccggtacgccgaacggtcaaggtccgacccagccgggacagcccggtcagcccggtcagcccggccccgccaagcagggcatgtccaagacggcgagcaacatcctcatcgccgtggtcgccgccgttctggctgcggccctctgcctgggcctcggctacggtgcccccaccagcggcctgatcaccttgccgaccagcaactcgcttaccaacgtcagctcgaataagtccggctccgggtccgccaccgccaagagcggcgaagcccccgactggcagactgtcgccagcgatgtctccggctccgtggtctccatccagaccgcgttgagcaacggcaccgccaagggctccggtgccatcatcgacaccgaaggccacatcatcaccaacaaccacgtgatctccggtgcccagcagattcaggtgacgcttgccaacggcaacatgtattccgccacgctcgtcggcactgacgccaccaccgatcttgcggtcatcaagctcgacaacccgccgagcgacctcaaggccgtggaattcgccgattccgacaagctcgccgtcggcgagaacgtgatggccatcggcaacccgctcggctacgacgacaccgccaccaccggtatcgtctccgccctgaaccgcccggtgaccgtgaccgacgacaacaacaacgagatcgtcaccaacgccgtccagatcgacgcggccatcaaccccggcaactccggcggcccgaccttcaacgcggccggccaggtgatcggcatcaactcctcgatcgcctccaccgccacctcctccgactccgccggctccatcggcatcggcttcgccatcccgtccaacctcgtcaagcgtgtggccgacgaaatcatcaaggacggcaaggtcaagcacgttgccctcggcgtggtcatcaagtccgacacggttgaagccgacggcgtgacccgcggcggcgcgaccatcaccaagtccagcgccaccggcagcgcggtcgtctccggcggcccggccgacaaggccggccttaaggagggcgacaccatcgtggccttcaacggcaacgccgtgaacaacaactactcgctgcttggttacgttcgtgccgcggctttgggagacaaggtgacgctgaccatcgtgcgcgacggcaagaccatgaatgtggacgtgacgctcgatcaggaggagtcgtcggtgaacggttcgtccggctccgattccaacggcaacagccagaataaccagaacaaccagaacggcaatggccagaacggttacggtaatggcaatggcaacagcgatggcggcaccggtgacggcggcggcttctccgacccgttcggcctgtggtaaagccgactcgacaacgtcacacggtgttgagcggtaaccgctgaacaccgtgtcggacaagcaaaggcccgtgacagtgagcaaactcctgccacgggcctttcgtatgcgcgattgtgccccgcgcccatgccgccaacgcagtttcgatatccggcatgtcgcgcaacgctcgttgatagggtaggccaagcactgagttcgggcgacgtcctgaacacagcgcataattcaatacaaaactgaatacatttctttacgccgtgtatcggaaggttgcgcgggagccgagcaaagcgaagccccaggcaaagccgccggtgggttaacaaggcgtgaccgtagcgccgattgcgcgggccacgcttgccgtaccgcaatcgactccgtatacgagcgtaaggagcaatgatgagcagactcatcagattcttcaccaaaattctcgacatctgcaagcttgtgccgatgcttccggtcgtcgtcatcgccgcaattccgttggctttactgggcgattggcgtccgtggggcaatgcgatggcgattccggtactcggcaatccgggtttcggccagtggctggttatcgcactggtgctggttattgtgattgacactgtgcgcggcatgattgacgatttgcgtcatgggcaggttggagtcgatgtgctggccgtggtcgcgatcctctccaccgtggccgtcgccgaatactgggcaagttgggcggtgacgctgatgatcacgtccggcgaggccattgaggaatacgcccaagccaaggccgagcgcagtctgaccgcgcttatggaagccgcgccgcaaaccgcgcacgtcgtcaacctgcctggcgtggggcgtgggtttgctgccgataagggcgattcgtccgatggcttccggcgcgtgggctcggcatcggctgccgccgccgcgcaccgcttcgacacggtgccggtcgagcaggtgcagctgggcgacgtactcatggtgttgccgggcgaaactgtgccggttgacggcgaactgctgtccggcacggccacgctcgacctgagcaatatcaacggtgagccggtgccgcgtgaagtgttcgccggcgcccgcgtgatgtccggcgcggtgaacggctcgactgcattgaccatgcgcgccacccaggtggccgccgattcgcagtaccagcgcatcctcgagctcgtggcctccgcgcaggagtcgcgcccggccgtggtaaaaaccgccgaccgcttggctgtgccctttaccgtgctctcgctggtgattgccggcgtcgcatgggcggtgtccggggtgccgacgcgattcgcccaggtgctggtgctggccacgccctgcccgctgctcatcgccgcaccggtggcatacatcgccggaaccggacgcctcgccgcagccggcgtgcttatcaaagcgcaggacgtgctggaaaatctcggccgcgtcacgcaggtgttcttcgacaaaaccggtacgctcaccgtcaagcagccgcaggtggtgcgcgtcgagatgttgcccggcgctgcaacccgtctcaacgaagaccatgtgctgatgatggccggcgcggtggaaagctactcggtgcacatcctgtccaaaggtatcgccaaggccggcgcggaggcgctggccggactgcgccagcggttcgaggatggtcagcgcctatgccccgagccggaggccagctggcccggccatggacgggagtatccggtcgtcaagaacatcaatgaagacgccggcaaaggcgtttccggcgaggtgaacggccacgcggtgcgcgttggccggctgtctttcgcggccgccggggaggatggattcttggcggtcggcgaggctgttcccagtcggtctgaggatgacctgcgcacacgatttgggctgcttcagccggacgaaatggcgtcgtatgtgtctgttgatggtcagctgatcgcgcgcattgtgctgcgcgacgtaccgcgtgccaacgccaaggcagtgctcgccaaactgcatgagttgggcgtcaccgagctcgccatgcttaccggtgacaagcgggcttccgccaatatcattgccagcgaagtcggcattgacgaggttcacgccgaactgttcccggaggataaggtagccgcagtcaaggccgctacaggagccggcaaaaccgtcacgatgatggttggtgacggtgtgaatgatgccccggtgctcgctgttgccgatatcggcgtggccatgaccgatggcacgtccaccgccgcttccgaaagcgctcaggtggtcattatgaatgacaatatcgccgccgtgccgcgcgccatcgccattgcacgccgcaccaagcgcgtgatgcttcaagccgtaatcgcgggccttgtgcttgccgccatcggtatgatcgccgccgcgttcaacctcattccagtggtcgtcggagccttcctccaggaagccatcgacgtggtgagcatcctctgggctctcactgctctgattgatcgggattgattaagataaaccggaattgattggagccgcatccggattatgtgcaatataacaagttgatatcaatattttgtgtgtgcttaccggatgcgggcgccgtaggtggcagtctattagactaaaggctgtttgcagcatcatttaggggcattgaggcccttgccagaggagtcgatatgtcagagggtgaggaagagctcaatgtgggcgcagtccgtttggaggaagtggcatcggcggctaatgtatcgctgtccactgcgtccaaggccttgcgtggaaagcctcacgtcagcgagaaaacccgtattcgagtgattgatgctgcgcagaggttgggctatagcgctgcagaagctatggcatcgatggcaaggttaagcgtcagggattctcacggcgtgcaggattttcgcgttggcatcattggcgttgatatgaaaggcgtcttttccccgaccattcttattggagcggagaatgcgtttcaagcgcgctcagccgcagcgctgctgttcaatgcgtcaggcaatgaggcattgttccacagtggtattgaacgaatgttggtgcaaggagtgtcgggactgttgattatcagcaggcgtacggatccggtgccatactacgtggattctccggtacctgtggtctacgcctatggcccgtcccgtgatcccgatgattgttccgtggcacaagacaatgtggaatcagggtgtttggccgttcgccaccttctttcctgcgggcgcactcgtattgcgattattgctggcgactccgagtactcggttgcacatgaacggatgcggggtgcgctcaaggccttgcatgatgctggattacagttggttggcgaagcgcggttcggttcatgggaagcggaatgggggcgcgccgctgcccgtctgctgctcaatgacggtgctgcattcgacgcagtgatatgccaaaacgatgtgttggctcgtggctgcatcgaggaattggaacgtagcggatgtcgcgtgccgcaagacgtagcggttatcgggcacgacaacagtccggattatgtgtcgtacgcgcatccgttgcttacttctattgatgacaacaacgaaatgctggggcgtcaagctgccctatgtctactggatgcgattgcggggcatcctcaccatggtgtggagcgtgtgccggtgaagctaatccaacgcgagtcaacgttgccgttggattgataacgtcaccggataggcggcagcagccggtttacatcttgcgtggcatcatccagacctttgcgaatatcattgatgccggaatcccgtacaaggccgtgaacgtcgatgttgctttgttcgctcaacgcttggccgcgtacgcgcatgctatggataaatcgtccggccttgcgtgcgtagtcgggcagcttgtcggggcctaccagcactaaagtgatgacaagaatcaccatgagttccgtgcccgaaatgccgaacaacatattattctccttctgcagttattgttgcaggggcttcctgtttgccggtgcgcttggctttgcgcgccgcgcgaaatggtaacgcggcgcgcattttatgtaaaagtttgagaagtttgggttcttcgcccgccgcgcgcatgactttccatagctggatgtgctcgtatactgcgcatacggctatggctgcgaaatagattgcgatgatgggcaaggcgagtgcacataatgtgcctgggtcgccggttggcgtggccacggccgcgaagataaacgctatgaccgttgcgagacgccactgcttcaaccatgttcgtgtttcgaccgcattcatcatcgtcaatgccaccatgactgcgggtagcaggaatgagaggccgaaagcgactgtcatgcgcagaatgaaatcaaaatagacgtcggcgctgagcaatgtggcggtgtttgcgggggcaaagccggtaaggatcgccaccgcttggggcagcagataccatgccagtccggctccggtgaggaacagcggcactgaggctccgatgaatgcaaccgcggtccggcgctctttgcgcttcaaccctggattaatgaatgcccacacttggtatgaccaccacgggcaggaggccgtcagaccaaggaagaacgcaatctccagctttacgttgaatgcggagaccacgccattgaatgtgatgctcatcagtccctgttgctgcccggccgccgtcaggaacggctgttgcaggatacgaaacacctgatcgctgaacatccatcccaccatcgacatgatgatgatgccggcaatggcccgaacaaagcgtttgcgaaattcgacaagatgatcggccagaggcatcaccgcatcggggttgcgaggcttgcgcgttttggacttgcgccctacaccccgcttccaccggcgtgtagggcgttgcgcacccgcgctggcctgctgcgtggcctcgtgtgagtgatcgatgagatcgtcgaggtcaagatgtgtatcccgatcgccgggatgcatcgccggtgcaaggggtgccggaagcgcagggtttccgggaaccgtgctcatcgctgttcggctccggttgctgtagtcggggcggcggtggcgttcatcgtgacggcttggggtacggcgggagcgggagccggtgctgccgccggagctggggcaggggcgtcgctgactgtattgacggtttgttgtgttgccgggtcatcggtcttggtctcggcacggaaaatcttcatcgattggccaatgcttttggctagctcagggagcttcttcgcgccaaacagcagcacgatgataagtagaatgataatgagctcggtggggcgaagattaggcatgatagtatgtccttccaatttctgtgttgtgacaggggaagggtatacctcattaacgcaccaatttatcagtatagcgaggaatggtgtgttgttcaagttgaagtgcggtgttgcgtttgagctgcttgtgagagttgctcgggaacatgttaatttgaatgcatttactgtgttattggtgagcatatgtgtttgggttcgttggttttcgcaagaggaaaacaaaaggaaaattacgaaaatagcatggctggaaatgctgataaagactgattttcattggtattgtgcgctacgaaaaccagagaaaaaatgagtgagtcgctttctttgacgcatggtgagaatcgtctgtttgagttattgtgaacgcgcacaacgaagacaagcggcatggagggcgcgcaaaaactcgaataatcgcatatggtaactgtttgctttaccgtcatctctcccatacatacatgacgacggggacgcaccacaatgatgtgatggtaaaacgggcagtaccagacgattccgagtatgtgtgtgccatccactgacgcatcttacctgcgtcgtcgggccattgaatggattaagtgcattgaatggttgcgaatgcggcagagtgtcttcgtccgtcatgcctcgcaatgaacgcgcggcagtccaacgaaggagcaagatgagttcaacggaagcaacaaacggcatctctcgccgtgctgtgctcgcaggcgcggccgccatcggcggcaccatcgccgtggcgagtgcattgggtacaggagtgacaacggtgcaggcagcgccatccgtcgctggcacggcaggtgcaacgggcgcgaacggcgcgggcggcgtggccgttcccgcagcgcagcgcaccacgaaaagcgcgaagaccattaccgacgcgcccgctctgccgggctggaaggtagctccgttccctctgcggaacgtcgccatcacctcgaacagcgtgttcgatcgtgccaaggaagggatgctcgactatgcacgcaactatccggtagaccgctggctggtttgcttccgtgcgcaggcgaacctgctgcctaaggacaacacgacgcagccttccggtggctgggagaacttccccagcggctcgctagacaaggctgttgaacagcaatggggcgatgccgaatacacgcgtggccagaacaagaacggtgctgatggtctgttgcgcggccactttgccggacatgcattgcacatgctctcccaagcgtatgccgaaacgggggaggaagcgattctcaacaagatcaacgagttcgtctccggcctgaaggaatgccgagattccctgcgcgagatgaagtataacggcaaagcccgctacagccaccccggcttccttgccgcctatggcgagtggcagttcaaggcattggaggaatatgctccctatggcgagatttgggcaccgtggtacacggagcacaagattcttgccggtctgattgccgcttacgagtttgccggtaatgccgacgcgctcgacctggctgaaggcatcggacattggacctatgcgcgtctgagcaaatgcaccaaaacccagctgcagaagatgtgggacatctacatcggtggtgaatacggcggcatgaatgattcgctggtggatttgtacaacgtctccaaggacaaggaccgtagcgaatttcttaaggcctccgcatttttcgacactgacaagctcattgacaactgtggtgctggtgtcgatatcctcaacaacttgcacgccaaccagcacattccacagttcgtcggttacgccaaagacgcggccatgggcgacgcggatatcgatgctgatgctcgtgcgcgttatctcaaggccgttgaggggtactggggcatgattgtgcccggccgtatgtatgctcacggtggtactggcgaaggcgagatgtgggggccggcacatactgtggccggcgatatcggcaagcgcaacgcggaatcctgcgcggcatacaacatgctcaaggtggctcgctatctgttctttatcgaacaaaaacctgcctacatggactattatgagcgcacgattctcaaccatattctcggaggtaagtcccgtgacctcgattccggcacggccctcacgccgggcaactgctacatgtacccagtgaatccggctacgcagaaggaatatggtgatggcaacatcggcacttgctgtggcggcaccgctctggaaagccactcgaagtaccaggattccatctacttccactcgacggacaacaaggaactgtacgtcaatctgttcacagcttccacactcgactggaccgacaccggcctgaagctcgcacaggaaaccaactatccggaggaggagacctcgacgatttccattacggccgcgccgaagagcgccgtcaccttccgcatccgcatccccgcgtggagcaaaggtgcgaagatcgaggtgaacggcaaggctatagatggcgtcaccgctggcgaatacgccaccgtggccggcagctggaaggtcggggacaagatcgtcgtcaccatcccgctgcagctgcgcaccgagtcgactgatgaccgcaaggacatccagacgctgttctacggtcccacggtgctcaacgcgctcaacccatccaccaagttcatccaacgcggcttctacgagcgcaacggcttggatggcaccatcaaactgggcgtacagaagaaggaaggcacgaagaactacttcatcattgacggcgacgagttcgagcccgcctacaacggcgacaacaccccgtaccacatgtacttccagcgcaaggacgagtatgtgggcttcgcaggcaagctcaccgatgtgctgaacccgaagcgcccggctgcacaggaccgtagcgagagcacgctgatggatgacatctgggcgggcgcgccgttcaaggaccgtgccgccttcatcaagaaggtgcaggaggtcacgaagacctatcaagacgaggggctgctttccagtcgtgatcgtcaggtggttctgcttgcctccgctcgcgccaagatgagctgacgttttcctgcgaccaaaccgtctcccgtagtgcacgacacggcgggagatgagtgatacaaaccataacgcctaacagaaagaatattatgaccatcgaaagcactacttcggccgtgaagggcggtgtggcgaaacgattcgccgcactgttcgtagctgcggccacgctgctggctggcggtgtcttctccgtatcggccgcgccgagtgcactggcggacgacgctgaaacgaatgttgcgctcaatgcagaaaaaggcaacgacaatgcaccagacgttcaggtcagctatgtcactggctggaacagcactgctgccatcaatgacgatagcttggacggcaacgccagctatggcggttggggcacttggggcaacaccagtgccagcgaaactgccacttacacatggaatcgcgccgtgaccacgtccaagtctgtgggctactactggacgaacgtcaagaccggtgatggtggcgtgccgctgcccaaggatgtctcgattgagtatctcaatgctgattccggccagtacgagaccgtgccgaacctgaaggtggacaagacattccccgccgacgacgagctcgacgccaccaacccggtgtatggtccgtatacctacaccttcgaccaggtcaccaccaagtccatgaagcttgtggtgaacaagaaggccaatgacaacaagggtattaccgtcactgagtggcaggtgtttggtaccagcgctgcactaccagtggatccgggcgacccaggtgctttcttagacgtgcagcaagttgccgtgcgcaccacgccgggcgtggacccgacctcgaagttgcctgcagaagtgtgggcgacacctcaagatggtcccagcattaaggttccagtgacttgggaaaccgttccggccgacgcttatgctacagctggtactaccgccgaagtcaagggcactactgctgccggtacctatgacaacatcaaagttgcggccggtcaggcgacggccactattggtgtctacgaccagctcaacaccgaggtgaccgacgcggagtacgtctccaccatcaccgctcccggtgtcaagccggtattgcaggataccgtggcgctgacctacgctgacggctcggtcgagtcgggtcacaaagtgacttgggacagtatcccggccgccgagtatgctgaagccgaacaggtcggcttcgtggaaggctctatcgagggtgtcggcaatatcaaggcggaaggcacgttcttcgtcgtcgcgccttccgacccgaaagcccagccgattgttgctatcgatttcgactccgcggcccccggctccggctggtacaccactgccccgaagttcaccatcaccgcgcagcgcggcgtctccaccgtgccgataaagacgatcgagtacaagatcggcaagggcgagtggaccagtggcaagggcccgatcagcgtgaccgcgcagggttccgtgaccatttccgcccgtgccaccgatgaaaacgacaacagccgcgaggtctcccagaccatcaaggtcgacaccaacgtgccggtggtcaccgctaagcaggagagcaagaacggcaacgatgtggtcgtctctctcaccgctgatgacggtgccgcaggctccggcgtgacccgtgtgctgtactccaccggcccgtccagcaacccgaagtccaacgagaacacgatgtggggcacctacaccgacgaggacaaggtgaaggtgcagctctccgctgaccacgacacttacgtgcacttctatgcgcaggatgccgccggaaatgagtccgactacgccaacatcaatctcggcaagggcgaagccgtgaccccgaccccgactccgtctgtggattccgttgccgtctccggtgatggtgtcaaggatggcaagctggcgctggtcgctggtgatactgcccagttgtcggccgaggtgaaggtgaccggtgatgcggccaagaccgtggcctggaagtcctccgacgcgaaggtcgctactgtggacaaggatggcaaggtgaccgccgttgccgaaggtacggcgaccatcaccgccacctccacggttgacgagaacaagtccgcgtccgtcgaagtcacggtaactaagcccgaggctccggttccgcctgccaccgatgaggagcgcaagcctcttaccgacaagatcgccgctgttgagagtgagaagctcaaccagaacgactacacggctgattcgtggaaggcatatgcggatgcacttgctgccgcaaagcaggtagtcaaggatccggccgcaaccgcaccgcaggtgaccgctgcgctcaacaaactcactgccgcacacgatggtctcgccaagaaggatagcggcgaaaagcctgaaccgcagaagcccggtcagcagaagcctgggcaaaaccagaagcctgaccagcagcagaagaacgctactaccactgcccccacgggtagtgcggtggctgccgttgctgcggccgtagttgtgctcggcgcggctggcgccggtctggttatctggcgcaagcgccgtgcctgacgtgaggctattgcccctaggctaataacaacccaataattgaatacaggtcttatacctgaagttgatctgcgtcgcactggcttgaacccgaatcgatgttcgggctaagcctgtgcggcgcatttcgttgcggctgtgttgctcataatccggtatcggagttattcattaggtcggtttgacgtttattaggtcggtccttggtcggagcggcccttgaaaccccgccgttccaagggatggcttcagcaccctccgacctaatgaacgaagaaatggcctaatgaatgcaatcgaggtcgtaaagagccgttggaggtgacgtcttcagtgtcatcaagggattcgccggttgtgcagtattgttattgttctgcggcggctctttaccgtcggccttctagccaatcgagggcggaagtgacgcggattccttgtgagacataactatgttcaacccgactggttacgtactgtcgctcacacggtataccgagaacattgccaattaaagtgaggtgccgagcgaatcggtcatgataggtttgtccggatttgatttctatgagcatacggttgttaggatcggtgaaatccaacaaatccacctcgaccttgctggcatcgcggtagaagaataattgtggctcctgattggcgttcaaatgctgtttcatggtttccgcaatgatgaggttttcaaatatatcgccgaacttggggtgcgcaaccagtgcttcgaccgtccgaatgcccaagagatggcacagcaagccagtgtcataaaaatagagtttcggcgttttgaccacctgtttgcgtgcgttcgtgtagaacggtatgagatggaatgcgatgtaacttgattccagaatcgacatccatgcctttacggttcgcggacttacaccaagttcattggcgatgttggtgtagtttatgagtgctccggaactgagtgcgcaaagagtcaagaatcggcggaagtcagccaaattgcgtacatcaagatattcggaaacatcacgttcgatataagtgtcgatgtagttcgagaagaacagattgagcggcattctcgtgtcgtaaatgcgtggataaccgccttgcagcataaacgtatccggagtaagggcctgatccgccttgcatgcttcttggaatgagaacggcaataacttgaccaataggaaaacccataatctgacattagcagtgctcgtaggtttcccaaacgcacaaactatggcctaatacacagaattcccaccaccctccctctgttgcaacggaaggctttgcgttaggctagagcgcgtgactgaatctgtgaatactgaactccgcattgctgtaatcggcgctggcccggccggcgtctactcatccgatatcttcctgcgccagctcaagaagctgggcgaagaacttggcctcggcaccgaagcgcgcatcgacctgttcgagaagctgccggtgccgttcggcctggtgcgttacggtgtggccccggaccacccgtccatcaagttcatcgcctccgcgcttgagaagacgctcgacaacccgaacatccacctctactgcgacgtggaattcggcaaggacgtgactcttgacgacctgttggcccgttacgacgccgtgctgttcgccaccggcgcggtcaaggacaagccgctgaacctgcccggtgccgaccttgaaggcgtgtacggcgccgccaagttcgtcgaatggtatgacggctaccccaccggtgcccgcgaatggccgcttacggccgagaacgtcgccgtaatcggcggcggcaacgtggccatggacgtggcccgcgaactcatgcgcaacgccgacgacctcaaggtcaagaccgacattccggacaacgtgtacgagggcatcggccagaacaaggccaaggtgctccacctgttcatccgccgtggcgtggcccaggccaagttcagcgtgcaggaactgcgcgagatggagaagctgcccggcgtgcagctcatcatcaacgaggacgacttcgatctggacgacgagaccatcgaggtggccggcaaggacaagctcacccgccagatggtcgaggagctgttcgccatccgcgagatggccgaagacatggaagacgacggcgacgtcgacttcgaaggcaacccggccgaccgaaagtactacgtgcacttcaactccgcccccaccgagattctcggcgaggacggcaaggtcaaggccatccgcgtggagcgcaccgaaaccggtgccgacggcaagatgcaccgcaccggcgagttcaccgactacccggttgaggccgtctaccacgccatcggttacaagcccgccgaagcccccggcattgcctacgacgagcacggcgcccacctggccaacgccaacggcgacggccgcatcaccaccgaggccgacggcggcgaagtgcgcgaccgcctgtacgccaccggttgggccaagcgcggcccggtgggcctgatcggctccaccaagtccgatgcgctcgccatcgtgaccaacatgctcgaggatctggccaaggccgctgaaggtggccgtgtggcagccgaccgcgaccccgaatccatcgaccgactgctggccgagcgcggcattcgcccgatcgacttcgccggctggaagaaggtcgacgctttcgagcgcgccgagggtgccaaggaaggccgcgagcacaagaaggtcatcgagcccgaccagatgcgcgagctcgcccacgcctgacggcccgcccacgcccgtccggcattcgtccggcattcgtccggcattcgtccacccggccgcgccccgtgcggacgcggccgggctcggggccggacgggccgggcgaatatgggacatttctcgcggcgcatatccagcaatcattcagcctgcgattttagtgtgtgcattatggatgccaaagtacgggtgcacggccatttcaacggcctgaagacaacgctgctgtttgccctgatgtgggccatcatcatgctgatttggtgggccacgggcggcagtcggcaaaccctgagcatctatattgtcatcggcctgattaccacgttcggcacctactggttctccgacaaactcgccatcgcctccatgggtgcgcgggaagtcagcgaacaggaagccccggaaatctaccagatcgtgcgtgaactgagcgccaaggccggcaagccgatgccgcgcatctacatcgcccccaccatgagcccgaacgccttcgccaccggacgcaacgaacggcacgcggctgtctgctgcacccaaggcatcctgcagattctcaacgcccgtgaactgcgtggtgtgctgggccacgaacttatgcacgtgtacaaccacgacatcctgacttccgccatcgcctctgccatggccactgtcatctcctatctgggctattcgctgatgtatttcggtggcggctcgcgagacgaccgcgatagttccggtggcctcggcctgatcggcgcattgctgagcgtgattctcgcgccgattgccgcgtctttgatccagatggccatctcccgcacccgcgaatacgacgccgatgaagacggcagcttgctcaccggcgatcccgaggccctggcttccgcgctgaacaagatttcctacggcgcacagaccgcgccgatgcgcaaaaccgccggcacccagtccgtctccgcaatgatgatcgccaacccgttctccgcggtcggtttctcgcgcttgttctccacgcacccgccgaccgatgagcgcatagcgcgtctcatgcagatggccaacgaaatgaacggcacgccgatcgctccgcccacctactccacgcgcgtcggcaggtgacgtgctaggataactattcgtgcctcgtttggctgagcatgctcgtcacgtgaggtgcagcagccgtaaggcatgcggacatagttcatcggtagaatgaaagcttcccaagctttagaggcgggttcgactcccgttgtccgctccattgattttcaatgattttcattatttccgggaaagtgtcgcgcacgatcgcaaaactacgcgctatttgagcgctttgcccgcggaacccagctgccggcaagcctcgaccacgcgggcggacatggaatcctcagccttacggccccaagaacgcggatcgtagaacttcttctcgcccacttcgccgtcgatcttcagcaccttgtcgtagttctcgaacacgtggtcggcgattggacgggtgaaggcgtactgggtatcggtgtcgatgttcatcttgatcacgccgtagcttacagcttcggcgatttcttccgggcgtgaaccggagccgccgtggaacaccagctcaaacggcttgccgttggggaaatcgactatgccggccgcgctaggcaactcgccttcggccaccgcgcgcgccacacgcgcctgaatgtcgccgagtagcgacggacgcagcttgaccacgccgggcttgtaggcgccatgcacattgccgaatgtgaaagcggccatgtaccggccacgttcgcccaaacccagtcggcgggcgacttcgaggccatcttccggagtggaatacagcttttcattgatttcggcggagtgaccgtcttcctcaccgccgaccgcgccgatttcgatttcgagcacggtgtgcgccttctgcgacttgtcgagcagttcctcggcgatgtccagattttccttgagcggcacggtggagccatcccacatatgcgactggaatgtaggctcctggcctcgtgccacctgatcggcctcatgcgcgagcagaggacgcgcccactcatccagatactgcttggcgcagtgatcggtgtgcagagcgatggtgatgttcgggtatttcgcagccacttcatgtgtgaaagccgccagcgccagcgagccggtaacgcgatcattgaccccctgccggagacgtaggccgcgcctcccacggaaatctggatgatgccgtcggactcggcgtctgcgaagcccttcaacgcagcattcagtgtctgtgagctggttacgttgatggctggataggcgtaaccgcctcggcgggcggcctcgagcatttcggcatagcgttccggtgttgcgatcgtcatggcttcattatcgcgcgaggcatgccctctaggccccgttcttcaacctgtgcgctgtgcgattggtcacagcatcgcctcgtacgagtagaaattcgtcacccattccgggttgtcgcgcctccagcctcgccctgcgtgagacgaaacttcgcagggtagagggtgtaaggtagtctgtttccggcggaatcgtgcgaatgcggaggtgcatcatgcctggaattgttcttatcggtgctcagtggggcgacgagggtaaaggcaaggctaccgatctgatcggcaccaaggtcgattacgtcgcgcgcttcaacggcggcaacaacgcgggccatagcgtggtggtcggcgatgagtcgtacgccctgcatctgctgccctccggcatcatcaacccgaacctgaccccggtgatcggcaacggcgtggtcgtggacccggaagtgctcttcgaggagatcgacggcttggaatcccgcggcatcgattgctcccacctcaaggtgagcgaggccgcacacatcatcgcgccctaccaccgcacactcgacaaggtgactgaacgcttccttggcaagcacaagatcggcaccaccggccgtggcatcggcccggcctacgcggacaagatcaaccgtgtcggcatccgcgtgcatgacctgttcaacgccgaccatctgcacgacaaggtggaggccagcctgcaccagaagaaccagatgctggtcaagctctacaaccgtcgtccgatcgacgtggaccggaccaccgaggagctgctgaagctcggcgaacgcctcaagccgtacgtggccaacaccggcctgattctcaacaaggcgcttgacgaaggcaagaccgtactgtttgaaggcgctcaggccaccatgcttgacgtggaccacggcacctacccgttcgtcacctcttccaacccgaccgccggcggcgcctgcaccggcaccggcgtgggccccaccaagatcacccgcgtaatcggcgtctccaaggcctacgtcacccgcgtgggcgaaggcccattccccaccgaactgctggacgagtccggcgaatggctgcgtcagcagggccacgagttcggcgtgaccaccggccgcccgcgtcgctgtggttggttcgatgcggtcgtcaaccgttacgcctcccaggtcaacggcctgaccgacatcgtgctcaccaagctcgacgtgctcaccggcctgaaggagattccgatctgcgtggcttacgacgtggacggcgaacgtcacgacgatatgccgaccgatcaggccgctttcgccgccgccaagccgatttacgagaccatgcccggctgggacgaagacatctccgactgccactccttcgacgagctgcccgccacctgccaggcctacgtcaagcgtttggaagagctgagcggctgccgtatctccgcgatcggcaccggtccgcagcgcgatcatgtcatccagatcaattcgctggtcgactgaccgtctgcaacgaatttcccggcttgactggtaacgacgcggcacatgatatccgccggctgattccgcgattcgaccacttgaagtggaagatggcggcggccggcatagtcattggtctggtttcaggattgctggttgtcgtataccgtctcggcatcgaatacggcacggatgcgtcccgttggatatatgcgcggattcgcgagaccccgtggctgattgcgccgtgggcggttgccgcggtggcggccgcgctggcgatcgcgtggatggtcggcaaggagccgatggctggtggcagcggcatcccgcagaccaacggcgtggtgatatgcggcttgaagatgcgttggcagacgattctgccagtccgtttcgtcggtggactgttgggcgcgttgtttggtctgtcgctcggccgtgaggggccgtccattcagattggtgcgtcgggcgcgcagtgtgtgtcccaccgtttgcgcggccgccgccgtgaggacatgcaggagcattatctggtcaccgccggtgccgcggccggcttgtccgccgcgttcagcgcgccgctgtccggcatgatgttcgctttggaaggggtgcatcggagtttttcccctgcgattctgatgggcgccaccgccgcatcgctgaccgccgatttcgtctcaaaatactgtttcggtctgcgtccggttttggatttcggtgatatcggtcagctgtcgttggaagagtatgtgtggctgattccgttgggattggtggccggtttggttggttcgctgatgaaccgctcgttgcttggcttccagacgctgtacggcaaactgccggcatggagccgcccgatgattgcgattgcgatcgcgttgcctgtcggcatctggttgcccgatgtgctcggcggcggctcgaatctgattgataccgccgaacatgcgcgcgtcggcttgggaatgctgtgtctgctgttcgtggcgaagatgctgttcacatccacgagtttcggctcaggcgcgcctggcggtattttcatgccgattcttgcggtcggttcgttggccggcggcatctgcggtgaagtgttgcatcgattcggtgatctgccatccgacgcagtggcggtgtttgcggtgtgcgtgatgacgggcacgctcgccgcgtccgtgaaaacgccgatcacgtcgattctgttggctgtggagatgtctggaacgttgacgcacatgctgccggtcgcggccgtcgctttcgtcgcgctgttggtgtccgatttgctgcgcaccaaaccgatttatggggagttgctggagcggtacgtgcgcgcgcaaggcatgcagatggcgatcgcaagccatgtgggcagcggcattatggaactgccattggaaatgggagcgattgcggacggcaagcgggtgcgtgacgtgcgttggccgtctgggtgcctgatcatcggcctgcgtcgcggcgaaagcgagatcgtgccgcgcggcgatacacggctgcgtgccggcgactatctggtggtgctgttcagtggcgaggaggagcgcgaggtgcgacctgcgatgcggcggctgtgtgatgcccggcttgactgagcctggctgaattcggctggactctggatgtacgaatctgcggaatcggacatccagggtgcatacgttggcgctccgtgtaaactcatatgcgttaggaaggcggcaaccgcggcccagctcgttgttgcacggcctatgggcggaacaacgctgtccgcggaaggccagtacaggggagcgcaatggaatcgcaagaacaatcgccgggagacgtggtgactgcgggtgaggactcacatcccatcacgcaggcaatcgacactgttgaggtgatgcatgctggtgcaaccgcgcccgccgctaacaccatggatccgcctacgattcccctggcgccgatgaaacgtatgcaggcgcggttcaatccgctcgccgacggactgatgtatgttgtggtgttcgtcggtggatttgttggagtcggctgtcggcatgcgttggatatgctcctgccgtcggtcagcgggacgccattcgttgtgggcacgtttgtgtcgaatatggtcgcctgcttcctgttcgcgatgctgaacgaattcatggcgaccgcttcgtggctgcgtcgccgggtgcggcaggttgtcagccgtggcgttgggctcggcttgctcggcgggctttcgacgatgtccggcgtgatgctggaaacgatggaaggtctgcacgagcggcatatcgccagtgcgcttggctatcttgcgggaaattttgcaggcggtttgctcactgccgccgccggcgtggttctgatgcaggcactgctgtcacggagtactcgaaagcgggttcggggtgcgttttcagctgtttccgtgtccgattccgccgaatcggacacgcagggcgtacgccatgtgaaagtggccgacgtggcgcgttctgccgcgcaggccgcaatggaagccgcgcaggcggcgcagcaggccgcgcagacggcccagcagattgcacagacgggacaggttccgcgagtcgaaacgccaaccgtgccgccgactgccatccagcctatgcagacaggccacgttccgcagattcctccgctggtcgttcctcagctgacacagtcatcgcagccgttgttgcgcgagccggatacttcagacttggggcagctgcccgagccgattcagcagtcgcaaccaatccagcagccccagcagcagtcgcagccaatccagcagccggccaacccgcttccacccagcttcgagcccaaaccgatcactgcggagatttcgcttgtcgccgacccgactaccggggaggtgcgctgatgatgtggatgatctgtctgttcggcggtctgggagccatggcccgttacgtgctcgacgtgtcaattcaacgaggctggaaccgcgagaatcgaagaacgaaccgcaacttcccgctatccacgctcgtcatcaacggcgtcgcctcgctatgcgcgggcatcgccatgatgtcctactattcgcaatcggtggatatggacacggtcatgatgttcgttgtcggatttctcggtggtttctcaacattctccacggcgctcaacgaagtggtttcattgattcgccagcgtcgttttacgctggctctgggctatggaatagcaaccgtcgcggtgcctctcatttgcgtggccgccggtttcggcattgcgctgcttgccaatccggcgtaattttcacgttacacggacggtcgctgagtaacgtgaaagaaatctgagcgccaccgccatcaaggccgccagtccggatgcaacgctggtgattgcattcgaccagaccaagccgctgctgaaggccttcgcctccgcaggagtcgacactaagaagctgtatttcgttgccggactgtcgaacaggttcgagagaatgtaaatgaatgtaatatttcgtggtaagcacgtgagcatacaacgatagaacagtgataacggggaaggtgcgatcatggtcggcatgcgcgatgtggcgaagaaggccggggtgtctctgagcaccgtctcgctggtggtgaacggcaacgggtacgtgtctgatgacatgcgcgaacgtgtgcgcaaagccatgcaagccctcaattatgtgccgaacgagcttgcccgcaatctgtatcatgattgcacgaatctggtcggcgtcatcgtgcctaccatccgccacccgttctttgcgacgtttaccgcacatctgcagcatgcactcgccgcgcaaggattacgcactatgctgtgctctaccgcagatgaggcggatggcgaaatccagtatgtcgacatgttgcgtcggcacatgatggacggcatcgtcatgtgtgcgcacacttcgcatcccggcgattattggacgtcgattcatcgcccgatcgtcgcgttcgaccgtgtgcttggagacggtatttcgtcaatcggatccgaccacgagcagggtgggcgattgattgcgcagatgctgatccgcaatggtgccaaacatgtggtgatgattggcggtccgcgagatcaattcttcgatttggctgcgcgcggagaagtcgaggaaggaccgttcgatttgggaaagaccacgttcccgacggtgcgctactacctcacgttggaacaggaattgacctccgcaggcgtgaaatacgagtatgttgaagctggcgaagtgatggattttgccggctatcatcgtgcggtcagcaatgcgctcgacaaggtgacgaccgacggcgtcgatgccgtggtcagttccgatattggtgcatcgttctgcgtgcgcgaagcgttgggccgtggaatttccattcctgacgagctgcagatcgttgcctacgatggtacgtatttgactgatttggccggcatgaagctgaccgcggtcgcgcaggatttctcggcgatcgcacagtcggcggccgaccatatcgtgcaggcgattgccaatgaggaagtggccgcggctaacgcttcacgcaagaacatccccaagccgttcgagccgaacgtgcttattcccatgacactggtgccaggcgataccacgcgttgatactgtgcgtcttcatgcgtgtgcccggtgtggatcgcatcgatttcagcggcgtccacaaccggcgaacgcccgtcgatagtcgtgctcatcatccgacttgtgcacatgtgtccgattctgccgaatcggacgtctgagttccgaaaaatgtgttctgtgtgtccgattctggagaatcggtcatgtgtgatgtgaattgggatgtttggatgtccgtttctgcagaatcatctttgctctgtactcgttgattcgcaaatacggcgcatggctcgtcataccggccatgctcggcggcgcggccttcctggcggactcggtgctgacgccggccgtgtcgatctcgtccgccgtcgaaggcctgaagacgctgccggcgttggagcatctgttcaccgagaacaaggatctgacgatgatgatcaccgcggtgatcatcgtgatcctgttcgccgtgcagtcgcgcggcaccgaatcgatcggcaaggtcttcggctcggtggtgatggtctggttcgcgttcctggcgatcgtcggcgtggtagccatcggcaacgactggtccgtgctcgccgcactcaacccgtactacggcatcaagttcctgttcagtccgaataacgccaccggtctggcgctgatgggcaccgtgttcctttcgaccaccggcgccgaggcgctgtactcggatatgggccacgtgggccgcggcaacatctacttcacctggccgttcatcaaggtggcgctggtgctcaactacttcggccagggcgcgtggatgctgcgcaaccagaacaaccccgaactggccgacgccgaggggatcaccccgttcttccagatgatggatccgaacgtgcgctatgtggccgtcgtgctgtcggccaccgccggcatcatcgcctcccaggcgctgattacgggcgcgttcaccatggtctccgaggccaccggcctcaactggatgccgcatctgcaggtctgttaccctgcccgtacccgcggccagctgtacattccggtcgtcaacgtggtgctgtgcgtggccacgctggccgtgctgctgctgttccgcgattcggaacatatctcggcggcctacggcttggcactgaccatcacgatgatcaccaccacgatcctgctgggcatctacctgtggcaccgcagcaacaagttcggcgccgttgtgttcaccatcgtgttcctggcgatccaggtcctgttcttcgccgcctcgatggccaagttcctgcacggcggctggttcacgctgctgctcacgctggcgatcctcatgatcatgtacacgtggaacgagggcaccaagctggagcgctcgcagcgtcggcacatgatgccgaaggacttcctccccgcgctggacaagctgcacggcgatagccgcatccaccggttcgcggacaacatcgtctacctgaccagcgatccggacctgaagcgtctcgatacggacatcttcttctcgatcttcgccgaccaccccaagcgcgcccgcgcatggtgggcggtggccgtcgagaccaccgacgagccgttcacccgtgagtattcggtcgagagcttcggtaccgactacctgttccgtgtgcgcatccgcctcggcttcaaggtctcgcagtccatcccggcctacctgcatcagatcatgcacgatctggagaagaccggcgagctgccgaaccagcagtcgatctacccgaagcttgacgccgatcccggcatcggcaccatccgctacgtggtgatccacaaggcgctgatgcccgagtcgaaggtctccggccgtggcgccctctcgctgcagatcaagtacgcgatccgccgcgtggccggttccccggtcaagtggttcggcctggcgccgtacaacccgctggtcgaggtgcagccgctgttcgtgtccacgcgccgcccgccgcgcctgacccgcgtggccagccaggcgcccaagcgcgagggctgagccggcaggccgaacagccggtgcgagccgggtggcctaatggcatgtcagggggccgcgaaccgtcatcgtacggttcgcggcctttgcatatgcgaatgatgcagagtgggcggtactgcttgtgaatgtagcgggtggacgggtgacgtggttgatgccttttgccgtatgttcacggtggctatgcgtcggatgggactgtaattcgacttcttgggatcttttttgctgcagtggtgcgccaaaaggtctcagccgtctctgcgccacgccttccggcagtcagtacaaggttgtactacactggtggctgccacacggatgtccccggtcgcccgcgcctccgcggtacatcgttgtatggatacgtgtcacgtatgcagagtgcatgcagatatgtagaaaggaatcccatgccccagcaggaccatctgaccgcacgtctcgtcgtcgatgacgattttgaggtcgctccggtcaacaatcgtctgttcggttcgttcgtcgagcaccttggccgttgcgtgtacaccggcatctacgagcccgaccacccgaccgccgacgagcacggcttccgcaaggacgtcatcgacctggtcaaggaactcggcgccaccaccatccgctacccgggcggcaacttcgtgtccggctaccgctgggaggacggcatcggccccaagcaggaacgtccccgtcgactcgatctggcctggcattccagcgaaaccaacgaattcggcctgcacgagatggccgaatggcttgaggccaccggcggcaacgagctgatggaggccgtcaacctgggcacgcgcggcctgcaggaggccctggacctgctggagtacgcgaacgtgcccggcggcaccgagctgtcggaacgtcgccgcgccaacggcgccgacaagccgttcgatatccgcatgtggtgcctgggcaacgagatggacggcccgtggcagctcggccacaagtccgccgaggactacggcatgctcgccgcctccgtggccgccggcatgcgccagatcgatccggatgtggaactggtggtgtgcggctcctccgcccatggcatgccgaccttcggcaagtgggagcagaccgttcttgagaagacctacgagaacgtgaacttcgtctcctgccacgcctactaccagccgttcttcaaggaggacggcacgcgcgacatggccagcttcctggcctccggcgtggatatggacggcttcatcaaggacgtggccgccaccatcgacgccaccaaggcccatctgaagagcgcgcacgacgtgtacatctcgttcgatgaatggaatgtctggtaccagggtgaggagccgagcaagacccccgagggcatcggcaactggccggtggccccgcgtctgctggaggacatctacaccgccgccgacgccgtggtgttcggcgatctgatgatcacgctgctcaagaacgccgaccgcgtgcgcgccgccagcctggcgcagctggtcaatgtcatcgccccgatcatgacggagccgggcggcccggcctggcgccagaccacgttccacccgttctccgtgaccgcgcgcctggccaagggcggcaccgtgctggagccgaagctgtccgccggcaccgtggatacgccgcgctatggcgaggtcgacggcgtgaacgccgtggccgtgcgctgcgccgacggctcgctcgccgtgtttgcggtgaaccgttcgctcgaggcgaccgccgagttcgagatcaggctgcaggacggcgcgcagccggcatccgtcgaggcgcagacgctgcacgacgacgatctgttcgctgcgaatacgctctacgaccagaaccgtgtgaccccgcacgccaacgggtcggccatgtacgatgccgagtccggcgtggtccgcgtctccctgccgccggtgagttggaccgccctgcacatcaagtgacgcgatgggccgcgcggtccgttccggagaaggacggatcgcacggcccttgcttcccgggccgggcggaagggaccggaccggccggggaaaacgcgttatgctggaatcagacgggcgttccgcctgaaccgtgcggaacatgcccgatggtgcgacgagaggggtgctgtggcgaaacgggtgaccatcaccgacgtggcgcgcgagacgggcgtctccatcaaaacggtgtcgaatgtgctgaacaacaccggcagtatgcgcccggagacgcgccagcgtgtccaggatgccatcgaacgcctcggataccgcgttaacgtgtccgcccgcgccatgaaaaccggcggcacgaagctcatcggactggccatcaccgatttctgccagccgttcatgccctatctcgccgacagcatcgtggcggcggcacgttcccgcgggtacgcggtgatcaccgatacctacaacagcgccggcggcttggcgcaggcgatcccggagacgaagaagctggccgcggacggctggattttcttcatgggctcgccgatcacggatcgcacgatactgcaccagccgtatccgttggtgattgtgggcgattacgatacgcagggactggccgattgggtcacgatgccgaacgtggaggccgtacgcaccgcggtgggggcgctgctggattcgggatgccgtaggatcgcgttgatcggcggcaccgcggagaacgcatgcccggatgccgaccgcgagtcgcggcccgaaaccaccagcacgatgcgtacccgcggctatgtgttggcccatgaggagcgtggcctgcaggtcgattggcggctggtccgtaacgcggattgggtgcagtccggcggccgcgatgcggtggcggggctgttggacgatccggatgcgccgcgtccggatgcggtcatgtgcctgaacgacgcgctcgccatcggggtgattcatgagctgcagcggcgcggcgtgcgcgtgccgcaggatatgcaggtcattgggttcgacaacgtgccggatgccgagtactgcatgcccggattgacgacgatcgacccgcatgtggatgattacgcgcgacatgccgtggatatgctgatcgcgcgcatcgaggggtcggcggatccgttccgcacgtatgtgacctcctacgatctggtgcgtcgtgcctcgacgtgttgacggcccggcgttcgcctggacatgggtctgtgacgggctgctgtcgcctctcccgtggcgtattccgggagaggcgacatgcgggctaggatcggagcagcacctccgtcagcgcttgacggacggcgctcggcatatgcgaatcggagcaatcttccatgtccggcccgctgacgtgctcgagtgaatccatcgtggccaatgcgtcgatgccgttctccgctatggcggcataagcctgttccttggtcagatatcgcatttcggcatgccgaaggatgtcgaagacgtcttccatgcggggatcgggggccatcgtcgtgtcgccgatggtgacacgtatctcgctgcgggtggatacgtcggcgaccgttacctgcaatgtgagggtttcggcatcataccggcgatccgaatcgacggatgcgccgtcggcctgtacggatatgtcgctgtcggtaatgcctcggaacaggaaatcccatgttctccgggccggcagagcgtgaacgtctccctgggctggcgataccgtgagtgcggatgtggcgccgtccttgcgccatcgataggtgatcgcggtggtcgccggggtgatctgccgagagtaatgtcccgaatcctccatcagcgtgaagtcgccgtccgctccggggaagacgatgatctccagatgctgcgggttgtcgacggagttgatggaatccccctcggacaggggctgcatcggcacgatgccgccggccttcgcgaacacgggaattccgtcgagcggacgccagacggtcatgcgccgtccgttgggcgaagacgcgctataccggcgcccggtgaagaagtcgaaccagtcgccctgcggcagccatacgtcggccttgccccgtcgggaggatttatccatcggttccgtgatgggcgcggccagcagttcggtgccgaacatgtattcgttgggaacgtggtatgcggcgtcgatgtcgggcgatccccaatacatgggctccaccaggggaaggcctgtccgggatgcgcgccagttcatggtgtggaggtacggaatcatgcgatggcgcaggcggagcgcatcgtccatgatcgcacggagggggtgcggatgtttttttggacggtcaggcggccagtccaagacttctgcggtattgcacggggctcatccagtccagtgacttcttgatcctggtttcattgtagtgggtcaggtaggcggccaggcgttcgcggaactcctcgtagcccacgcccctccagtcccgcccgtagaataactcgttcttgagcctgccgaagaacccctcggcggccgcgttgtccgggctgcatcccttggcgctcatcgaccggatcagcccgtgctcctcgcagatgcggatccattcgtcccaccggtagtggcagccgcggtccgagtggatgattggatgttccccgtccctgagcgtggcgaccgcgtcaaggagcatccggttcgccatgtcggcgttcggggagcgcgacaaggtccaggagaccaccatcccgtcgaagcagtcgaccaccggggaaagccagcacttgtacccgtccatggtgaactgggtgacgtccgtgacccacagcatgttcggcgcgtcggcgtggaagtcccgctccacgaggttcgccggggcctcgccgatctcgccggcgtaggagctccaccgcttcggccgcttcaggtacacgggccgcatggccccctcgcgcatgatccgcctgacgaccttctccgagacgacgatcgggtcggactcgtcaaggcgcagcatgcggtggatggtccggtatccccatgcgcgcccaccctgctcgaacaggccggcgacgcgggcccgcagcacggcgtacctgtcgcccgcggcgatcgcgccgcgctcgtaatagtaggtgctgcgtttcagccccacggccttcagacaggccgccaggccgaattcacccctgatcgcgtcgacgacccgcgtcctctccctgttcgtcagcatggacgggtcgaggcgcgggtcgtcggcttttaaaacatcgatcgtctcccgcatcaccgcgttctccagccgcaggacctccacctgccggcgcagctcctccacgtcatcgccggccgcgggcatcggttcggccggcatcggcgcgtttctcctgtccatcagtcccagtatcccctcgctccggtagcggcgcatccactggtacacgctcgtcggcgtgcaacccgcgtcgcgcgccacgcgggcgaggggctcgccctcgagcgcgcgtctggccgcattcgtcttgcattccagcgtatacgaacgcctgcacgcgcccgtgatctcgtcggcctccgcgtccagcatcgcgttcaacagctgttcgaccttctccgacaccaaccggtccagcttcgtctcgagcatgttctcgtcgacctgtagaatctgattcggcatggttccgtcgccttcctaaataggttgatttggtttggcgactgaaatcgtacccggacgacggaccatgtctctcaactcaagcctcaaccaaaatgcgcaacaaaccgggcgttatcaatcggacacattggagtcggacaggctaagctgcatagaacaccgcatctaatcggttcgacacgcgcatttcactgcgcgactggacattgacgtccctttcgaggtaatatcgaaccggttcgatacatacgtgagtatgcaaatacgtaaacaacaaacaggcagatgcgcacgcaaattgcacccgcgcccatgagccaagggaggtcccatgaaaaacaaagtgcaactcatcacatacgccgatcgtctcggcgatggcactcttagctcgatgaccgacatcctgcgcacccgcttcgacggcgtgtatgacggcgtgcatatcctgccgttcttcactccgttcgatggtgcggatgcaggcttcgacccgatcgaccataccaaagtcgacgaacgtctcggcagctgggacgacgtcgccgaactctccaagacccacaacatcatggtcgacgccatcgtcaaccacatgagttgggaatccaagcagttccaagacgtgcttgaaaaaggtgaggaatccgagtattacccgatgttcctgaccatgagctccgtcttcccgaacggcgccaccgaagaagacctggccggcatctaccgcccgcgcccgggcctgccgttcacccactacaagttcgccggcaagacgcgcttggtctgggtgagcttcaccccgcagcaggtggacatcgacactgattccgccaagggttgggaatacctgatgtcgatcttcgatcagatggccgccagccacgtgcgctacatccgtctcgacgccgtgggctacggcgccaaggaagccggcaccagctgcttcatgacccccaagacctttaagctcatctcccgtctgcgcgaggagggcgtcaagcgcggccttgaaatcctcatcgaggttcacagctactacaagaagcaggtggaaatcgcctccaaggtggaccgcgtctacgatttcgccctgccgccgctgcttctgcactcgctgttcaccggtcacgtcgaacccgtggcccactggaccgagatccgcccgaacaacgccgtcaccgtgctcgatacgcacgatggcatcggcgtgatcgacatcggctccgaccagctcgaccgctccctcaagggcctcgtgcccgacgaggacgtcgacaacctggtcaacaccatccatgccaacacccacggcgaatcccaggccgccaccggtgccgccgcgtccaacctcgacctctaccaggtcaactccacgtactactcggccctcggctgcaacgaccagcactacttggccgcccgcgccgtgcagttcttcctgccgggcgtgccgcaggtctactacgtgggcgcgctcgccggccgcaacgacatggaactgctgcgccgcaccaacaacggccgcgacatcaaccgccactactactccaccgccgaaatcgatgaaaacctcgaacgcccggtggtcaaggccctgaacgccctggccaagttccgcaacgaactgcctgcattcgatggcgagttcagctacgaggtcgatggcgacacgtccatcaccttccgctggaccgccgccgacggcacgtccacggccgccctcaccttcgagcccggacgcggcctcggcacagacaacgccaccccggttgccagccttgcctggagcgatgccgccggcgaccacgaaacccgcgatctgctcgccaacccgccgattgccgatatcgactaaccgttggcccataaacgccactccgctgtgcgcgctccaagtagtgcgcccggcgtaagctgggttcatggagagcaaaccgcccgcagtgcactgaagccagtgcgcccgggcggttttgcgtatgcggggttgaaggtcatgctcctgcgggcgcggcccaagcatcccgccggaatcgacgagacgagcagcagaacagagaaagagcagcatcatgttggaaccgtatgtgcgtccgggtattgatgatcgcccggatttggacaaggtcctaagtcccgaagacaaagccgccgtggccagactggccatcaagaatcgccgccgcccgcccgaagcctctgcggaccagcctgaggcccaggctgtgcgattggcttccgccggttcttcggcagccgctgctgcagccgccagtgtggacactcccgcgccggatatgtcgtccgcctacctcgacatgcgcgatcccatggtcgccgtcaatggccaacgccctaccgcaggtcaggtctcccgactcaactggggtttcttcgctgcttcaattctggtcggcgcaccttgggtggcgttgaacaccattgccatgcccaacgcgattgcgcgtacgttcggctatgacactgctgttgccggtcatatcgccatcaatccggccactggccgcccgttgcccgtcgccaccgaattggcgatgcccctggccgtgttggtgattgtcggcgtagtggcctccatgtttgcgatgccgctgatttcagtgttgtccgaccgcacacgcacgccattgggccgtcgtaccccgtggatggttggcggaggtctgctgtgcgcgctgatcacgctgattctggggcagaatatcggcatcattgtgctttgtattttctgggtgttcctacagttcgcctatgcgatgctttccgtgccgttgaccagcgccatcagcgaacgggtgcccgacaagttccgccctcgcatcgaacgctggcatggcatcggtgtgatgctcggccaagcgcttggcgtgtgcatgggtgcgcttggtgtgatgttcaattcgtttgcgccgtttagttacaccgccgtgctatttgcagtgtccggtattgccaccgtattgattctgcccaaggagccttctagcgctgagcagccgaaccagctttttgaccgcagtcaggtacttgaccaattgcgcccgccggcccacgctcccgagttctcccgggtgttcgccgcccgtacgtgcatgatggccggtgttgggctgaccggtgtgtttctgtggtatctcgtacgtttctgggtttatggcaaggccgtggtacttacgtccgcgccgctgaccattccggccggattcctcattgccggtatggctgtggccacattgatcggtgccgcgctcgcctcctgggccgccgggccgatttccgagcgaatcgaggaaaagaacattcccgtggcccgtgtggtggccggtgcctgcctgctgtatgcgattggtctggggctcgcatggggccttggcgtctggtccaccggcactgcccgtgaaaacggcatgctgctgtttgcgttgatctccggattcgccttcggcatttacgattcgctcggacttgaactggtgatggactctttgcccgacccgcgccgagccggccacgacctcggcatttatgcgctcgccaactcggccggtctggcgctcgccgccatcatcggcgcgctactggtgaacgccttcgagcatagcttcggctattacctgctcttcccgtccgccatcgtcatggtgctgctggccggaatcgtcaccctcaccaccaaatctgccgaataataaaccggttcgagtacactggtcagcagtgatccagtccagtactcgcaggggagcaaaaccatggtcggcatgcgcgacgtagccaaagcggcaggggtgtccttaagcaccgtttcgttggtggtcaacaacaccggctacgtctcggccgatatgcgtgccaaagtcgagtccgcgatgcgccagctcaactacattcccaacgagctggcccgcaacctctaccgaaaccgcaccaacaccatcggcgtgatcatgccgaccatcgcccacccgttcttctccacactcaccgcgcatctgcagcgcgagttcgccgcgcgcgacctcaaaaccctgctctgctccaccgccgatacagacaagggcgagagcgagtacatcgacatgctccagcggcacatgatggacggcatcatcatggcggcccacaccgagcatccggccgactactggacctccatccatcggccaattgtcgctttcgaccgcacgctcggtgagggtgtgccggtcgtccggtctgatcatgaacagggaggccgtctgattgcgcgccagctcatcgattccggcgcgcgccacgtggtgctcgttggtggcccgcgttcccagttcgcggaaggcaccactttccccacgattcgctaccatctcaccgtcgagcgtctgctggctgaggccggcattgcctgcgattatgtcgaagccggcaccgtggccgacatcgccgcccacgaagccaccgcatgcgccattttcgaacagtatcctgatgtcgacgccatcgtcggctccgatgtggtggcatccgtggcattgcaggaagcctcacgacggggtatcgaggtgcctgctgatctgcaagtcatcgcctatgacggcactctcatggccgaaaccgccggcaaacgcctgaccgcgattcgacaggacttcccggccatcgccgccgcgctcgccgtccgcatggactcacagatcgccgccgacggtggccccgcctctccgtccaagaacgatagcgcttcgaacgttgacacccaacccactcccgaagaagtcatccccgtagccctcatccccggcgaaaccacccggtgactcctatcttggctcccctctctgaggctgagctgtgaagcaaacagtccagtggactgtttgtaggcgaaggcgagccgggaggcgagcaggcagactgcgggcggtagcccgtctgtaattgcggccgagctggcggcgtaggcgactgaggggagccgagtcacggccgcccacagtcacccatctcacatgactcctacgtcacaatgtccacaatgtgaacccttgctggattggcaagacatacaaacctatgtttacattccagttcaggtcgaacggcctgaggaaataccgaaaggaggccacgcgatgactggattcaatgcttctgcgtttgtatccgcacgaattattagcccgtcttcgctggcggactaattcggcactgatgcttgaagccccgtcaacgaaggcagggccaatcaagctgacacaatcggcacggccctgcatgatgcggggctttttttgttgcgctcacaaggcttacggcagaatcccgcagacggaaacggtagcggacagtacacggcaacaacacagcgacagaacaacaacctccctgtggggcgaaataatcgcccgccgatgagagtgaacgagagcaaaacaggagtaacaatgactgcagcagtcgaagagactggcttagggcaggcggcaggtaaagccgctaccttggtacgcgattcggtcaagaccgtgatcgccgcgtcgatggtcggtaccgccatcgaattctatgacttctacgcctacggcaccgccgcggcaaactacttcccgcacatcttcttctccgcgaaggacaaccccaccgtcgcactgctgatgagcttgctgaccttcgccgtcgccttcatcgcccgcccgctgggctcgctgatcttcggccacttcggcgatcgcatgggccgcaagaccacgctggtcgtcagcctgatgaccatgggtgtcggcaccttcctgattggctgcctgcccacctacgatcaggtcggcgttggtgcagtcgccatcctctgcctgctgcgtttcatccagggcatcggcctgggcggcgaatggtccggcgcggcactggtcgccaccgagaacgcgcctgaagacaagcgcgcactgtacggctccttcccggagctcggcgccccgatcggcttcttcctgtccaacggcacctacttcgtgctcgaatccttcaacaatcaggacgcgatgctggcttggggctggcgtgtgccgttcctgctgtccgccatcctggtgatcgtcggtctcgtggtccgcgttcacatggaggagaccccgatcttccgtatggctcaggagcagaagaaggttgtcaagtccccgctgaccgaggtcttccgcaagtcttggcgtcaggtgctgcaggccaccttcctcgtggctgtgacctacacgctgttctacacgctcgccacttggtccctcgcttggggcaccaaggagcagggcgaaggcggcggcaaccttggcttcaccaaccaggaatacctgctcatgctcatgatctccatctgcgtgttcgccctgttcatcgtgctgtcctgcctgtacgcggacaagatcggccgccgtcgcgtgctgaccttctcctcctgcgcgctcgtcgtgttcgccgtgctcttcccgttcctgctggacggtggtctggtcggccagaagaacttcttcgccaacatggtgttcctgtgcgtcggctttgccctgatgggcatcgccttcggcccgatcggcgccttcctgcctgagctgttcgacgccaacgtgcgttactccggctccggcatcggctacaacctggccgccatcgtcggcgcggctttcgtgccgaccatcgccacttggctgagctcccactggggcgtccactccgtgggcctctacctcgccgtgatggccgtgtgctgcctcgtctccgtgctcacttgcaaggagactaaggacgttgactttaccaagtgacgatgttcacaacgtgaaaaatctcaattccacgaagtgaacccctgcgaggcttttccggtgcaacaggactaaacctgcatatcggaaaagcccacaaggaaagccacaacagaatatcgctcagcgaaaccccgcagagcacaagaaaatttcaacccccataaacaaataaataaaaggagcgccaaaaatggcagcaactatctggtacgagaaggacgccgatctgtccgtgttcgatggcaagaaggtcgccatcttgggctacggctctcagggtcacgctcacgcactgaacctgcgtgactccggtgtcgacgtggtcgtcggcctgcgtccgacctccaagtctgtcgagttcgccaaggagcagggtcttgaggtcaagccggttggcgaggccgtcgccgaggctgacgttgtgatgatccttctgcctgaccagtaccaggccaaggtctacaaggaagaagttgagccgaacctgaagccgggcgctgccctggcgttcgcccacggcttcaacatccactacggctacatcaagccgtccgaggatcacccggtcttcatggtcgccccgaagggcccgggccacatcgttcgtcgtgagtacgccgctggccgtggcgtcccggtcgtcgttgccgtcgagcaggacccggacggcaagacctggccgctgtgcctggcttacgccaaggctctgggcgctctgcgtgcaggcgccatcaagaccaccttcactgaggagaccgagaccgatctgttcggtgagcaggacgtcctcatgggtggcatcaaccacctgtgcgacctcggtttcgacgtgctgaccgaggctggctaccagccggagatcgcctacttcgaggtcttccacgagctgaagatgctcgtcgacctggctaacgagggtggcctgaacaaggctcgctggtcctgctccgacaccgctcagtacggcgactacacctccaccgtcatcaccgacgagaccaagaagcgcatgcagtaccagctcaagcgcattcaggacggctccttcgccaaggagttcatggacgaccaggccgctggcgccccgaagttcaagaagctgcaggaagagtactctcacccgcacctcgagaccgtcggcccgaagctgcgcgccatgttctcctggaacaacgccgaggccaaggacaaggacgaggccgagtccttcaacggcaagatcgctcgtacccaggttcagtgattgccgcccctgaaggggatttaagctagcaaaccgccgttcccgcccatacgggagcggcggttttgtgttgttgcgcgcagcgaatcattctcaataacaactatgcgctgatttcttgcaggcaaacgaacaccgaatatgcaagatcgttgatatctcagcctttccccatatgtgggattgtgcgattctgttcaaaagggtgcagagttgttatcgagaatcgttctctgcacacggctgtccatactccaatagtgacctagctcacgttgtggactccagcggggctgcgacggcgttctcggtaggattgaactcggtttgaaggacacaatcctcgcaaaacaggacttatctgcacaccgtagatacccccggcgcccagcggcgccacaacccactactgaaaaggagtgccaataatggcagcacaaatctggtatgagaacgacggcgatctttccgtcctcgaaggcaagaaggtcgcaatcatcggctacggttcccagggccacgcccacgcgctgaaccttcgcgattccggtgtcgacgtggtcgtcggcctgcgtccgacctccaagtcggtcgacttcgccaaggagcagggcctcgaggtcaagtccgtggccgaggcttccgccgaggccgacgtgatcatgattctggcccccgaccagtaccagcgcaccatctgggccaacgacatcgagcccaacatcaagccgggtgccgctgttgcgttcgctcatggcttcaacattcactacggctacatcaagccgtctgaggatcacccggtgttcatggttgccccgaagggcccgggccacatcgttcgtcgtgagtacgccgctggccgtggcgtgccggtcgtcgtggccgtcgagcaggatccgcgtggcgacggctgggctctgaccctggcctacgccaaggccctcggtgccctgcgcgccggtgccatcaagaccaccttcaaggaagagaccgagaccgatctcttcggcgagcagaacgtgctcatgggtggcgtgaacaagctcgtcgagatgggcttcgaagtcctgaccgacgccggctaccagccggaaatcgcctacttcgaggtctgccacgagctcaagatgctcgtcgacctgatgaacgagggcggtctgaacaaggctcgttggtcctgctccgacaccgcccagtacggcgactacgtcaacaccgtcatcaacgaggactgccgcaagcgcatggaataccacctgcagcgcatccaggacggctccttcgccaaggagttcatcgacgaccaggatgccggcgccccgcacttcaaggaactgcaggagaagtactccaacgagcgcatcgagaccgtcggcccgaagctgcgcgccatgttctcctggaacaaggatggcgtcaaggatgccgacgaggccaactccttcaccggcaagatcgcccgcgcccaggttcagtgattcttccttggctcccctcgggtgaggtgcgcacgaacagcgagccggcaatcgcagccttcaggctgtccgtgttgcagtacgctggcgcgtaagcgcctgagggtggtccccagtgcataccaaaaggccgccgctccgattcattcggaacggcggcctttcgcttattccaagggatctacttgataacccacgcagaagtgtcggtggggagctggccttcgggggtcagcgggccggacgccagcaccacggagccatcgggcagcgcgaccggggcattgccgaagttggtgattgaggtgaacacccgcccgccaaccgccgcgcgggtgtacgccaccacatcgtcgcccatgtccacctgctcggccgtggtgtcgcgcgtggcggtcagcgactcctggcgaatcgccagtgcggcgcgatacagcgcgagcatcgagtccgggtcggcttgctccacgtccaccgcgtaatccttgaaccacagcggttgcggcaggtgcgggtcggcggccggcgtcacgccctcagcgcgcgtagccggcgagaagccgaaggaagcgcccgtgccgaactggccggctgcgcacagcggcacatggttttcgccggtaccgtcatcggccggagccggacggctgaaatcggccaaggccggctcatcggcggcggtccacggcagcggcacgcggcagccgtcgcggcccttgtccatcgtgttgcgggtggtgtggaaggcggtcggatcctccaagtgatcccacggaatatcggccacctcaaacaggcccagttcctcgccctgatagatgtatgcggcaccgggcaggccgagctccatcagcgcggcggcacgggcacggcgggtgccgagctcgcggtcttcgggatatgtggtgccgttgcgcagcagccagtcgtgcggcagctggtggtagggcgcgcccttgacctgcggcagaccgtagcgggaggggctgcgcggcacgtcgtgattgttcatgacccacgtggtggtggagccgccggtttcggccgccgccttaagacccgcggcgatggccttgcggaactcgtcggcataccagttggcttgcgcgaagtcgaagttgaaggactggcccagctcgtccatcgaagcgtacaggtgctggtgctcgggcaccacccacgcctcggccacggcaaagcgcggcgggtcgtactcgttgaacaccttgcgccattcgcggtagatatcgtgcacctcgcgacggtcgaacagcgggtggctgaagtcatgattcagcacgccgaccacgctgtattcgcggccgagctcttccaacggcttggattcgaggtccttggccaggccgttcgccacgtcgatgcggaagccgtcggtgccgtggtcggaccagaaacgcagggtcttcttgaactcctcgtggatgtccggattcttccagttgacgtccggctgcgccttatcgaacaggtgcagataccactggccgtcggccacgcgcgcccaggccgggccgccgaagaaggattgccagtcgttcgggggcagttcgccatgctcgccgcggccgtcgcggaagatgtagcggtcgcgcgccggggagccgggctcggcggcgagggcctcctggaagaacacgtgcttgtcggcggtgtgattgggcacgatgtccacgattaccttgatgccggcctcatgcgcggccttggccatggcgtcgaagtcgtccatggtgcccagtcgcgggtcgacgttgcggtagtcgatcacgtcgtagccgccgtccgccagatcggaggggtagaacggggagagccagatggcgtccacgccgaggctcttcaggtagtccattttctcggtgacgccggcgatgtcgccgatgccgtcgccgttaacgtccttgaagctgcgcgggtagatctggtagacgacggcctgcttccaccagtcgtcattgaggttatttgcggtcatgccgattccctcctgttccgggtgcgttgtggttgggttgttccggtcgcgcccgaactgctgtgtgaaggcccaaccgttgtattaatgatgataacgatatcatgtgaatcacgcatgcaaaaatcgatttatcggcgttttgcggtggtaacgtggtcacgcctgcgcgggcgctgctgtcgcggcaggcggcgcggtggtttcgcgcagtattagcggagtgttcggccgtacgaatgccggttcgattgacttgccggcaatggcatccaataccatgtgcccggcagtcgcgcccattgcgaacgggtcctgatgcagcgtggtcagtcccacggcggcggacagggtggaatcgtcgaagccgatgatggaaatgtcctgaggtacccgccgcccgtattgacgcaggcgatacagcacgggcgcggccatttcatcatcctcaaaacagaaggcggtgatgctggggaaggcgttcagtacggcgttcaatgccgcgttgctttcgccaagaccgcgttgaatgctcaggggcgttagctcgatccccggatgggcggcagcggcatcaatgacgccctgcaaacgagcctcggcactgtagcgcatattggtttcggtcggtgcgctgccgacgaacgcgatatgccggtggccgagtgcaatcaggtgctcgatagccgaacgtgtggcggcgtaatcatcaatgctcacgcctgcgtcgaacccatcggtggaggggatgttgatgccgacaatcggcacgtgcatatgcttcagtcgctccacttcagccggttcgatgtcgaaggagctgacaatcaccgcatccgcattgcgccgcacgggcaaatccgcaaagaagtcgtggcgctcggcggcgttgcgcatggggtagggcacagtgtcgtagccggaggggcgcagcgccgagtcaagaccggcgaagatgttcgaattgaaccaactggcgatggtctcgctggcaagcaatgcgatacggaacgattggccggatttcagggcggcggccgagcgagagactgagtagtcgagcttttcggccgcggccatcactcggtctcgagtctcgggaagcaccagatccggcttggcgaaggttcgggacaccgtggatacggaaacgccggcctcgcgggccactgcctgaatgcttgccttggtcatatgccgtcgctccttcgccgtcgcgaacaatcattgtcatgacaacgataacatgcccataacaagtcgtcgtcttcggctatctcgattacgaggggctgatttagaccaatttcccattgccggaatcgatcaccgcttctctcggcgcatcacggcggctagggactgcacgcgtggcaggtcgaagacctcgtcggtatgtaccacgtggcctgagctgtccgccagcggcacgcgccagttcgaatactctctggaagtgcccggctgattctgggaacggcattcgcccacgccgtccaccaacgctgcctgcagcagcagcgacggcgtatcggtgagcatggcgtgcatcgcttccacgatttcctgcacatggccttccacatcatccgccacggtctgcgagatatagccgttctccaccagacggttcatcatggccgtgcgttcggccatcgccgaggcggcgaacgcctccaccggctcgctcaggagatgcagctcctcgcgtagcttgacgtgttcgaagttcaggtagccggcggtgggtggcagatcgtgcgtggtcaccgaggccaatgcctgcttgcggtagtcctcgggtgcgcggtacgggtcgccggcgttcggcgaatcgtccacgcggttgaaccattccacgtcagtgccgagtacgccgtgatctgccagaatgcggcgcacgtaatccggcacggtgcccagatcctcgccaaccaccatgcctccggcgcgcgtggcttcgatggccagtactcccagcatcgcttcgtggttgtacgttacgtatgcgccgttgagggcgccgagcccctgcggaatccaccacaggcggaacaggcccagcacatggtcgatgcgcaccgcgcccgcgtgctcgtacatcgaatgcaccatctcgcggtacacctggtagccggtggcctccagatagcgtgggctgaacggcggctggccccaatcctggccctgctggttatagaagtccggcgggcagccgaccgtgacgccgccggaggcgaagcgttccggattggcccaggcatccgcgccgagcccgtgcacgcccacggccatgtcttgcatcagacccagtgtcatgccgtggtccagcgcctcctgctgcgcggcgttcacctgctcggcggcaatccactgcagccagcggttgaactcgaacaggtcgtggtgctcctcgacgagctggcgcacggccgggtcgtcgatggtcttctcgaagaaccaacggttctcgccccacggcgcgccccatacctcgaagcacaggcaccaggtggcgaaggaatcgaggtctgggccggcggtggtcttgaaatgctcgaattcgagctcgcgcttgttgttgcggcccgcgtcgaagatcaggcgcagcgccgggcgtttggccgcccacgccgcgttgatgtccatcgggttcgattcgtcgttgcgtgcggccactgaatcatgcagcgcatccacctgcgctcggatatcggccggcagcgtgccgtattcggggatgtcctgcgggcggatgtacgtcacgttgaggaatcggcgcgattccggtagatacggcgatggctcaagcggcggaatcggcgcgccggcgtgaatcgggttgatgagcatgaagtcggctttggacttgtcggccgcgtccgccagcagcagcttcagatcgccgtaatcgccgatgccccacgattcgcgggaccgcacggaatacatctgcgtcatccagccccaccgctggtgctcggcgaccgcctccggcacgggaatgcgcgcgggggcggcgatgatggccgccttgccctcgcgcccgtccaccgtgacggtcagtgtgtggtagcccatcggcagatcgggggcgatggtcaagtccggcttgccggaattgaggttcggcagcagggcaaagtggccaaacgcggtgccgtcctccagctcgatggaggcggtgatgtccgcgtccgacgggcaattcagggtcaggcttgtcggcttgccggtggtggccacgatggtgggtggtagcaaacgtttgctgttttcggcctcaagttcggtcatggaacgttttatggcctcgtcgctggaggcgtccacatcgagggccttgagcacggcgaccaaggcctcgtcgctgatttcggtgtaggtgccgagctggtcgatgaacgaggtggaaagcccgcatgctttggccagcttgaccagcggacgggcgagtcgttccgtgctttccgcgcgctgcggggcaccggaagcggcgtcgttggtggtgtctgcgatggtgccggtgctggtcgctgcgtcgttgctgtacgcgtcggtcatgatgactccttgcttgcaaattgggtactgctagtcgtttgcattgctgttcgagggccgctctgcgttgaggttccggcaacctgacagaccaatgttcgagctgttctgcctctaccgtaactcatattgacaacgattgcaatacattcggtgagttggacgaggctagaggtgttggtgtttgtcgtgatggcccgttgactatccccagtcgactttgccgacagcctcgccggcggaggtgaggtcgaacgggtttaaccaaacacgacgaacgattgcggggagagcgtcagctgcccgccgctcacggccggttcaccaagactgagcagcacgtcggcgtcggaagagagctcgtccggcaggtattccgtgaggaatgaggcgattgaggcacctgaatcggcgttgaaataactggaatcgccttcgtgctccataggcgtgtcggtattgcgcagcaacaggttgtagccgttcgggtggccgtcccggcgccagtcgaggtagaggtccatgtcgaagccggcctgcatcgattcgttcggatggcctggacgccatcggcggaccgacctgggtggattccgataaggcggccgtatgggtgaccaactgggacaccgagcgcaacggctcctcgctcaccacccgtgacggcaccagctacctgctcgccaacgccttcatgctcgcctacgattacggccagccgcacatcttctccggctactactacgccggcgtcgacgacggcgctcccggcgccacccgcacctccgtgccggacatgacctgtccgaccgacggcatcgaaaccgccggcacctggcactgcgcgcaacgctggaccgccatccgcggcatgatcggcttccgcaacgccgtggccggcaccttcaccgccaccgtggccaagggctcggccgtcgccctatacgccggcgcgacgcccgcaaactgggccggcacccggaaatacgatccgtccgatcccgcctggttcaccggcgaaacaccgcataagggcgatgacaccgccgccaagtccgccgattccgcagcgtccgccaagtcaggcgacgccaagtccggaaaggcaacgtccgatgccatccgccgcgccgcaacgctcgccgccatcctcctgcccgtcatcgtcggcgtcacgttcatggcgatagctcgcaggaacggcaaagcccagtccgacaacagcggcccgaataacgactgattcggccccgctcagccgcgcacccgcggcgcggcggtggagtcgcgtaccagcagttgcacggggaagatctcgtgcggctggtccagggtgcgcccctcgataaggtccagggccttgcgcgcggcggcgacggccatgtcgtacggcttctggcgcacggtggtcagccccacctcgcccgagaacgtgctgttgtcgaatccggtgacggacaggtcggtcggaatcgccatgccgcattggcgcaggcggaagaacagcggaatcgccagcgaatcctgatggaagcacagggcagtcggggcgtcgtcgcgcgcgagcagcgcggtgagggcggcgtcgaccggatcgtcgccggcctgcatgtccatcgtctggccggtcacgccgtccagttcgctgcacgcctccaggaatccggtgacgcggttgtgcgagctgaagcccatcgtggcatcgaacgtctcgtacaaatacaacaggttgcggtggccgagcgtggtcagatggcgcacgatcagccggatgccggccttgtcgtcgatgcccacggaggcggtgaacccctgcgaggccgtgttgatgccgatgagcgggatccgcgtggtgttgagtcgcctgatttcggccggggtgatggcgaacgacgagacgatgaccgcgtccgcgttgccgcgcaccggcagttcgtcgaagaactcctcgcgcgcgcccgcgtcgccgatcggttggatgaccagatcgtagccggccgatcgcagcacttcgttgaggccttcgatgatgcgcgaggtgaaccagtcgagcttgctgctgcccaccagcagcgccacgcggtgggagcggcccgatttgaggatgccggccatgcgggataccgagaagtcgagttgttgggcggcctccatcaccttggcgcgcgttttggcggagaccatgtcagggcgggagaacgcgcgggagaccgtggcggtggagacgcctgcttgcctggcgacgtcctcgatgctggctttcatggcccctcccggtttttcaaagttgacggtgtgacaaacttctcttcattgtaaatcattgcagtacgttttacgacagtcatagtgcaatgggttgcgatattgcgacacgccgaaaatatagaccaatatggtctcaatagctttggaatgtaacaggttgcaaatgtaacggtttgcatggctgagaaagccgggttgccgaactagttcgacacccgtatgctgaaccgtgttcacttagagcttgcgaggaagtaagggagataatgaagatcaagaaatctctcgccgcgctgactgcaaccgtgagcattatggcacttgcaaccggttgcagttcgagcggttcgtcaggcgtcgtcgacacccaggccgacaagggcctggccgtcatgggcgacaccatcacctacgaccccaaccacttggtcaacgacggccagcccatcgaactgggctactggtcctggggcgacgaaagcactgacccggtgatctccatgctccacgagtacgagaagatccacccgaacgtcaccttcaagatctcgcaggtggcttggagcgactactgggtcaagaccccgctctcgctcaagggcaacaagaacgcccccgtgctgttcaacgtccacaactccgaggatgccctgctccgcccgcacgccgtccgcctcgacggcgccagcgactggcgcatcttccaccaggtggtgctgccgatgagccgcaattccatcgccgcgctcgccatcttcaccttcctgtggaactgggaggactacctctggccgttcctcatgatcaccgatgacgacaagcagctgttgtcggtgggcctcaagatgttctccggccagtacggcaccgattacggcggactgttcgccgccacctccgtgaccatcatcccggtggtcatcgtctacctggtgttccagaagcagttcatcgccggcatcgccaccggctctggcaagtaaacccggccggtttcggccgaatccgaaccgcgccgcagtctcccaccagtcccggggagccgcggccgcatcactcgtatcatcgtgaataaccgtacagaaggggtaaccatggcacagtcaccacaactcaagcagtcgtctccgacctcgcccgatccgcaggacttccgcctcgacgccacgccggccatgcgcgccgacaatgtggtgtccggcgagcactggcgcatcggactcatcaccgattcgctcgtgcgattcgaatggtccgattccggcgtattcgagaaccgcccgacccagaccgtcctgaaccgcgatttcggtagcccagtcgaacgccgcgtcaccgagcgtgacggccgcgtcatcatcgacaccgcggccctgaccatcgtctacgaccagcagccgttcagcaaggaaggcctgagcgtggtcgtcaaaggcgtggccgacacccagttcaacacctggcattacggcgacgcccagcgcggcaacctcaaaggcaccgcccgcacgctggacgaggcggacggcgccatcgagcttgacaacggcgtgatctcgcgcgacggctgggccgtcatcgacgattccgccgccaacatcatcatcgaaaccgacacggtgaacggcaaggcgaacccgttcggcacctgggtatccccgcgcgccaccgccgaaacggacttgtacttcttcggctatggccaccgctacatcgaggccgtacgcgacttctatcgcctgaccggccccacgccgctcctgccgcgcttcgccatgggcaactggtggagccgctactaccggtacacgcaggacggctatctggccctgatggaccgcttcaagcgcgagggcatcccgttcaccacctccgtgatcgacatggactggcatcgcgtggacgacgtggacccgaagtacggttccggctggaccggctactcgtggaaccgcgaactgttccccgacccgccggccttcctcgccgacctgcaccggcgcggcctgcgcaccacactgaacgtccacccgcgcgacggcgtgcgcgcgttcgaggacgcctaccccgaagtcgccaagcgcgtcggcatcgacccggccaccgaggagaacgtggaattcgacctcaccaacccggacttcgtggacgcctatttcgacatgcaccaccgcatggaggccgaaggcgtcgacttctggtggctggactggcagcagggcggcgtgacccgcgagaaaggtctcgacccgctgtggatgctcaaccacatgcactacctcgactcagggcgcggcggcaactggccgctcaccttctcccggtacgccggccccggctcccaccgctacccggtcggcttctccggagacacgatcgtgacctgggaatcgctcgccttccagccgcagttcaccgccaccgcttccaacatcgggtatggctggtggagccacgacatcggcggccacatgttcggctaccgcaacgaagagctggaggcccgctggtaccagctcggcgcgttcagcccgatcaaccgactgcattcgtccaactcgccgttctccggcaaggagccgtggaacttcaaccgtgacgtgagcgccgcgatggtggacgcgctgcgtctgcgccacgcgatgatgccgtacttgtacaccatgaactaccgtgccgccgaagccggccgtccgctggtcgagccgatgtactggcagaacccggatacgccggacgcctacgaggtgccggacgagttccgcttcggcaccgagctcgtggtcgcgccgatcgtctccccggacgatgccgccgcctgccgcggccgcgccgacgcctggctgccgcagggggagtggttcgacttcttcgacggccgccgatacgtctcatccgacgccgccggccgccgactggaggtctggcgctcgctcgaccgcacgccggtgttcgccaaggccggcgcgatcgtgccgttgcaggacgtcgcggaatccggcgaagcggtcaactctatcgccaacccgcaggccctgcgcgtgctggtgttccctggtgccgacggctcgttcgtcatgcgcgaggatcgcggcacgtggggcgccaccagcgccgacaccgcgatagcgttcacgtggggcggggccgatgcgtcgcccagcgccttcaccgtcgcgccggttaccggcgatacgtccgccgtacccgagtcgcgcgactggacggtcgtgttccgcggcgtcgcgccggtcgatgcggccagcggcgtgcgtgcatggtccggcgaggctccggtcgaggcaacggtggcgtacgacgaggcgaccatgagcctgaccgtgtccgtcaccggcatcagctcggctgccagtctgcgcatcgagattcccggcggtctgcgcatcgccgacaatccggtcgaatcggacgcgatggacctactgctgcacgcccagatgctctaccgcaccaaggagctcgcgctgcaggcggtccacaagctcggcatcggcgcgatcggcgccctgcgcaccatgaaccgtggtccgcgctacgccaacgatttctggatcaccgacatgcccgatgcggtggccggcgcgctcgaagaaattctgctgcgcagctgagcccggttgcagttttctgcaacatccgggtgcgccccggtatgcggcgataagttcggcatggttgccgaagggcgtggcataccgggtgcagtgcgtgggatggccttcgcgattgcactcatcgtgcggtcagtggaaaggaacttttcatgcacaaggtgaaacagcacaagggcgtcgcggtggccgccgcagtctgcgcggtcgcgatggcggcctcgctcgcgacccacgccggcgcggccggggaccggcgttattgactggctggcgttatcgagtgattggcggtatcaattagccggcgttattgatgagccggtgttgtcgattagccagcgttatcgaccggcactgaagcatgcagtacccactgcccgcgtttctcccgcacatcccaatccccgtgcgcatgcagcacacgctcccgatagtacgcaagcccggaatgccgcccctcaagcgtcgtgccaccttgacgtgggcggtccgtcacatcaatggtgacgtggtcctgagcggcggaaaccagcaccacgtaacgctgcgtcggatcggcatacctggcgatattgccgaacaattcccgcagaaaatcggcgacaaacactgtgtctgagttattcagcgcatcgatgcccccagcgacaataacgtcgccgacacaccccatgcgccgcaatcgcgcgccgccgctggcaagtctgatggcaaggctgatggcgcgccccagtcaccccttgcagttttctgtataagtggattttggctccaaacgcaccactccgtcatcgccgtcagtcactcccacaaaaaacttgagccaaacatactcaactttttgtgttgaaattgggaatagaacttgccaaatggaagttgagtgatgtaggctcaagtttggaaggtccaagagacgaccaatcggaacttgggcaaagaacgtaagaacaaacgagtaattaaggagcacacattatggcacgtgcagttggtatcgatctgggaaccacgaattcctgcatcgcaactcttgaaggtggcgagcccaccgttatcgtcaacgctgaaggcgcgcgcaccacgccgtctgtggtggccttctccaagtccggcgagatcctcgtcggcgaagtggccaagcgtcaggccgtgaccaacgttgaccgcactatttcttccgtcaagcgccacatgggctccgactggaccgtcgacatcgacggcaagaagtggaccccgcaggagatttccgcgcagatcctgatgaagctgaagagggatgctgaggcctacctcggcgagcccgtcaccgacgccgtcatcacctgcccggcatacttcaacgatgcccagcgtcaggccaccaaggacgccggcaagatcgccggcctgaacgtcctgcgtatcatcaacgagccgaccgcagccgctctggcctacggccttgagaagggcaaggaagacgagcgcatcctggtcttcgacctcggcggcggcaccttcgatgtctccctgctggagattggcaaggatgacgacggcttctccaccattcaggttcaggccaccaacggcgacaaccacctcggtggtgacgactgggatcagaagatcatcgattggctggtttccgaagtcaagaacaagtacggcgtcgacctgtccaaggacaagatcgcgctgcagcgtctgaaggaagccgctgagcaggcgaagaaggagctctcctcctccacctccaccagcatctccatgcagtacctggccatgacccctgacggcaccccggtgcacctggatgagactctgacccgtgcgcacttcgaggaaatgacctccgacctgctgggtcgctgccgcacgccgttcaacaacgtgctgcacgacgccggcatctccgtgagcgacatcgaccacgtggtgctcgtcggtggttccactcgtatgcccgccgtcaaggaactcgtcaaggagctcaccggtggtaaggaagcgaaccagtccgtgaacccggatgaggttgtggctgtcggtgccgccgtgcagtccggcgtcatcaagggcgaccgtaaggacgtcctgcttatcgacgtgaccccgctgtccctcggtatcgagaccaagggtggcatcatgaccaagctcatcgatcgcaacaccgccatcccgaccaagcgctccgaggtcttctccaccgctgaagacaaccagccgtccgtgctgattcaggtctaccagggtgagcgtgagttcgctcgcgacaacaagccgctgggcaccttcgagctgaccggcatcgctccggctccgcgtggcgtcccgcagatcgaggtcaccttcgacatcgacgccaacggcatcgtgcacgtgtccgctaaggacaagggcaccggcaaggagcagtccatgaccatcaccggtggttccggcctgccgaaggacgagatcgaccgcatggtcaaggaagccgaagctcatgaggctgaggacaagaagcgcaaggaagacgccgagacccgcaaccaggccgaggccttcgcctactccaccgagaagctcgtcaacgacaacaaggacaagctctccgacgacatcgtcaaggaagtcaccgacaaggtcaacgctctgaaggaagccctgaagggtgacgacaccgagaaggtcaagaccgctcagaccgagctgatgaccgccgcccagaagatcggccaggtcctctacgcccagcagggtgccgagggtgctgccgctggtgctgacggtgccggcgcttccgctggctccgcctccggttccgacgacgacaccgtcgaggccgaggtcgtggacgacgatgacgacaaggacaacaagtgatgtccgagttcaacaaggacgactacctgaacgacctgccggatccctcagatgctgaggctgccgctcaggcctcttcaggggctgacgcctccgccgagtccggctctgcgcaggattcggctgcccaggctccttccaatgaaggagccgacgcggctcctgccgcagctgagggagagaagactggcgaaggccagtccgattccgcagacaccctcaccccgctcggcaaggccaagaaggaagccgcagactacctcgaagccctgcaacgcgaacgtgcggagttcatcaactaccgcaatcgcacgcagaaggagcaggagcgcttccgccagcacggcatcatcgacgtgctgaccgcgctgctgcccgccctcgacgatatcgaccgcattcgcgaacacagcgagatggacgactcgttcaaggccgtcgccaccaagattgacaaggccttcgagaagttcggtgtcgagaagttcggcgaaaagggcgaggacttcgaccccaccaagcatgacgcgatcctgcacaagccggacgcggatgccgaaaaggaaacggttgacaccgtggtcgaggccggctaccgcatcggcgatcgcgtaatccgcgccgcccgagtagtagtagcctccccgcaaaactgacatccagctcgctgcaatgagttgatatttaccttggctcccctctctgaggggagccaatcataaagacttttctagaaaggagacatgaatggctgaaaacgaatggctcagcaaagacttctacaaagtccttggtgtctccaaggacgcttcggacgacgacatcaagaaggcgtaccgcaagctcgcccgcaaataccatcctgacgtcaacaagaccaaggaagccgaggagaagttcaaggacatctccgaagcctatgacgtgctgagcaagaaggaagatcgccagaagtacgacgcgattcgtcagttcggcatgggcggtgcccgcttcgccggcggttccggcggcttcgatgcttccggtttctccgacatctttggttccatgttcggccagggtgccggcggcaatggctcgcgcatccgcttctccacttcgggcggcggccccaacaacatcaacgacatcttctcgatgttcggcggtgctgcaggtcagggcggccagccgtatggcggctacggccaatcgccgtacggcaatgccggcggctatggctatgaggaggccccgcgccccgaaaacggcgaggaccgcaactccaagatcagcctgaccctgcgtcaggcggtcaagggcgctaccgtgtccctgtccgtggacggcaagaagttcaaggcccacgtgcctgcgggcgtcaaggacggacagaaaatcaagctggccggcaagggcaagctaggcatcaacggcggcaaggccggtgacctgtacctgcacgtcaccgtcaagcccgatgccacattctcgatgcgcggccatgatatcgtcatggacctgcccgtcaccgtgggccaggccgtggccggtggcaaggtcgaggccaaggatatcgacggcaatcccgttaccttcaaggtgccggcaggctccagctccggcgcggaagtcaagctcacgggacttggcgtccagcgcagcaaccagccgggcgatctgatcggccgtgtgcagatcatggtccccgccaagccgggtctggccgtcaagcacgccgccaaagaattcgacgaaaaagccggcgactatctcagcctgtaatcaggaggtgaacaatggcgcggttagccaaccagatgaagcagttatacgcgatgtgcgcaaccgcgctcgtgatgggcagggccgatctcgacggagccgatgacgtcggcttcgacatcgaactgcccatcttcaccgtcggccagaccgccgagttggccaacattcacccccagactctccgtcagtacgaccgcctcggtttggttcgtccgcagcgcaccgatggcggcgcacgccgctactgcctgcgcgacattgcccgcctgacccgagctcagcgcctgagccaggatgagggcatcaacctttccggtatcgcgcgcattttggtcctcgaagaagagaatcgccaactgcgccgcgaagtcaaacgcatgcaaaccggcgaccaggagagcgttttcgccgcaggccgtgacggcaatatcgtggagatacaacgctccaaccgcgcccgcctctggcgcaacgccatccgccgcgaaacccgcgaactgcccggccgcgatactgccgccgatatcgctgccggcgccaccggcgactccaactacactcccgccgactccaagtccatggtcctgtggggttggtgagtctggccgcattgcttcgattccttctccattcgtaaaactgtttgttatctcacatcgggcagctgccgaaaagcacgaatcttcttgacggagatgtcaaggtttgttacggtgacgtgcgaaaaccgattcgtaaggggtgctttaggctgagacggtatgtgccgaacccttcgaacctgtgagctaacactcgcgtagggaatgcgacggttgaactcctctgttcggctcggcatcccatatgcgcgttgagagagaggaagcgtatgtcaatacgcaaggagctgaccgcccagaacgtactgctgggtttccagcatgtgcttgtttccaacgtctggcttgatccggtgtttgtggccggagcaatcggcttacctattgccctgtcgtcgaacatgattaacgccatcttcatcgtctctggtctggttactttggttcaggccactcggctggttcgcctgccggtggtgcaggggccgtcagccgcgtttgacgcgttgatgatcgcggcaggtacggccggcatgctgggggcggcgagttcgtccattctcatcgcttcgcttgtgttcctgttgctgtgcctgaccggtgtgatagagcggatgcggttcctgttctctccgatgatttcgggcgtggtcatctttatggtcggtgtctcgctgtctggattcacgctgagcgagtttctaggcggggctcccggcgacaagacgttcgccgatccgcacatcctgaccgtgtcgattctgaccacggcgattgtgcttgtcctgtcgttgctcggcaagggcctgctcaagtcgttctcattcctcatcgcgctcgtcgtcggcaccgtggtcgccgcagcgtttggcatggtggacttctctcctgtggcatccaagggatggttgggcctgccgaccttcctgccctacggtccgttcacatttgactggaagatcttcatcccgttcttcattgcctacatggttgccgtcatggaagctctcggcgtctatcaggcggcttctgagattcagggcacgtccctcgaacgcaagcaggtgcgctacggtcttgccggcgaggcggccggttcagccatttcctcgctgattggtggattcaccaccaccgcctacccgcaaaatgtcggcctgctcaacctgaccggcgaaggcaagttgcgcacgcgcacgcctgtgatcatcgccgctgtgctgttgctgattctgggcttcgtgccaaaggcgggcgcgttgctgtccgtcattccctcggcagtcgtcggaggcattttcctgccggctgcggccagcctaatcgtgaccggcctgcgcgccctgcgcaaggtcgctgatgacgagcgccgtcaaacggtcatcggcatgtctctgttgctcggcatcgccctgcccaaggcgctctccggcctgaccggcggcgcaagcgtgttctttggcaacaacatcatggtcggtgtattcagcgccatcattctcaatgcgcttttcgtcgctcttccggatttggtggcgaagcatcgtgcgccggcgtccgtggatgttccagcagccgatccggcggatgggactggcgctgcggcgtacgatgaacgataatgctggttgatattggatattgacaggagcgatgcaatgactgatgtgatggatgacgcgcgtcgtatcaagcgcgggattctggattttatccatacctatggctgtgagcaggccccggaagaggcgtttggtgcgttggcgcgcgacgtgttcatctatcagtacacgtatgatctgccgtaccgtcgttactgcgcggctaaacgcgtcacccccgcaacgctcaaggattggcgggagattccgccgatgccggtggacgggttcaagcaccttgacctttcgaccataccgaccgagcagtgcgaagccgtattcatgacgagcggaaccacgcatggcggcaagatgcgtgggcgcaacttccatcccgatcttgaggtgtgggatgaatcaatgattgtgccgttccgtcatttcatcatgccggatcgagagcgtatccgcatcgccgtgatttcgccggcatgggacatgaaccagaactcctccctgtcgcgctaccttaccaaggccgtggagtgctgcggcagcgaaggcagcggtgtgttcttcgacgagcatggactcaagttcgatgaaatcatcgccttccttaaccgtgcggtgtctgacggtgaaccggtgatgctgatgggtgtctcgtcgtcctatctgtatctgttcgattacctgcatgagcatgatctgacgttcgcgctggcccccgatagccggttgttcgacactggcggcttcaagagcactaagcgcgacatcaccgaagaccagatgcttgatgagctggaacagacactgggggtgccgcgccaccactgcgtcaacatgtatggcatgaccgagttgagctcgcagatctatgaccaaaatattctgtcgtggtatacggatggcaccagcaactatctcaaggcgaaccccgcctgggtgcgcacggtcttcctcgatccggaaacgctgactcccgtcaaggatggtgagaccggtgtgatagcccattacgaccttgccaattggaattcatgcatcggtattctgaccgaggacctcggccatcggaccccggacggattcctgctgcagggcagggcgaagggagccgaggctcgtgggtgctcaatcgcggtagacgaggtcatcagtgccaaccgttgatgaatccgtgagtcaggccattgatgtcttccacctgccctcgggagtggatgtttcggattacgaaatctatgaggtcgccacatcggatggggtgaagcgtttgcgctatccgcgactggatggctcaaaggtgacttcccttgccaagcagcttgtcgatgttcgcaaccgcacgcttgccgcgatgagtgtcaacgatattctcgacatcgtggccgacgcggcccaactatgggccgatccggattttgagctgcggcgtcaggctgaactgctgattcccgcaatcaccggatatgagcctgacatggtgcggattgagctcaaacggtatatgcgccagttcaggcgtcgtgaactgctccggttccttgactccgaaatcggtcagccgtctatgctcgacgaattccggccgaacaaggcgggggatactctaaatatgtgggcccagcgctcacctatcaggtgttctccagcaatgtgccggggattcccgtgtggagcatggcgatgaccctgctggtcaaaggcgcgattcttggcaaatcttcattttccgagccggtgatgcctgcgttctttgctcgcagcattgcgatggtcaattccgacctcgctgatgccattgcggtggttccatggaagggcggctcgcagcagctcgaggattcagccatcgatgcggccgatgccgtgattgtttacggttcttcgcagactaccaaattgattgcgggcaaagtcgccgggtccaagccctgtctaggttacggagcaaaagtcgggttggcgttcattggccgagaggctttgcgtcctgatacctatgccgataccgtgcatcgtgtggctgttgacatcgccacatatgaccagcaaagctgcctggctccgcagaccgtgttcgtggagactgatggagccctcacccctcgtgaagtggctcagctgctcggtggcgagcttgagaatcagcagcgcaaatatccgcgctccgtattgagtgacgccgagaacgtggccattcagcgggcgcgcaccgacgctgagatgagagccttgatgggcgggaaggccgcggtgttcgccagtggccatagcacggcatggtcggtgctgtatcgagaacttgacggtagcggtgccgacgaggatgttgcttcgctgatgtcgccgttgaaccgcaccgtcaacgtggtggcggtgccagatttgttggacgctgccagaagactgacttcctgccgtggctggctgcagagctgcggtgtcgctgtggattcaaccagactgtttggtcttgcagatacattggccgaggtcggtgtgaatcgcatctgtccgctcggtgagatggatcgggcgaaatccggctggcatcatgatgggggcttcaacctcatcgatctgttgcgcgcggtggatgtcgaacgcggcagcgacgcgtacagcgattcgttcgatatggatatggaataggcctgtgctgttgcgggcagcagaggctggtagcagggcgaaaggcaagggtaatgacagagcaaagcgatatggcacggcgtccaatggtgaatctggatggcagaacagcgatcatcaccggttccggcaagggcataggagcggctgtggcgaaatgcctggcatcgcacggagccgctgtcgtcatcaattacgtacatgacgccgccagcgcgcagcgcaccgttgaagacatccactcgctgggaggcttggctatagctgtacaggcggatgtttgcgatgaatcgcaatcttccaagctagtgggtaccgctgtcgactcattcggcggcgtggacatcttagtgaataatgctttcggacgcttctcctttgacccgcgtcgccgttccacttttgctggaggcgattgggatgagtttagcgcacagatcgagggatgcctgcatggtgcatatctgatgtgctcacatgtggtgccgctgatgcgagcccagacctccgggcgtatcatcaacatctccagcaatctggtcgattcgcccatcgtgccctaccattcgtatatcactgccaaaggcggcttggtcggcatgacccgctctctggcccaggagctgggcggcttcggcattaccgttaatgccattgccgcaggtttgacggccggaaccgcatccagcgcagccaccaccgaggatgttcgtgaacgaatcattgccatgacgcctcttggccgccttgcccgtcccgatgacatcgccggaggggtcgcgttgttggcgtccgacatggccggcttcattaccggacaatgtctgcacgtcgatggtgggctgaccatgcgctgaggcgcaggggcggtgtgctgacgcgctatggttgtcgcatccgattggtgcaatggaatgcagcaagagtaaaggcgccaattggcgtgcgggcatgtggacggaggtaactatgctgctcaaagccgtgttctgggatttggacggtactctcatcgattctgagccgctctggcatgacggtgagattgagatcgcgcacaacaatggcggcgagtggaacgaggacctcggttgggagtgctccggcactccggtaccacacgtggcagaggtcatgattgcgcatggctgcacattgagcgttcccgaaatcgacaagcagctcaaggattatgtgttcaaggcggaggtcgaacgtctgccgtggattcctggtgtgcaagacgtgctgcattcgctcaaggaagccgacatcccatccatgctggtcactacttcgcctcgccgcatggccgagaacatcatgaagcaggctgatggattgcttgccggctacgtctgcggcgatgatccgtacgagcacaagccgagccctgccccatatctggccgcggctgagagactcggcatcgcgcctgaagacatggtcaagtgcgtggtaatggaagattcctcatccggtctgcgctccggcgccgcctcgggggccacactgattgcgcagactggctggattcgcaccgacacttccggccttggccagtttgcctccatcgactcgtatgagggcatcgatgcggccgcgctggacgcctttgtgcggcagcgtttgggggagtagaaatttcgtttgtattgcggagtttgtgtgggaaaccccagtcgacctgatgttataggccggctggtagggtatttgacggtttgcatataactgtctggttcattgggctggcagctcaatacaagatttaggactcataggaaacacatgggcttcgttaatttcatcatcgaactgctgaaggatccgcgtgccgcgattgccggttggattgccatgggcgtggcgccgaccctcggattcatcttcctcatcgtattcatcgaaacgggcgtggtgttcttcccgttcctgcccggtgattcgctgttgttcgcggccggcgtgttcgcagccccggatgctgcgaccggcaaggccgcgctgccgctgttctggttgctgccggtggtttggtgcgcgccgattatcggcgaccagtgcaactacttcatcggtcatttctttggccgccgtattatccaatccggcaaggtgaaggcgctgactcctgagcgactggccaaaaccgagggcatgattgaaaagtggggcccgctggctgtgttcctgggccgcttcttcccgttcattcgtacgttcatgccgttcatttccggtatttccggtatgcgttggagccgtttcacgccgttctcagtgctcggcggcctgtgctggtccacgttgttcacgctgctgggctacttcttcggcaacattccggccgtgcaggatcacttcgaactggtgatcgtgctgattctgctggtttcgctcgccccgaccatcatcggtctgctcaaggccaagttcggcaagaagaagccggccaaggtgaccgatgctcagttggacgtcatggaagacggcatcaagaacctcgataagtaagcaaggaatgtagattaccacataaggaatcgtcgtgaaaatgaaggccctgactgtgcatatgaggtcagggccttttctgcatgagatgggcgtgaaacaacagcgtggttatccacatttgtcgtggacgacatgccggggtgtggataactcagcaagctagaaccacaatggtcgattcgtgttgagcattgaactcggacacgtttcaatcggcttatgaatagcaacaccacaccccgcgtggcgcgtaggatcacctcgccagcggtagcacctccgggcattccgctgcccacggacgatgcgccgattccagcgcatcgctactacactccgccgcccaggccgttggcctcatgcgaacggcagagatcgggcgaggctccggcactcgccctaactacagacaccagcttccataacattgtgacgatgacgtcaggtcatggaggcgtggggttgagtgtcatggcttccatgcttgcatggacattggcgagacgtgaacacagctgcgctctcatagacgctgatttcgtggccggatgccttgacctgctgctgggtgtagaacgagagccgggtttacgattcagccaagtcgacgcacccctcggccgcatcgagggcgatgcgatgaaccatgagctgatgatgtgggagggtgtgcgagtacttccctatgacccttggagcgcgcgccagcctgactggtgggaagttcaagcggccattcgagccttggcggaaacgaacgacgttgtcatcgtagatgccggtcagggtggactcattgagaccgtacccgatctgcgcagtggcatgcaggtgattgccgcggaattgtcggtgatggggctggccagagccaagtcgcaccggtccagactggattcatggggctgtgaagcgccacatatcgtcggcgtggaaccacgtggcgctccacgtgggagaggccacgtgggtattggtgaggcgcaggactatttgactgccacggtattggggcctgtcaaaccaagtgtcaatctgtgtggagacgtactggaaggcctcggcatcagatcggtgaccaaaggcagccgcaaagccgtgagcttgcttgccgatcttgtcgagcaggccattcgcccggtttcgggagcttcttgcaaggaccggtgatgcggtatggctgccgtaatcactcgggctgatgagcccggcgcagtgcccagaactgtgttcttcggtctattgaatgatgtggcatccgacccgcaggttaccgatctggcggtgacctgtgatggccgcgtttgggcggaccgcggcaacggcatgcgagaaacagtattgcgtgtgccgtttcgctcgccgcaagtagttcgagaatacgccgtccaactgtgcgcgcagcttgggcgcagactggatgatgcctgcccgatagcggacgccgccagtccagacggcatccgcgtgcatgcggtgattgccccattggtgccacaaggtgccgcaatctccatacggttccctgacaggaccatggcatcgttgcgacatctgagccaattaggtgtattcccggctgcttggctgccgatgttcgtgggactggtgcgcagacatgccacagtgctgattaccggcggaacaggcgtgggcaagaccaccttgctcaaggcgctgctggcgcaatgcgatgtgaacgagcgcatcgtcaccgtagaggaagttcgtgaactgggggaactggggcgtggcgatcatgtgtcgttggtaacgcgcgaggcgaatgtggagggcgtcggagccataagtctgacggacttggtcaaagcgacgttgcgaatgcgccccgaccgcgtggtgctgggcgaatgccgtggcgcggaaatcgtcgacctattgcgcgcgttcaattctggtcatcacggtggcatgaccactgtgcatgcggacggcgtgaaccgagtaccgtccaggctgatttcgcttggattactcgccggagtcagtccacaggcgttggccatgctggcggcaggcgctttcgacgcggtggtgcatttggagcgagtgaacggacagcggcgtatcacgcagatcggcgaactgcgtgtagcacatggtgaactggcaggaacaccgctggcggtatggaatggctgccatcctcctcggtatgccgccgaatgggggcacttcattgaacgatggggcatcgttcccgggccgagtggtggtgggtgatgatgtggtgtgctgttctggtggcgctcgccgtgctgatatggccggggaacaagtccgggaggctgtatcggctggcttaccgcgggcgtgcggtcgattccgcagccataaacgaacctcgatatgccggctcacctcgcgtgggcgttgcgcaggtgattacgtccgccatcgcgcgattgcgaggtggcggcacattggttgaagcattcgaggaacaatccagcagacgcttcgccactcagcgcattactgtggaacggctcataacggtgttcgaacagcggcgtctgcccgacgaatcaccagcgcaggtacttgaagctgcacgcggggtcaccgccgcagcggttttgagcgatgagctcggttgccaagcagtgccatgtctggaagcggtattgactgcttaccggcagatgaggctgatgcagaacctgcgatcgcaagcatgtgccgttcctaaagccactgtggggctgctgagcgcgcttccggccgtcactgtggcattgggcgagcttctgggagctagaccattggcgttcttgcttggatcgccacgcggtgtggtctgcttggtattagggggatgttgttatgctgccggcttggcatggatgcgggcattgttgaaaggcagcggattatgagtacggtgtgggtacacgccgcggcaggctgtgcggcgatcgctagttggctgtataaggctccgtctcgtcatgacagccgcttgccgggcgaggaaccggtcgtagcgcatgattgcgggtcgtcatggaccatactcatattgcgtatgttgcaggtgtccttgcgtcagggctcctcgattccccgggcgcttgacatggtgggcaaagccgtcggcggcgactgcggcgctcgcatgagcgaggtcgggagctccctggccagaggggttccctgggctgatgcgtggcatgccgctatggctgttcagcatgagggtgcgccagctgatagttcatccggaaaacgtaccagcagaacgcaacgagatcttggcctgctgcaatcggctttggaatcgtcatggacgcatggcgatatgcctggcgtgcgcctcgaatccgccattgaacagctggaccgtgacgagcgtgccgccatcgaacggaatgccgcgaagctgtcggtaaagctactgatgcctacagggctatgttttctgccggcattcgtgctggtaggagtcattccggcgattgcgtccttcatgatgtgaatataggcgtgaactgagtgcgcttagggtgaatcttgttgtattgctcggtattgcacttggctgcgtttggttatccacattggtggtggacgacacgtcggggtgtggataactcggcaagctagaaccacataccccgttttccctggtgcatgaagcgttgatagtccacagtggtatgcaccccgcgtcaacccggcgcgggggccaaccactcacacacgcatggggaaggtgcgaagccactgcgcagcttcccctccttaccgaaaggaacgccaatgaatacccctatccccgtcatcgtcgacgggcaggccggcatctttgcgcacagcaaggctcgtgtggccacgctgaacgccaaggcgaaagaacggctatgcctcatggacgcacgcatccgcaccctcatggctgagcccgaagaaggcgcggccactgcggaatacgcagtcgtactcgttgcggctacaggctttgcggcggtgctggtcgccatcctgaagtcggatgccatcaagacgttgctgaccaacatcatcaaacaggctctgaaagtcgggtgacagccatgaagaccatgacatgccggtggcggctcgccagactgccgccagacctatgcacgggatcggccaccgccgaattcgcaatcgtattgcccagcattatcgccatcgccgggctgatattggcaataggacgtgtggtcatcgtttccatggactgtcaaagtgccgcggcagcggctgcacgcgagtttgtggttaccggtgacgaatcatccgcgcgcagcatagctgcggacgttgccggggagagccccacgtcagcattgcccacgacggccaatcgacgagtgtgacggtcgaatgttcggtattgcccggtccgctggatgtaactccaacgcgggttaccggcaacgctacggcgataagccaataacggtcggctggctgggcggccgcaacagaaaggaactgcggtgcagggaatgcgttatgaggagggatcgggcacgatggccggagccatgctggttatggtggtgggcattgcgctcgcggtggcggcaagtgtgggcaacctcatgatctgccagaaccgagcgcgttccctcgccgaccttatcgcctttgacgccgcgtatgcgctgtggcatgcggatatcggtgatccatgtgcgctcgccgccaacatggctgaagcgaatggtgtagttttgggctcctgctccgtgcgggatgaagacgtgttggtaaccatcaaggtggaaaccatggtcctggtggcatcatccgtggagcggatggctcgggccggaccggtgagttgtacggaaggagacaattatcacaataatggaccgtaaagcaccgatactctggcgggcttctgggcctttggctaaggtgagagcatgagcgagagtgaacgcaacgagcgccgtcgcgtggtggccatggtgggcaaccccacttccgataaaggccgtggcgctaaggtggacgcgcaggtattgggtctgctggaggaagccggccgtgcccataactttgatgtcatcgacatcaccggcacgagtttcgacgattccctgaatcaggcgcgtgaacgcgcgcacgagtacgactatctcgtagtggtcggtggcgacggcatgatcgcacttggagcgaacgccgtgggctgcagtggcaagccgttgggcatcgtggccacggggtcgggcaacgatttcgcacgaggactgaagctgccggtcaaccgtatcgaaaccgcagtggaaggtatcgtcggtgctatcgtgcgcggatcacacatcgatgtggacatgggacgcgtgacctctttggacggcggctatgccgtggatccctccactggcgaggagtacgagtaccaggagagcaagtccgccgagcatccgattgaccggtactatgcgggcatgctgtcctgtggtcttgacgcgagcatcaacgaccgtgcgaatcattcgcatctgccgaccggcaccatgcgctactttgcggcggtgctggtggagctgacgcatatgaagcgttatggttaccacatcaaagccacattggcggacgggaccacggatgaacgagacatcatcacaccattgctgacgattgcgaattcgaggcatatcggtggcggcattgaggtctcgccgtactcctgcttctccgatggattgttggacctggtgtggatggaccacgtgccgaacttcggcgaatgcgcggtggccatttcgaatgcctataacggcaagctacttgcttcaaaggtgttcggctggaaacgtatccgtgaaatcgaagtcacgcgggcaacggaaggagacgagccgccggtgctgatggcggacggcgaatatatcgggcatttgccatttagggtagtggccgaggactgcgcgttgcgcgtgctagtgccgccggccgtagccgcccgtgaggtggattcccgacaggaagtgctcaacgccattgcccgagatggtcgcgatcccgtgaccggccagttcgcgtgacccgattatattggctcccctcattaggctgagccgtaaagcaaacagcccagtgggctgtttgtaggcgagggttcgacgatagtcgaaccagaagaaagtcagccgtaggctgtccgcaattgcggacgagctggccgcgaagcggactgagaggagtgcgggagagcggtaccagagccaatggccgtcagacctcagacgacatagctttcgatatgcagcgtctgcgccatgacctctttgatggttcggtcgctgatgttcagatgcgagcgaatcagcgagataagccccacaatcagtgtgaagaacgtctcatggacgttggtgattggcaggccatgcatctgctcgaaatcacgtacggtggtctgggcaatgtagtcggcaatacggtccgccgcgcggtcaatgaacttgatatacagttcggcgttgccgtcttggatcatacggtttgagaaggggctctcgtcggcgatcagggagcggagcacatgcacgatgtcgtctaatgccttgttcacgttgcctgtttcgcgcgcttggttccactgcttcaacgtggtgaggatttcgtcgatgacgttatcgagtactgcgtcagctacggcttccttgtcttcgaagtagtggtagaacagcgaacgcgtcataccgacttcgcttgcgatgtcggaaacggtgattttggagaagcctttttccagacacaccttgcgcgcggcttgcacgatggcgtcgcgccgggcatcgccgcgggtggggcgtttctcgtcgagggtatcgctcatgggtgcctcctgaccacaaccgttattgacactatgttaatacaaagaaagcggttaataacaataaaaatgcggtaaccgttgtcaggtgaatgtcgttggaatataaagagttttccgattcggcaactatgagcccggtttatcttgactttttatcggttaattctgagggcaaaggtaggttagtagctatggcacttgcactgtatcgtcgctatcgtccggacaccttcgaaggggtcatcggccaggaccaagtcacggtcccgctgatgcgcgccttggacgagggcaagctcacacatgcctatctgttctcagggccgcgaggctgcggcaaaaccagctccgcgcgtatcctggcccgttgcgtcaactgtgccaaagggccgacttcccacccctgcggcgaatgcgaaagctgcaaggacctggccaccggcggtccgggttccatcgacgtggtcgaaatcgatgcggcctcgcacaacggtgtggatgatgctcgagaattgcgagaacgcgctggtttcgcccctgcgcgcgaccgctataagattttcattctcgatgaggcccacatggtcacgcagcagggcttcaatgcgctgcttaaaatcgttgaagagccgcctgaacatgtgatgttcatcttcgccaccaccgaaccagacaaggtgatcggcaccatccgttcgcgcacccaccactatccgttccgtctggtgccgcaggaagtcatgggtccctacctggagacgatctgcgacaaggaaggcatcaagcccgagcccggtgtgctgaaactggcgatgcgcgccggtggcggctccatgcgagataccctgtccgtgcttgaccagctgatggttggttcggtcgaaggcgttatcacccatgatgccgctgtagccctgctcggcttcacgccggaggcactgatcggtgaggccgtggatgcggtaatcgatcacaacggcgaagccctgtacggcgttatccagaaagtcgtggtcggcggattcgatccgagacgattcgtcgaagacctactggctcgtgtgcgtgatctgctggtgcttacgttggccggggaccgtgcggaatccgtgctgtccgacacggctgaggccgaggatatggacgatctgcaccgccaagccaaggcgctgggactgggcgcactgaccgcaatggcagacatcatcaacactacgttgggtgccatgaccggagccatttctccgcgtatgcgcttggaactgctggccgcgcgattgttggccggcagtgaatcaggctttgcaacagccgctcccgcgccagcttcttctggtatgccgcctgcggctgcttcttcgacttcgactacgccagccgcttccggtatgggtgccagtggttttgccggcgcatcgcgaggcgggtttgccggagcctcacatggcggattctccggtgctgcacgcaaccagcaagcagccgcgcctcagagcaccgcttcccatgaatctgttggaggcaatggccctgtcaacggcccggtcagcgaccgacccgcgggctctctgtctgtgcaacctgctgtagcaactgctgctgccggtgccgctcctgccgccaatgccgggtggggcgcgcccgccgcgtcgccggccgtcccggctcaaccggtgacctcgcctgcggcatcggataatcggtccatcgacgagaagtgggatgcagccgtcgccgctttgccggaaaccattcgtgaatatgtgtcacgagacaaggtgccgaccgtaaaattcggccccaaccgtaagggtctgccttgcttgtcgatgacgttcgacaagtcgctgagccagcacgctttcgccttggccgtggataacagcggtaagaaggcggcggccgtggtgatggatgccgtgcgcaacgagttcggcgccaatgcggttattgcaccttctgcggtcgcggcgaatggcgagcgagtcgaatccgtcaaacgtatgagcccggagcaattggccaaggtcaagcagcagattgccatggccaaggctggattggccgcgtcgagtttgggcgcgagcctgggcattcatatggggagcgagacgaaagctccgaagccgactgcaacaggccaagccgaggacgcagacgacagccatcgagccggacaatccagtgcatccacggcagcgaagaactggagtgacgatgacccttgggccaagccggccgtaagcaacgcttcgccgcaatctgcagacgggttcgcgcctaacgagcccgctgctacgcctgcgcccgaagagcatcacaagaagcatgttgcggttccggacatcagtgacggtgttgatccgtgggccgctccggctgctcctgttgcacccactgcgtccgttgcgtccgctggacccactggacagtccactgggcagccagccaccgcatcttccgttacggcagttgccggcgcgagcgacgatccatggaatcagacgcagtctcaggccgcggtctcaccggcgtcgcaaccggccgaagccgacccgtggaaccagccatatcagcagtctcctcacgatgatccgtggaatcaaccgcaggggaaccatgctcaggcggctccgcagccaggagacgacccgtggaatcagcctcagtcccagactccggcttcttcggttcctcagacagtgtcgggcaatatgtcgggcgatgacccgtggaaccagccccaatcggttccgcagccggctgccggcgatgacccgtggaatcaaccgcaggcagttccacaatcggctccgcaggccaccccgcacggtgacccgtggaatcaaccgcaacccgcacagccgaccccgaatgccgacccgtggaatagccagccccagccccagccgaaaccacaaccgcaagtcgcggccgaggatgacgaatactcgatgagcgaccagtcgctcggcgaggcgacggccatgaatctcgacgatctgaaaaagctattcgaggtcaaaaaagtcgagcaattcgcggcagatgatccgaagaaccccaagaacatccagcctgccaagaagcactcggatgaataatgaggacgaataacgaggaatacccatggcacttgcttatgacggcgcaatacaacgactgatcgacgctttcgggcggctgcccggcatcgggccgaagggcgcgcagcgtatcgccttctacatgctgtccgcgcccgaagatgaagcgcgcgatttggccgaggccatcgaagaggtcaaggccaagatccgcttctgtgatatttgcggcaacgtgtgcgaatccagcccctgcccggtatgcgccgacccgagacgcgaccgttcggtgatctgcgtggtcgaagagcccaaggatgtgatgagcatcgagcgcacgcgcgaataccacggcctataccatgtgctcggcggcgcaatcaacccaatggccaacgttggccctgccgacctgcgtattcccggtctgctcaaacgcttagaaggcgatgaggtcaaggaagtgattatggcgctcgacccgaatattgaaggcgaggccaccaccagctacttgacccagctattgcgacccgtaggtgtcaaggtcacccgacttgccagcggcctgccggtgggctccgacttggagtatgccgacgaaatcacgctgggcagggcactggccggtcggcgcgaggcctaagccagcgtatcattggcgctttcgcccttgcggcgcatccacggccagaatgcgccgtggcggatgatgcgcgcggccttgtggcgtcgtgccaaccagataatgaacagtcctgccgccagtatgcctagaccaacaccaagggcgatattgcgcgcgtcaagcacgtcattcggctcgggggccggcatcggaatcgccacgcggtgcccggagataagcagtcggtgcgtgttcacgccgtatggcgtacaggtcatcaaagtgacgcgatcctcacccggcacgatcttgagcttcgacgtgtcatccggcaaaatcaccgaaatgcggtccactttgtagcccaaagtttcgcccatgacttcgatgtagaagaagtcgccctctttcacctcgtccaaacgggtgaacatcagcgcttcaaccaacccgcggtgcccggtaatgaccgaatgggtggatttacctcccaccggcagcgacgtgccgtacaagtggccggcaccagaagccagtgcttcctcggaagtgccgtgataaaacggcagattgatggactgcttgggcaccttgattgtgcccatcacgccgttgccggtattaagcagtgactggtattccttgtctttctttgaggcggaatcctcgccgctggcttgggatcctccttgagcggcggcgaacggatcgacggcttcacccaagataggctggccggattcagcgagcttcttgttgtatgcgcgggccgccgtgagcttgtcttccgcctgcgggtaaggccagccagctacttctttggccgtggtggctgtggtggcggccaagttgcggtcggactcgaattgcaacgctagcgggaagcaggccacggcgattgcggcgatcagcagcacaatggtgatgatgcgcatcgcccacaggttgcgttgcaggcgtcggcgctcggccacgagatcgctgatatcgatgacttcgtcaaatggtgttggaacgaatgctgcgggctcgggccgcgctgaggaaacgttgtcatttgcagatgcgtcatccggcatggccgcgttgttttcccacattttctgtgaggcacgcttactcgtcgaacgtcgatgcagcaatgccatagtcgcctgttccttcgcttgatctgctcatgatttgcttatacaagacggccgggtccgtcttagtcgtgcatggcataggtgctgtcgcaaatggcaacaccgcacgcgccacactgcgaaacgttactccgcaccaagcctttcatgcaacatgccgacggggccatataggggcaatgtaggggcataagaagtctgaaaatgcgatacgaacaacgttgctacggctgtcagtgatgcggcttacttcggacaagccgttgagatgcaaggggatgcaaaggattgcaaagtatggcaacatgataagtcgcagcgtcggcgatatttggcagagctttcaaataggggggtatgaatgcataaagagggaatatgttacctcgataaaagaggcgctattgctgttttcgtggatgtcggttcgtcgtcgagccgttggtttcgtaggcgtgaggggcgttcccgcgtattctgttttccgaccaaagaaatgaatcacgaagaacgcctgagcaaaagctcattcgccggattgccgaacgtcaaaggcgcggttgcagaggatgcgcggatcgcggattcgccgctgcgttccgaattggctagtgtgatcagagaaaagatggcactgtctgggcatctctctttttaggtcaaggaaaagggtctggcgataggcggtgatgacgcccatcgtgttggtggcactgttgctgcaaaaaggaaaagtctagttcgtaatctagtgtccaacttccctaataggaatggtccaacttccacaacgaaaatagtccaacttccacaattagaatggtccaacttccgcaatagagtgatttataggttgatgtttcgacggtttgcgggagggcacatatggcagtggagagctcggagattcaacgtggcgagtaccttcctcgagtggctgatgggttgctgactcaggcattgcagtcttctggtgccgttcagattaaaggtccaaaatggtgtggcaagactgcaacggcagaaaggcagtcggcgagtcaggtcttcatgcaggacccggatcgcagtgctacgctgttggccttggctgatacaaagccttctctcatcctgcgaggtgaggagccgagactcattgatgaatggcagatggccccgcaattgtgggacgcggtgcgtttcgccatcgatcgagggcgcggtcgtggccgattcatcctaactggatcggcgactcctcaacaggaaccagctcattccggagtgggaagaattgcccgattaaccatgcgtaccatgtccttatttgaatcgcaggaatcgacgggcgttgtttcgttgggagagttgttcgatggcaaccatgatgtttcgggtttctccgatttcgatattgaaaacaccgcgtttgcgctatgccgcggtggctggcctgaagcagtagtcgaatctcgagtaaatgttgccttgcgcatggccgcggattatgtcgaagaactacttgattctgacatcaatcgtatggatggtataaagcgcaataaaacttggatgcgtctgattatgcgctcgtatgcgcgcaatatttcttctcaggcgtcgcaatccactatcgcggcggatatgcagggtgaaccgccttcggaaggtacactctccgattatttagatgcattgtcgcgagcttgcgtaactgaagatcttccagcttggaaccctcgtttacgttctaagactgcagtgagaacgagcccaaccagacacttcagcgacccgtcgatagcttgtgcggtactgcacgcgaccccggagaaactccttaatgatttcgagacctttggcttgctgtttgagtccatgtgtattcgcgatctgcgtgtgtatgctgatgcgcttggcggagatgtgttccattatcgggataagacgggattggaatctgatgcggtcattggcctgcatgatggacgatgggctctcattgaggtcaagctcggagaaaagcaggttgatattgcggcggcccatttgaaaaagttggctgacagaattgatcaagatcacgaaggccgtccgtcattcttgatggtgctgaccgctacggctgccgcttatcgccgggatgatggggtattggtagtgccgttggccacgcttgctccgtgagctcgtatcgtgcgtttgacccatcgttcccaacacaaaaggaaaaggcccgggctgcgggaccgggccttgaaaaggagagaggaagaagaaggtattcagttatggggtctgcggaaacctcgccggtttgctttcgtttgccggtaattgatagttaaccgctcgaatctcaaaggatggatgcggctgcctcaaagaaccaccggtgaaaacttgaatatttgctgaacaacgtaggccatgcccgtgtccacatgtcggcgcggggtcgcggggtgaacgcggcaacctttataatcgttgcgtttgcgtagaatattgagcaaactccccctaagagaagaacaaaggacagcagtggctctcatcgtgcagaagtacggcggttcgtcggtcgccgataccgaatcgatcaaacgtgtggccaagcgcgttgttgagacggaaaagaagggcaacaaggtggccgtggtggtctccgccatgggcgacaccaccgatgaccttatcgatcaggcgctgagcatcgactccaacccgcccgagcgcgagatggacatgctgatgaccgcaggcgagcgaatttccatgagcctgctggccatggccattcacgccgaaggcagccgtgcccactccttcaccggtcagcaggccggcttcttcaccgacgcccgttacggcgcggcccacatcaaggccgtgagaccggaccgcgtgaagaacgcgctctcattgggagacatcgccatcgttgccggcttccagggcatcaacgccaagggtgacgccaccacgctcggccgcggtggttcggatacctccgcagtggcgcttgccgtggcgctcggtgccgatatctgcgagatctacactgacgtggacggcatcttcaccgccgacccgcgtatcgtgccttccgcccgccgcattccgtccatcgattacgagtccattctggagatggcgtcctgcggctccaaggtgctggcactgcgctgtgtggaatacgctcagcgtttcaacatgccgctgcacgtgcgttcctcgttctcccgtcgccccggcacattggtggtgcccgacggcattgacccgcgtacgctgccgaacctcgactgagcgcggctacagcgaacgataatcgtaagtaatttcaagcaagacaaggcaagacatgactgaagaagaagcgaaatccatgggcgacctgttccctgacctgggccccgaggcaccggtgatttccggcattgcccacgatcgttccgaggcgctggccaccgtgcgtggcgtgccgaacgagccgggtatggccgccaaggtgttcaccgagctggccaccgccggcgtgaacgtggacatgatcgtgcaggccggcgcatccgtcggcactgcggacatctccttcaccgtgcccgaatcggccgtcaagcaggttcagaacacactgctcgacaagcaggaagtgctgggctaccactccttcgatgtggacaccaacgtaggcaaggtggccgtggtgggcgttggcatgaagacccatgccggtctggccgccaagttcttccaggccctgagcgatgagggcatcaacgtgctgatgatttctacctccgagattcgtatcgccgcgctcgtgccgctcgatcagctcaacgacgccgtcaaggcgctgcacaccgcatacggtctcgatgccgatcaaatcgaagccgtggtgtacggcggtactggccgctgagccactgagccgcgtttttgcggtatatacgacgaaagccctccttgcggagggctttctcagtttcggactcagttttaactacttcttggtgatgtagccgagagccttgagcatttcggcgcattcaagggcaccgccggctgcaccacgcagggtgttgtgggccagacccacgaacttccaatcgaagatggaatcctcacgcagacggccgatggaaacgcccatgccaccctcgtagtccacgtcgagcttgacctgcgggcggtcatcctcggtgaggtactggatgaagtgcttcggtgcgtgcggcagctccagctcggaagccttggacgtgtagttcaccagacggtcgatgagctcttccttggtggccttcttgccgaagttcaggaacacggtggcggtgtggccgttgagcacgggcacgcggatgcactgggaagtgatcttgaggtcgccgtcgaacggcacgatctcgcccttggcggcgtccacatggccgaacaccttgagcggttccttctcagactttgcttcctcaccggagatgaacgggatgatgttgcccaccatctcgggccagtccttgaaggtcttgcccgcgccggaaatcgcctggtaggtgctcacaaccacctcgcgcggctcgaattccttccacgcggccagcgccggcgtgtaggcctgaatcgagcagttcggcttgacggcgataaaaccacgagtggtgcccaggcgcttgcgctggtgctcgatcacctcgaagtgctccgggttgatctccggcaccaccatcggcacgtccggggtccagcggtgggcgctgttgttggagaccaccggggtctcggtcttggcataacgctcttcaatggcgcgaatctggtccttcggcatgtttaccgcagagaacatgaaatcaacaccagaggccacggactcggcatcgtcgccatcgacgaccaccatgttcttgacatattcgggcatcggggtttccatcttccaacggtcgccgacagcctcggcatacgtcttgccggcgctgtgcgcggaagcggcaagcgtgaccacctcgaaccacgggtgattctcaagcagcgtgataaaacgctgaccgaccataccggtggcaccaaggatgccgaccttcaatttttcggacatgatgacctctatgacctctgggtttcgatggattacttacgtcggacggccgtcatgcgggtggccgtaaaacaatgcaattgtacgaaacacgcggaacaacggcagtggtcttcccagatggtggctgcccaatgaagcgaaggcgatgttctacactggtagccatgtctatcgcatcagtagaggcccaaaaacagctcgaccgtatcgtggctctcggctacccggatgtggcggatatttccgccgccgcattccgctcgctggcccgacctctgatcggggcgctcgagcattccgatttgggatcgaacatcctgctggtgcccacgcgtgaactggtttcgcctgagtcgctgattgcacgaacctccatcaatcgcatggcaggcttcaccaccatgccgccgcgtgacatcgccagcttcctgcctcaagacggcttcatgccgccggaaggcccgttctatctggtcgtcaatccgcacaccggcacgtgctatgtcaatcgcgagccggatgtggcccgcaaacttattgactccgatgagcgcctgccgctcaccctcgaggaaggcttggccatcgccacccagcacccggagtggctgctggaaaagaacggcttcaatctgctcggctcacgctccgcagacggacgcgtgccgagcatctggatgagccagaacgcaccgcgactgggagccgtctggcccaattcccgccatacttggctgggcaacgcgtattgcacggcccgtcgcggggtgagtctgttccgttaaagcgattctcctcaaaagacaaggtcggcaaggtggatggcgaccgcccgttgtcggcgcatggggaaccgtaatgaaagtcaataaggatggcaccttctccggctcctaccacgactcggatatgggagccacgggagacggctatctcataggaaacgacgtcgatacgctgaacggcaaagcattgctcaacgtgacgagcggagcggataagggatacacgttctacgatttctcgtagtgattcagctgccgtgcggagcggcggggaacgtgaaggaccggcgcgtatgctgtgcgaaacagcattacgtccctagactggtgaggcatgacgaacctgcgattccgcgaagacggcagcttccgcgtgctgcagatggccgacatccaagacggccccaacgtactccccgataccatccgccttatccgtgaggccattcgcaaagccgacccggatctggtggtgttcaccggcgaccagattcgcggttacgatcctgcctacatcgacactttcctgcgccgccgtggcgaggaaccgggcgctcgcgtgcgtgcggtcaccgaagtcgaggccaagctgcgcggaatcaagcggcgggccagaaaccgcgtgaacaatcgtctgctggccatgaagtctgacggcagcaatcccgacgtccaacaaaccgcgtccaccgcgtccaccacgtccacgctggtctactccacaacatccgatccacaggatgtgccgacgactttggacgagctcatggacgagacccgtgacaaagtccgccgcacgtttgccggcttccttggcccggtcatcgaagcggaagtgccgttcgccgccacctacggcaatcacgatttccagtgcggcatcctggccgacgagcaggacggcatctaccgcgaattccccggctgcctgaacccggtcgacagcctcgagccaggcacttttgccctgcccattgaggcttccgacggatccgggcgcgtagctatgtccgtcatgatggtgaattccggcgattacgccggcaagcctgaagagaacgacgcccaatacccggcctatgtggtcaatccgcgcggtcttgatttggctgattccgatgggtatggcacgccaagccccgaggcgatcgattggctgggagccgtacagtccgaacttggcgaacgcaacggcgacggtaagccggtgcctgccatcgccttccagcacattccgccgcaggaattctacgattgcctcaaagaggttcccgcatggacgccgaacgcggtggaaggcgcacgtacccacgccggccattgctacgtgctcaaccatgagatttgccggccgggatcgcggctgggtgaggcgattggctgtgcggacgagaacgtcggtgaagtggacgccttgcgtgaggcaggcggctacttcgcgctgttctgcggtcacgatcacaagaacgccttcgtgggccacgcgcatggcattgatttgggctacgcgcctacctgcggattcgaatgctatggtcccaagtcgcgctatcgcggcatccgcctgttcgaattccatgaaagcaacccggccggctacgtgacccgcatgctcacctggggtgatctggtgggccgatactccagcaacgaggtgcgcgtctggttcgaggaccactgcgtgaccggtgccatcagcatgcgtaacgaattgcgccgcccgcaggtattcgcagtgctgtccggtgccatgagcctcggttttatggccgtcatccgctcgttggtgaagaagcggtgacgaccataaaaccggtcaatacatcaattctgctgatacggcctgaatgcggaataggtggcatcctcgtcgtatagcaggttatcgggctcttccgattttggcgtgtaggggcatgtgtcagaggtgggtttggatggcgtgtctgaagccgccggcgtgcagcaggcttctggtgatgtagttgtcgaggtttgcggaatcccagggctatgcccctgagggtctcgagccttccgttgatggcctcggtgggcccgttcgcgctgtgctcccagtcgaagaacgcgaggacgtcgcccatgcgcccccacgcatagctgtaagtagtagtgctgcgtcggaacgctaagtgtgctggcgtattgtgagatgaacgggatgttggaatgggccgtcgctaggatagaggaagttatgcatgttaccaatgcgtaaacgaatatccaataagcgattgtatgaatggttcacacagtaaaggaggaacaatgggtcaggatcaatcatccgtttttgatctcgcagcggtagccgcagcgtccaatgggggaacaacgacccgctgctgcctccggcgcgattcattggcgatccgcagaagccgagtcgtatgccgtacaacaagtacgccgcctacgacaagcagatcccgtttgattacccggagcgtacgtggccgggcaagcgactgcagcgcgcgccgcgctggtgctccgtcgatcttcgcgacggcaatcaggccctcgtcaacccgatggattccgagcgcaagctgcgtttctggaacctgctcgtctccatgggattcaaggagatcgaggtgggcttcccgtccgcttccgagaccgatttcgacttcatccgtatgctcatcgagcgtgagctgattccggacgacgtgaccatcgtggtactcacccagtgccgcgagcacctcatccgccgcacttacgaggcgctcaagggtgccaagcgcgccatcgtgcacttctacaactccgtgtctgtgttgcagcgcgaggtcgtgttccgcaagaacaaggaggagatcaagaagctcgccaccgacgccgccgaactgtgcaaggacctcgagaacgaggccaagggcatcgacctgtactacgagtactcgccggaatccttcaccggcaccgagccggagtacgccgtcgaggtgtgcaacgccgtgatcggtgttatcaagccgactcccgagcacccgatggtcatcaacctgcccgccaccgtggaaatgaccacgccgaacgtgttcgccgacgaagtggagtacgtctccacccacctcgacgaccgtgactccgtggtgctctccctccacccgcacaacgacgaaggcatgggcgtggccgccaccgagctggccgtgctggccggcgccgaccgcgtggaaggctgcctgctgggcaacggcgagcgtaccggcaacgtcgacttggtcacgctgggcctcaactggctcacccaaggcatcgacccgcagcttgacctgtccaacgtgcccgagattcgcaagacggttgagtactgcaaccagatcaagatttccgagcgtcacccgtacgccggcaacttcgtgttcactgcgttctccggctcgcatcaggacgccatcaagaagggtctcgaggctcgtcaggtggccgccgagcgtgctggcgccgatctcgacagcttcgtgtggcttgtgccgtacctgccgatcgacccgaaggacatcggccgtacgtacgaagccatcattcgcgtcaactcgcagtccggcaagggcggcatggcctacctgctcaagaccaaccacaatcttgacctgcccaagcgtctgcagatcgaattcgacaagatcgtgcagaactacgctgacacgaccaagaaggaagtcaaggacgaggatatctggcgtctgttcaaggacgagtacctgccggtcgaacagtccggcatgaccgccgccggtgtggttgtgggcgatactcatgacgcctcgctcgtgccgtggggccgcttgaagctgctcaaggtggccgtcagctccggtgaggatggctccgacaccgtgctcaaggctcgtctgctcgaccgcggcgtgaacgtcggggtcgatgcgcccgtggagcgcgaggtctccggcatcggcaacggtccgatcgccgctttcctcaacgccatttccaactttggcgttgacgcctcgattatggattacgtggagcacaccatgtccgtcggcaccgacgccatggccgcctcgtacgtggaatgccaggtcggcgaggccgatgacgcgcagatcgtgtggggcgtcggcatcgattcgtcgattaccactagcgccctgaagtcgattatctccgccatcaaccgtttccagcgcaagcgctgagcgctagcagagcaaaaacaaggctccctctgattgcatcagagggagccttgttgtctgtgttttacttactactgggtgacgccgttggtgccggtgttcccgccggtgcctccggaattaccattatcgttgccggtattgttcccgttgtcaccgccggtattgttgccggcgttgccatctccgccggtagtggtgccgggataattcgggcactcggtggaatagctcggattggcgaggcactgctgggcgaactcctgagcctgctgttgcttcttggcttcctcttcggccgccttctgctgtgcgtcctgctcagcctgcttctgcgcgtcttcggtggactgcttgttggtgttgttggacaggccgctgctctgtcccttgcccaagccccaagtgccgtcggagccgccgatcttgccgttgtctttagcggtcgggaactgctccgcctcggtgccttgcaaggcctgagccatgaactcctggaacaggtgggcggggtatccagtggaagagacgccgtatccggagaaggctggcaccacttgcggattgcccttatcgtccggattccagatagcccacacattcatcatgctgggggtgtatcccacgaacgacgaagccatttcgtcgttggcggtaccggacttgccggcgacgggccggcccaacatgctggatgtgccggccgccgtaccgtacgtggtggtgccctgcatggccttctgtaccaaagcgcagtcgttggcatcgaacaccttggtgccgttgctgggcgcgttgtacatgtccttattgttggaatcaagcactttggacaccatgtgcaaggtgttcttcacgccattgttggcgatggtcgaatggccttgcgccaaatcccacacggtcagggcgttgatgcccagcacgttgtacatggagttttcatcgatatcgccctgaatgcccgcttcatgggcgattgcggccgtgcgcttcggcgtcagatgctcattgacgttcatgaacaccgtgttcaccgagttggcggtggcctgatacagattgatgttgccccagttgttctccagagcgttgttcacctcttgatccaagccggtgaagtgctggtgggaattgccgttgaacaatgtatcgaagctgacgccggattgcgcggcccccagcaaagcgaacggcttcatagtcgaacccggttcgaatacggcctgatcggcattgttgagctgcttggacagataatctgaaccggcgtatacggacaatacttcaccggtcttcgggtccagcgctatgccgccgatttgcagggattcaggcatgtcgtccagacgggtgtcgccgatggactgcataagatcctgcttgctcttgtcgatggtggtgatgatcttgtatccgccagtatccaaatcctctttggtaaaggccttggactgcaccagctcgcggcgcaccatatccagcagataaccgttcggccccgcgtattcgttctgctgcgccaccgcggcggtctgcgggaacttggcatcagtgtgctgcttggcagtgatgtaaccatcctcctgcatgatgttcagcacacgcttgaagcgcgatttggccatatcggcgttatcggccggatcccacgtggacggtgacggaataatgccggcgatcatcgccgcctcagacagcgtcagatccttggcgtccttattgaagtatgccttggccgctgcctggataccgtaggagttgcggcccagatagatggtgttcatgtaattgcacagcacctcgtccttggattcggtctgcgcgattttgatggccatgatggcctcgcgcgccttgcccacataggatgtggtttcgcccatgtaataccgctcggcatactgctgagtgatggtggaaccaccttggcgcgtgcccttggtcacattattaatgaatgcgcgggcgatgcccttcagatcaaggcctttatccgtgtagaacgtacggttttcggacgccacaatcgcgttgccgatgtagtccggcagcccctcgcaagagatgatttcacgattctgctccgcgtaggagccgatcgcggtggtgccgtccgcgtaatacacggtggttttctcggccaacgcgaacttctcgggttgcgggacctcagtggtggtgtacaggtatgcgaatactgcgataccggccagcaagcccagtccaatcagggagaagaagatgcccagcacccatttcagtacacggtgcttgccttttcctgtgttctttttcttcctgttcggggctcgatggctattggaagccttgtggcttgcgtggcgggaacggctctcctggggcgtataggggccctcctgtgcggagtggccggctctgctttgcgcggtgcgcggttgcctcagagcggggccattgcctcccgaatgtgcacgacgagtataagaagccatggtgtccaccgtaactgttggccttgaacaatcgtttgacgtgagcgtagccacacgcgtttatgccggtatttttccggaattcttacaattgggcacgcttcttgatgctgcatgaatattgcctgaatgcgctggttggcctgtcgtgcgacccggcgcgcacgtttcgtgtcgctgcgctggtccatacgtctccatagacttatccccagcctccacgcggcgctatgtcacccaactcccccagggcaggaatgcagcaagggtaagtggcctctgacgggtgcgtggaggttttctttatgtgcggatttggctgtgagctggcactagcgtggtcccctgtccggggcgcggccgtacagtcgaacgtatgaatgacgcacagacccctagaattcgcgacccgcatgcggcggtcaatctggtcggctcaggcgcagcacagcctgactcgtcgtcgaacgttgttgacccattggctgcgctcggcccggtctccggttcagatgcatcggcatccacatcaggctccttacgggatttcaggccgctggacatggacgatgcggatggggcatctgatatcgaccgcggcttggcccggcttgacccgcttaccgtgcgcccgcgaatctccagccgcgtactgtgcgtggtattcggtctgctcctgatcgctatcggcttcggcgtgtggtgggggtgcgtgtttaccgaaaacggacaatcgtacgacgaactggtctggaaaaacctgcacaacgatgtaccgtcctgggccaccggcgtgatgaacgccgtcgcacaatcctggctggttatcgctgtcagctgcacaattgccgcaatcggcattattacggcgctgattcgacgccgctggtggttggccgggcaaatcgccgtgttcgccgtggtctgcttggccgtcacccgtatcaagggtctgttgccgcgtccgttcatcatcaacactgaatcgcctgccgctaattccgcgccttccggtcacacgatgctggccgcagcctgtgcggtgattctgctgcttaccgtgcctcgtgcggttcgagctttggcgggcgtcatcggcgtggtttgggcggtgaccgtcggtgtctccgtgatatacggacaatggcatcgcccttcggatgtggcgatgtccatcctgctggtggcgggattggccctgctcgctctggcagttacgcgcaagtccggcatggacgagccgggtcgccgcgtctcctcagtgagcgtgcaaatcgtcggcagcgtgctgattaccgggggcctgctgttgctcgcctacagcggttatgtgatctggcaggtggtgccggggctcaatgtcagcgccagctgggcggttcagggggcgaatgtcagcgctgttgtgggcattgcgggtgtggccatgctcgcattcggactgttgctggccctgcgtcagatcactgcagcgcccttaagccggctgggtctgatcggcgctccgccggcaccgcccaaacggtaaaacatggggtgcgaacggccgaatttgcccggcacaacggcggaatttggcagttggacatgattcatgagtattatgacgccagaaacgtcgtgtgtttcgcgcaatacataaggagtgggtatggctaccaaactggtgattgtggagtctccgaccaaggcccacaagatcggtgactacctgggcaaggggtacaccgtcatggcgtcggtcggccatatccgagacctcgcgcagcccagccaggtgcccgcggcagacaaggccaagttcggcaagttcggcgtggacgtcaacgacgggttcaagccgtattacattgtcgacggcgacaagaagcgtacggtcagcgaactcaaatcggccctgaagaacgccgatgaactctatctggcgactgatgaggatcgcgagggcgaggccatcgcgtggcacttggtgcagaccttgaaacccgaggtgccggtcaagcgcatggtgttccacgagatcaccaagaacgccatcaacgcctccctgaacaacacgcgcgatgtggatggcaatatggtcgacgcacaggagacccgccgcatcctcgaccgtctgtacggctatgagctgtcgccggtgctgtggcgcaaggtgggcccaggcctgtccgccggccgcgtgcagtccgtggccacccgcctgatcgtggaacgcgagcgcgaacgcatggcgttcaagcgcgcaccgtactgggatatcgtcgccacgctgtccgcgcctgacgcgctgggggagcgtgccgaattctccgcccgcatgatcgcgctcggcggcaagcgactcgccggctccaaggatttcggtgccgacggccagctgaccccggacgggttcgcggcgaacgttcgccagcttgatgaggctggtgccactgccgtggctgaagcgctgaggaccgccgatttcactgtgatgtcgatggaaaccaagccgtaccgccgccgcccgcagccgccgttcaccacctcgaccctgcagcagaccgccggcaatcgcctcggcatgggtgctcgcgccgtgatgcgcgcggcccaaagcctgtacgagaacggctacatcacctatatgcgaaccgattcggtgacgctgtcgcaggagggcatcaccgccgcccgcaacgccgtctcctaccatttcggcgacaagttcctctccgccgagcccaagcagtacgccaccaaaaccgctggcgcgcaggaagcccacgagtgtattcgcccggcgggctcgcgcttccacgacccggacgagctggcttccaaacttcccggcgaccagctgcgcctatacacgctgatctggcagcgcacgcttgcctgccagatggctgacgccaccggttccaccgccaccgtgcgcctgtctgcgccggccggccccaccgagggcgaggccgtgttccaggcgtccggcaccgtcatcgaattccccggctttatgaaggccacgggggaggggcgcaagcccaaggccgccgctcccggcgctggggctggctcggaccaggctgctgccgccggcaagacggacgccaaggccgtcaggggtgacgcctccgaatccaacacctccctgccgccgatgagcgtcggccagcaggtcgaggcaagcgacatcgaaccggacggccatgaaacccagccgccggcccgctacaccgaggccacgctggtcaagacgctggaagccaaggagatcggtcgcccgtccacttacgcgagcattatctccacaatcatggatcgcggttacgtatacgagcgtggccgtgcgctgatccccagctggctcgccttctccgtgaccaagttgctcgagacgaacttccccaagctggtcgactaccagttcaccgccgagatggaaaacggccttgaccgcatcgcccacggcgaggaatccggccgcgactggctcacccacttctacttcggttccggcgagggcgccgcccgcaacgccgacgaggcgcacgaaggcctgcaacagcaggtcgcgcagctcggcgagatcgacgcgcgcgccatcaacaccatcgacatcggcgacggcctgcacgtgcgcgtcggccgttacggcccgtatctggaagacatggagcatctggacgccgaaggcaacccgaagcgcgcgtctctgccggacaccatcgcgccggatgagctgacggtggccgtggcccgcgatttgatcgacaaccactccggtggaccgcgcgagctgggcgttgatccggtatccggcggtaccgtcgaggtgcgcaatgggcgtttcggcccgtatgtggcgttggtgccgccggctgaggcttcggctggcgctgctggcgatactgctggtgcttctgcggccaagaagggttcgaagaaggccgcggccgccgccgcgtcgcgcccgaagatggcctcgttgttcaagacgatgagccctgaatcgctgtcgctggaagacgcgctaaagctgctgagcctgccgcgcgaagtgggcacatacgaggaaaccaacgccgaaaccggcgaggtatccgaatgcacggtggccgccaacaacggtcgctacggcccctacctgaccaagacgggtgccgacggcaagtcggagacccgctcgctggcctcggaagacgagatcttcacggtcgatatcgacaaggccaaagaactgttctcgcagcccaagtacggccgcgggcgtggccgtggtgccgccaagccgccgctgcgtgatttgggcaaggacccgaacaccggcaagaacgtgaccatcaaggacggccgtttcggcgcgtacatcaccgatggcgagaccaaccgcacggtgccgcgtcagtacacgcctgaatccatcacccctgatgacgccttccgactgctcgccgaaaagcgtgcggctggtccctccacccgtggccgtcgcggtgctgggcgtgctggtggcgccaaggccgttgccggcaagggcaagaagggcggtacctcggctgcggtttcggcgcaggaggccaagcgcgccgaacgccgtgccgaagtcaagaagttggcgaacaagggctggtccaaccagcgcatcgccgaaaaactcggttccacccccgccactgtgaaaaaggacgtcgactggctgaccgccaacgagggctacgagcgccccgccgtaattcccaagcgtggctgagcggaattattgctctacttgcgtttcaaggggctgatttctcgttttgagaatatctacttgcgtttcaaggggctggtcatctgctgaaccacgagtatgaacggctccgcgccaacgtcattccgccgttttggaacgttgtctacttgggcaacagcccctcgaaacggaagtagaccttcagaaaagaccaaatcagccccttgaaacggaggtagagctggtttaactgcctgttgggcgcaactctgcgcctaacgctaaggtcaatagcatgagcggtctgtttgtttcgtttgaaggtgtcgatggcgtgggcaagaccacgcaagtcgagcggctgcatgcgtatcttgaggctcaggggcgtaccgtggtcgttacccgtgagccgggaggcactgcgttaggcaaggccattcgccaactgctgttgcacggtgtggatggggcgcagtcgacatcgcaccgcgcgccgaggcgctgctattcgctgcagaccgagcccagcacgttgccgaaaccatccgcccggcattggagcgcggtgaagtggtgatcaccgaccgctatttagactcttccttggcctatcaggccggtggccgcgaactcacgccagaagagattcgatccttaagcatgtgggccaccaacaacctgctgcccgaccgcacgtatttgctggatatggacccagccctgtcccaccatcgcctcgaacacgcggaagaccgtatggaatcggccggtgatgacttccagtcccgcacccgccaggccttcttggacttggccgccgccgagccgaatcgtttccgcgttatcgatgcgagccagagcattgaagcggtatgggctgccatcgaatccgacatcaaggagctcgcatgagcgtatgggattcactagtcggccaaaagccggtaatcgacatgctcagtcgtatcgcgcagggcgacccgagccagatcacccagtcgtggctgatctgtggacctcccggatcgggccgttccaacatggcccgagcattcgcggcggcgctggaaagcccggatcacggcatgagcgctgagcccacgcgcgtcacccagcaggtgcttgccggcacgcatccggatgtcacggtgctgaccacgaacaaggtgactattggtatcgatcaggtgcgtgagatcatcactacctccgagcagatgcccgccaccgcaccgtggcgcatcatcatcatcgaagacgtggatcgcatgcttgagcgcaccaccaacgtgctcttgaaagagattgaggagccggccgagcattgcatctggctactgtgcgcgcccagcgcccaggacgtgctgcccaccatccgctcgcgcacacgcatcgtgaacctcgccgtgccctccacccaggcggtggccggattcctgacctccaccaccaatgtcgagccaaaagtggcgcagcgtgcggcccgactcgccgaaggccatatcggcatcgccaagttgtacgccaccgacgaacgggttatgtccgaccgcgatgaacttgtggtcggtgtgctgaatctggcccgtgcctcggatgcagtgttgttggccggcaatcttatcgacaatgccaaggcccaggccgaggcagacgcgaaccgcatcaccgccggtcaggaagcggaattccgccgcatcaacggactggcaccgagcgaccgcatcccgccgaaactgcgtggcgcattcaaccagattgccaagaaagacgatgtgaagcgtttggtcacccgccgtacgcgcgacgtattggatcgtgcgctgaactccatcgcctccatctaccgagatgtggcggtgctgcagaacaatgcggaggattcggtgggcctcatcaacctggagaaccgctcgtcgatcaccgaattgtcggtgcggttgaaccgggccggtgccgtgacccgtctggacgaagtggcccacgcccgcaagcgcctagccggcaacggcaacccgctactggtattcgagtccctcttctgcgccctgatcccataacccgacgcaactagcccccctctgatgagtgggggctgtcgagcgtagcgagactggggagagaccccgtaacgcacagcccccagtacgtcacacatatgagcgatactgggacgtatgaagatttccgccgatttcaccgtcatcccggacgatttcgccaaggctgcggcccctgaatatttcaatggtggcgtgcctgtggtctccttcccgttctacatcgatgatgtggatcccgaggcccgctacctgcactgggagttcgtggacccggattcgattccggtctgcggcttcgagtggattcactggtccgtggccaatctgccgattgatgcgctgatgtacgacttcaatgattcgcatgcgttggccatcccgccggacttctcccgtcagctgccggccatgattcccgagaccgtgcaggggtgcaactcctcggcctccaagttcttgggccgcagcactgacccggcggtgatcatgcggtacaacggtccgcagccgccggacaaggatcatgagtactacctgcaggtgtgggccaccaagaagccgttgcccggcttgaatcagggcttctggctcaacgagctgttgcacgcgctgcgcaacagcggtgaagtgcccgacaccgacggcatcttcctgaccggcaaggcgtgagccacatgagcccccgcaggcgggggctgtcagcatcactgactgggggtgggtcagtacaaaaccaccttcagtccgacttcgtcgtccagctcccgccagtgggagcgtgaccacaacaaagaaaggacaccatcacactatggcctgcaccacgattctggtaggtaaagacgcgagctatgacggctcgaccatcatcgcccgcaacgaggattccgcgaacggcgagttcaacccgaagcgcttcatcgtcgtgaagccggaggaacagccgcgcgaatacaagtcggtgatctcccacctaaccatcaccctgccggacgacccgctgcagtacaccgccgtgccgaacgcggacctcaaggaaggtatttggggcgaggccggcgtcaacgaggcgaacgtggcgatgagcgccaccgaaaccctgaccaccaacgagcgcgtgctcggcgccgacccgttcgtggaatacacgccggccaagggcgatgagcccgaggtgcccggcggcatcggcgaagaggacttcctgaccatcgtgctgccgtatgtcaagaccgcacgcgagggcgtccagcgcctcggcgcgctgcttgaggaattcggcacctacgagatgaatggcgtcgccttctccgactccaacgaaatctggtggctggaaactgtgggcggccatcactggattgccaagcgcgtgccggacgaggcctacgtgaccatgccgaaccagctcggtatcgacgaattcgaccttgaggacgctctgggtgaccaggaagcgcacatgtgttccgaagaccttgccgaattcatcgaaaccaaccatttggacctcgcggtggagaacactaccccgttcaacccgcgcgatgccttcggctcccactccgactccgaccacgtgtacaacaccccgcgcgcctggtacatgcagcgcttcctcaacccgtacgacgaggtgtgggacggcccggacgccgaccacaagcccacctccgacgacatcccgtgggcccgtcagcctgagcgcaaggtgaccatcgaggatatcaagtacgtgctgagctcccactaccagggcaccccgttcgatccgtacggccagctgggcgatgagcgcacccgccacatgtaccgcacgatcggcatcaaccgccagagccagctcgcggtgatgcagatccgcccgtaccgcccgcaggcctcccgcgccatccagtggatggcatacggctccaacccgttcaacacgctggtaccgttcttcccgaacgtggacaccacgcccgcctaccttgaggacaccactacccgcgtgacgtccgagaacttctactgggccaaccgcatcatcgccgccctgtgcgatggcgccttccgctccacgtccaacgccgttgagcgctaccaggagaagaccggtgcgatgggccaccgcttggtcgccgccaccgacgagcagatcgcccgtctgggcttgacggccgccgaggaagccgcgcagtccgccgctgaagaggaatttgaggccgacaacgtggatggcgatgtgcagccgatgaccccggacgagaccatcgccgcgctgcgtaaccccgaggtgcgcgagattctcgccgccgccaaccagaccatggccgaccagctcaaggaggaaaccgaaaagctgcttgactccgtgctgtacactcgcagcatggaaatgaagaacggcttccacatgtccgacttttagtccgtattgagctcccctccctgaggggctgagccgttaagaaaacagcccagtgggctgtttttaggcgaagaggcggcgactgccgccccaccaccccgccccatcacacaaacacagaaaggctttatatgaccaccatcgaagacttcaccagccagtacggtctggtccagaagatcgacgcattcggctacatgaagtacctggccgagaaccctgacgccccgcgcaagcacggcaaggtggtgctcgtcaccgccgatacgccgctcaaggcatcgcgcggagaaggcaagaccaccacgaccatcgccctgatcgacgctctgaacaagcgcggcattgatgcgaccgccgtgctgcgtcagccgagcatgggcatcaccgcagccggttccaagggcggtgcctccggcggcggcaaggcttccctgacccaccccgagctcatcgactggggtctgtgcggcgaaatgggcgccatcgaggcggcccagaacctgctcgtctccttcgccgagaaggccatcgatgacggcaagctcgacacgattctcgtgccgcgtgtctccgaggttccgagtcgctccctgcgctccaccgctgtggactacggcaagggcaacgtgccggagaaggtcgtgctcacgccgacctgcgagctcatgcagattgtggtgctctcccgctcgatggacgagatttccgagcgcgtgtccaagatgatcgccggcaccaaggacggcaaggccgtgaccttcggcgaattcgtggacctgtggcgtatcactggcattttggccgacgcggtcaagccggccaagaccgaaaccgtgaacggatcaccggtctacgtgcacggtggcccgttcgccaacgtgtccatcggcattccgacgttggtctccgtggaaatggcctgcgccctgcatgacgtggtcatcgtcgaggccggctacggcaccgacgccggcgcccagaagtggctggacatcgcctgccgcgaatacggcgcgcagtggccgtccgccgccatcgtggtgacccgtgcctccacctggcgcgacgatcccgagctggcctggcgctacccgttccacgtgcagcgcctggagaacctggacattccgaccttcccgctcatcaacctgtgggaaggcgaggacgatcaggttccgtccctgaaggccaccgccgacgagctgggcttccgcacgccgatcatcggcaacctgttccgcgacggcggcgaggcgctggccccgcagcttgacggtttcgtcgacgcgttgcagaacggctccatgccggccgaaccgtactcgcacaagggcatggccctgaccgagaacgccaagtgggtggccgagaacgcctacggcgtaccggccgagcgcgtgatttacaaaccgggcttcaccgagtccgtgtccgaggccatggaactgtgccagagcgcaggcatctcgctggacgatctggcgttcgtggcggtcaagtccccggcgaccatgaccgacaacgaccgtgccccgaagaagagcgcaccgtgaccctgaagaaggtcgaggtgcatgccggtgccggtctggtccacgtcaacctgaccaccagcctcaccaccccatgcccaagatcgtgtgatgacaggcacaaggtgaggtaactcgctttcgaggggcggatttccggttttccggaggtctatctgcgtttcgaggggctcttcgattgcgaaacccggagtatgaccattgaaattgcaatgtttatactccgggtttcttgttttaaaagccccttgaaacgctagtagagcttctgaatgttggaaatcagccccttgaaacgtagaaagcccgccgccggcgggctttctacatctgagcttccctctttgaggggagctgccagcgaagctgactgaggggagccagaatacgcaaactagaagttgctaccattccagccccagtcggtggtggcggtgtaacggatgtaggtgcggtcctcgggaatgccgagcgtggagttcagcgcggccataatgctctcggtcagcttttcccaagcagagcccggcacagagcggccgaacacgttgacttccacataggcggcgggctggtcatcgctaccaccgaagtaaatcggcatattgtcctcgaacgggcacattagccagccctcggacttgcccggcacggcggtaatcgccttgccataggcagccttcaacgcctcgcgctgctcaggggtggtgggcacggacacatgagtgtgaataacgggcataattcctccttgattcggttcgcttccagtctagcctcagcggttgctgttgaacatggcatgcggatgtaggaagctgcttgcagaacggaccggggcaaggccaatttggggagattattggcctttccagccaatatatgttccgcagtcagcccaatagtgttgaatacccttgtgagaaaactgattgaacaactgatgaagttcggcattgtgggcgtcatcgcctttgttatcgactggggtattctcaacctattggttggcatattccacatgcacaacgtgctggctgccaccgtctctttcatcatctcgctgattttcaactatctggcgagcatgaaattcgtattcaagcatcgtgatgacatggcgcgctggatggagattcttatcttcgtggcgggcgctgtagtcggtctgttcatgaatgacgcgattatctggatttccacttatggcatgaaccatgatgcctatgtatcgcagcatgccgaatatctgttgcgcaccaatatcggcaagttggtggccactgccgtggtaatgatctggaacttcttgattcgcaagtggctgctcgacgatacgcacaccaatgcgatgaaccgtctgaagtccgctgaaaatcgactgaatgccgaggagcttgaagccaagtggcagaacagcttctcccacaagctcggcatctggtccctggaacacacgcccaaaggctggccgaagtagcgttttgacgtataagccccctcgtcagagggggcttagcttttgtctcacacactcacttcagtcaaggtcggctgctcggtggagcccttgatctgcttgaagccaatcagcgcaatcaccagcgagaccagtgccaaagtggtcaccaccatgaagccgccatgcgagcccatgcggtcgatgaactggccggcaatcgccgaaccggcggaggagccgatagaattcatcgcacccatccacgccatgccttcggtcaggcgggaaggcggcaccaagtgcagcatgagctggttgccgttaatccacgtcggagcctggcacacgccgatgatcaggtagatgatcataatcacccacagatgcttggcgaacaggaacgtgctgatgccgatgttcaccacggccaggcagaagtagaagcgcttccacagggcaatcgaccagttcttcgcgccgtacaccaaggcgcccatcaacgagctgatggagaagcaggcgaatacaaagcccgtgtactgcttcatattcgactcggtggcgaatgcgatgatcgagatgcctgtagccgactggaacgcgcccaagccgaaccaggtgacgcataccgcaatcagacccggtccccagatggacgccttcttgccggaacgcgcatcggcgaccgcctgctcaatggcggcgttaatcgtggcctcatcggtcacgccttcgcgctcaagacggcggcgagtctcctcggctgcggtctccaccttcaacgcttcggctcgagccgcctcgcgctcacggtattccttgcgggaaatgccctcagcgcgggccagctgagtctgtgacggtggctcagtggtcagctcggtcaagaacatcagcgcgcccaccaccacgcacatgccggtgaacgagaatgccagcagaccggagatcacggccagtgtggaagccagtggattgccgattacccacatgcattcgtccagcacgccgcacagggagagcgcacggttggtacgctcctgatcgcccttcaggattttggtccagcgcgcgcggctcatcgcgccccacggcggaatagctgccaggaacggcgtcaaacagtacagcacccattccggcgcacgattggtgatggatgtggtcagcgcgacggcggcgacaatccacaccagaatcgttggaatcgaaacctgccgctggccgaacttgtcggtcagcttgccgagcagcggcgtggccacggccagtgcaatcgcctgaatggcggtgagcatacctgccagcgagtagttgccgtagtaatgctgcacggaaatggtgatggtcatgcccaccatcgggaacggcatgcaggcaatcaccgaaccgatggaataacgagcggtatgaggtatgcgcagcaactccgcatacccaccaaaaactttgtgacccacttccttgatgccagccataatggtgttcgagttggacaggttgttggacataacagcactacgctcctttccgctcccgattggatgttccccgctgacgtggcgttgccggcgaagccctcatcgaatgatgtgttgtccatggtcgcgcaaagtttgcgttggatttccctattcgcatatttgcgtcacggatactctaatcgttggttagggcgcgacacgcggtagattggagatattaagacaacgttctcatgttcttcggcgaacatcgcaagatgcccgtaggaataaaaagaaaggcggctcatgagcgcaaccaccatccacttcgttcgccacggcaaggtctacaaccctgaccatctgctctatgagcggctgcccgacttccatctctccgatcttggccggcgtatggcacaggccaccgccgcctatctggccaatagccctcagaccaatacgatttccgcggtgtattcgtctcccctggaccgcacgcgcgagaccgccgacgcgattcttgacgcgttgaatcccgtgcgcgaggcccgaggcgaagccccgctcatgctcaccgccgatgagcgagtgattgaggccggcaacgagttccgcggcaagcgtatcggccatggcgaaggcgcgttgtggaagaacggcaattggaaactggtcaccaacctgtacaagccgagttggggcgaatcctatcagcacattgcgcagcgcatggatgatttcgcacgcgagaaggtcgcccaacaccccggcgaacagattgtggtggtcagccacgaatcgccgattttcagttatcgccattatctggagaccggccaccccgagcactggatgttcctgcggcacacggcgctcgcctccgtgacctcggtgacgtacgacaacgaaaccggccgtgtgatgtcaatcacgtatgtcgacccagcagccaacgtcaagtaacggcacactggtgaatagctgagctacaatctgggctcccctcagagggagccaatgggacgcactacaatcaagtggtgaacgcagaggagcatgaatgaccattgaactcaatcgtgaggcaatcgcacggatcgcggcattgccgggggtagctgaggccgctgaagccggctcggcgctaattagcctgtggccgctgaccgaagccatgcagatggacaatgacgccaagtatgcggagaacctgcaggtgcgtgtcacgcacgcgttcgcacgcattctcaccggtcaggatgttacgatgcctgacgccgaattcgtctacgagggggccgatgagattcctggccgtccgcaaagcatcgtagacacgctgcttgctgccaatgacgcctacgatacgatggccggttactcggaatccggcgatgtgcagctgattttcgatgccgccgaagctttaggtgttgactgggattcgcatgtcgaggccgcagtccgtgagacggttgtctccgtggaggctcaggttgaggccgatgccgaggctggcggacgtttggcggcttccggcgagccggctgatgtggccgtccgtttcgccaccgcgctcgccgtatgcgatgcgctgctgaacgtggtgagcgggcatgccgagacggttggcttggttggtccggctgttgctgatgccgctgatgttgctgacgaggcccgggccaccgccatcgtaacgttgccgattctgctgtacgtcaacgaattacgtgagcagtgctcgattccgcgcatctgcctgaccgaccagcagattcttgatctgattgatacgcgtgccaatgccggtgacaccctgaccgccaccgccgaatacattgccccgctggccggtgccgaatggaccaagcaccgcgacgatgtgctctggaacccggacgaagccaagaagaaggccaaggaagaagacgaaaagcgcaacaaggaggccttggccgccaagtttgcgcacattaaagatgaccctggcaaagaaaccgtggagttgtgagaatcaaggcagcttagcccgcctgatcggttctcttacccctgctcgcgattcctccgtgccaaggaaatcgtctatgtggtgaagaacatcgcttacgcaacggaagaagaaacacttatgggcaatggcgtcaatctgcgcacgctcaccaatgacggcggtagcgcggtaatcagcgattacggggcgcatctgctgcgctgggccccggcggggcagccggatgtaatctggacgccccgcacatggcatttcgaagctggtcagccggttggcgggggagtgccggtgtgcttcccctggttcgggccggggtttgtgcatggcgggcagactgcgaagcgaccgattcatgggttcgcacgattgcgccagtgggcgctggacgaaggggcgtttaccggtgcccgtgtgcggtatgtgctggattccgaacgactgacgactggcgaagtgccatggatcgaggatgaacccaacgtgcgtttccatgccgcatacgaggtgtgtgccagcgatacgctgacgatgacgctgaccgttaccaacacgggaggtgagccgatgtcgtatgaggcggcgctgcactcgtatctgcatgtcggcgatgtgctcggcgcgcggctggtcggtttgcggggtgcaacatatctggatgccacggaagccggattcccgccaaaactacaagaacagccatcggtgatgttcggcgatcagccggtggaccgtgtgtattattccgatgctgcactggaattgcaggaccatgtgctgggtcgtgtgattcgcatcggcaagaccggctcgccgcagacggtggtgtggaatcccggagagcagggcggcaacgccattgcccatgccaagacgggtgaatggcgtggctttgtggccgtggaggcagcggcgtgccgagaccgtatcgttgcccttagtccgggtgaatcgtatatgctttcgcagtccattgccgtgatgccgttggggtagttggctgaatacagtgccgataatacagtgccgagaatgatgaagccctactcgcgttgagtagggcttcatcattggttgcggggaacttcttcaacggaagttcaccgatatcggttactggccttgccagggtttctgggcattgtcgccggcgggagccgtgtgctcagaaggtgttgcggattcgtcgccggcgttttgaggcatcggcggaacctggccgtactgtggggccggggcctccggttggccgtactgcggggccggcacctgaccgtaatcaggtgcgggtgcagccggctggccatagtcgggggtcggcatgggcggctggccgtaagccggggccggctggttgaagccgggtgcgggcgcgttcggagcggcgaaattcgggggtacaggcgtgctgtatggtgcgccgtaagcaccctgaggcatgggggttgccgccgcgccatcgtcaaaacgtgcgccctccggcttgctgggaagagccatgaacacgatatagacaacgcagccggccagcgtaatcaacgcaccaatgaccgccgcgccaagaccgccggcggccatgctgccataaccatagtcataactgccaaggctcctgaacccgccgtacagtgccgcaccaccgccgataatcatgatgataaggccgataaccatcgcgatatagaaaatggcaacccaccagccaggcttgttcgtgtcatgcagacggcggacggaaagtgccagggtggggattagggtcgccagaccccaaatggtggcgaggaagccaagcttttcatctgtggcggtgttgaggatgtccagcacgatattgatgccgaaagcggccagcacccaccaccagaattcactgcgggacgcgcggcccctgaacaccacgtacttcttccagaagcgcaggaaggcttcttggaaggagcatccgtagtaaggcttatccagcggcacagtggcagtgggcgcggcgtattggccgtaagacggcggaaccgggccgtaaggattgccatcgggggccggtgtgccgtacgccggtgcggattgaccgtaggtgttggcgtcgggtgcgggctgaccgtaggttggtacggcctggccataagagttcgcggtcggagcaggctgaccgtatgccggctgtccgtaagcgggctgcgccggctgtgagggctgcgccggggccggtgcgccatactgcggtacgggattaggtgtgggcgtaccgttggcctcaggctgctgaggcaaaggcacattgttgggatcagacattgattcccctttcataagacctatgtgtcacatcatattcttccattgcatgagtggaaaactcaacaattgcgccaaataatgtccaaagttgtggtgaatgcactggaaagaatcgatggttatcaaatcgatatcagttgagggtgaacgttgtcgatcggttgtgtaacctgttacatgaatattgcgcacagttgcgggggtggaactggaaagcagacgaagcttttggcgctacgcataaagcaacatacagagatgtagggaatgccatgaaccacgaatacacggatgccgccgttgagcagcgcgaatcgcacgaagacgaatctcaagactgggatctgctgttcgtgggcctggcctgctgattctcgtttgctgttttcttttcttttgattttaaaagcaaaagaaaagaaaatggcaggcaaaagagatttcgttggaaaatggccgttttgggatggtgttggcccgaaacgtcaataacgaagcaaaagagcgaggagcgctgctctccgcgtccggcgcgcgcggcacaataggggactatgactgatgctgaaaacaccaaacccgaactgcccaagaacgttcgtgttcgcttctgcccgtcgccgaccggaaccccgcatgtcggcatgattcgtaccgccctgttcaactgggcggaagctcgcgccaccggcggcacgctgatcttccgtatcgaagacaccgacgccgtgcgcgactccgaagaaagctacaaccagatcctcgaatccctgcgttggctgggtatcgactgggacgagggcatcgatgtgggtggccctcacggcccgtaccgccagtccgagcgtaccgccatctacaaggatgttgccgccaagctgctcgaagccggctacgcctacgagtccttctccactcctgaggaaatcaaggagcgcaaccttgccgccggccgtccggccgagttcggctacgatggctacgaccgcaacctgaccgatgaacagaaggccgccttccgcgccgagggccgcaagcctgcgctacgtatcaagatgcctgatgaagacatcgcctttgacgatctgattcgtggcaccatcgagttcaaggccggctccgtgccggactacgtgatcgtgcgcccgaacggcgacccactgtacacgctgaccaacccggtcgacgacgcgatgatggaagtcaacgtcgtgctgcgcggcgaggacctcctgagctccaccccgcgccagatcgtgctttaccgttaccttatggaactcggcatcgccaaggagatgccgctgttcggccacatgccgtacgtgatgggccagggcaacaagaagctctccaagcgcgacccagagtccaacctgttcaaccaccgcgacaatggcttcatccgcgagggcctgctcaactacctggccctgctcggctggtccattgcaccggaccgcgacgtgttctccatggacgagatgaccgagaagttcgacgtgcgcgacgtcaaggccaacccggcccgcttcgacatcgacaaggccatctccatcaacgccgagcacatccgtatgcttgagcccgaggacttcctgcgccgctcggtgccgtacctgcaccgcgacggtgtggtttccgccgacaactgggatgccctgaccgaccgtgagcgtgaggtgctgaccgccgccgctccgctggttcagccgcgcgtgcgcctgctgggtgaggttgccggcatggtcggctccctgctctccaccgagggctacttggagccggctgacgacgccaagaagcagctgaaggattctgccggcgaggtgctggacaaggccatcgccgcactcgaggctgtggatgaggctgactggaagaccgacaacctgcatgagaccctgaacaaggctctggttgaggagggcggctacaagccgcgcctcgctttcggtccggtgcgtgtggccatgtctggtcgtcgcgtgagcccgccgctgttcgagtccatggagatcgtcggcaagccggtttccctcgctcgcctgaagggcctgcgcgagcacctgtgagctaaggttccttccgtgctcggctgagctgtaaggacactcaaggtgggcgtctgcatgtgcagatgcccaccttttcttgtattcagtgatgagctggaacagctggaaagtcttaccgctgcgccgcatgccagtgagaatatgtacgaggttgaacatggctggtttgtgcagtgaggtcacgaaacgtgccttgtaggtggtttcgccttcatgcgtccatgaaacggttgataggtaaccgggcggcggtctttgacgtgacattgcattacaagcatcgcgacgcgctcgctgtcgcaagggaacataagcgcctcatttggttcttgaaggctgatttgccggctatgaatgtgcaaggcaaagatcattgcctcatctgcaatttcatcagtgcattagatggtaattcatcagtagtgcttactgataatccgtcagtagagttcatgcaaattcatcagtagtggcagcgtagcacttgaaatcgttgaaattccgcgcgacacgccgtaagttgcgtaagggtgaatacttgcgtatatttatcactcgttgcgcggttcaccgagcagccggttgaaaaactgaatatgcccccatcgtctagcggtctaggactacgccctctcacggcgccaacaccggttcaaatccggttgggggtacgacgaacaactccttggagttgctacgccaagccaaattgggatgtggtgtaattggcaacacagctgattctggttcagccattcttggttcgagtccaggcatcccagccaatgaccctcgcggaatgcgagggttttttgttttcagggaagtagccgcttgaaaagcgacttccctgcatatgagtgcgcataagagcgctaagagcgcatacgtgtgtatgaaagtacgagaacgaaggagatcgaagtatgtccgctgggcagcaggctgtaccggcaaacaacgccaacaatgcaagcaatgaaggcgctcagaagaagcacatgtctaaggcggccgtcgccattatcgccgtggtggtcgtggccattatcgtcgtggccggtgtgttcggcttccgcgcctactccgatgctcagtacaacaatgcagtcgccgcttgcgccgccgcttccgaaaatgtgcgcaacgccactaatgactacaacaacttggtcaatggcgatgcttccgaagctgctgcgctcaccaagaaggatgtaaaggatgcctccacgctggacgccctcaacaaggaactgagcgtggaactgccggtatacgaaggctgcgtagctgacgacactgccggcttcaagtccgctactgcgaagctcaacgagcaggctgattggtacaaggcttatactcaatcgctgcagaaggctgtggatgccgtgaacgcttccaagaagtaagcgagcacagcctcaccattgtcgtcaaagccgtcttgcggttgcgcaaggcggcttttgctattttgctcaatcggcttgctgctgtaatgctgctgcattgattgcgtcgaatgcaggtaaattcgtcttactttttttgcgcagtttttccctgcgcgtgtcgcgatgatgcgaatatagatgtgaaggttaacaacgtagtcgtttattgggttttgtgatttcactcacgttgtaattcaatgtcaaatatgtggcgattctccgtatttgctgagattgctattaagaatagcttcttgtaaagtgtcttatcgtaattgcgaatgcgtattcttcaatgaagaaggcatctgcttcacctcgaagaagagattaaggaaaatatagttaatgaaaaagaagaagactatatcggctgcgctggcaacagcgttagccttaacctgcatgggcagcgggggaggtactgcgttcgcagtgcccctgtctgatgctgacttgcagactttggcaagtcagattcagcaaatcaacgatacttctgattctgcaactgcttccgagactccttccgcacaagccgatgcggttgaaggctggactattgattccaacatcgctcagggcggcgaaatcctggagatggcaaacggttggctgcacctcaagtccactgcctctaacggtaatgcggcagcgaaccccagctccagcaacaactggccggcagtagccgtatggggcacagattacgacttctccaaggccggctccttccacgccaccatcaaatccccgcaggaaggctccgccaaccgcttcggcttctacctgggctacaacgacccgggcagcggcctgttcatcggctacgattcgggcggctggttctggcagacctacaccggtggcggtagcggcagctggtacagcggtgctcgtatcgctgctccgagcgccaacgaagagcacgacattcgggtctcctggaccgacgccaaggtcgccacactgaccgtggatggccagaaggcattcgatgtcgattactccgcaatgacgaacctctccaacaagcttgccatcaaggccggctcctggaaggagctgaacgaggtcaccgacgtgtacatcaaggacttcccggaggttgtcgaagccgccaagcacgcggtttccggcaaggttgtggacgctggaggcgctgccattgaaggcgcaacagtgcgtttggataagaccaaggtgaagaccggtgcagatggcaccttctccttcgccgacattgaagaaggcgaacacacgctttcgattgccaaggaaggctatgaggacgtctcccagcaggtgacggtctccggcgcggatcttgccatcgatcccatcaccctgaacaaaaccgttcaggtcgcctccgaaacgctgaagaccaagaagatggaagttcagattaagaagaacttcccctctgtgctgcagtacacgatgaccgacggcaaggtgatgtacggccagtccaaggatgtgcgcaccgttgaaatcaacggcaccaacatcgaactgggcgatgacgacgtgaccttcaagaaggtttccgacaccgaggccacctacacgctgaaggtcaaggatgaggccaagaagattgacgcggtgatcaccgttcagatcacggtcaaggccaaccagctgcacctcaacgtcaccaagatcaagaacaacctgtccgaaggcattcctgagggcaacggtgtggaggagaacgccatccagacgctgtccttcccgaaccagagtctcgtttccgtgcgttccagccaggaaaatgcccaattcactggtgctcgtatgtcttccaacacgcagaagcctggcgataccaacttcgcagtgaccgaagatactaacgtcaccgatagcgactacacctacggcttcatctccggtgctggcctgagtgccggcctgtggagcaactccgagcacgatggcacctatgtggcggctcctgtgcgcggcggcagccagaacacgcgtgtctacgccaccacccagcagactggtgacgccacctccctgggcctggccagcgctccgtggtactaccaccgcacggtcaccgattccaagggcaagaagtacaccgtggccgaaaccgctctgccgcagatggccgtggccatcgccggcgacgagaacgaagacggtgccgtcaactggcaggatggcgcaatcgcctaccgcgacatcatgaacaacccgtacaagtccgaggaagttcccgaactggtggcatggcgtatcgccatgaacttcggctcccaggcgcagaacccgttcctcaccacgcttgacaacgtcaagaaggtggccttgaacaccgacggcctcggccagtccgtgctgctcaagggctacggcaatgaaggccacgactccggccacccggactacggcgatatcggccagcgtctcggcggcgccgacgacatgaacaccatgatggaagagggctccaagtatggcgctcgcttcggtgtgcacgtcaacgcctccgaaatgtatccggaagccaaggccttcagcgaggacatggtgcgccgcaactctgcaggcggcctgagctacggctggaactggcttgatcagggtgtcggcatcgacggcatctacgatctggcatccggttctcgtgtaagccgtttcgctgacctcagcaaggaagtcggcgacaacatggacttcatctacctcgatgtgtggggcaacctgacttcttccggttcggaagattcttgggaaacccgcaagatgagcaagatgatcaacgacaacggctggcgtatgaccaccgaatggggttccggcaacgagtacgactccaccttccagcactgggcagctgatctgacctacggcggctacacctccaagggcgagaactccgaagtgatgcgcttcctgcgcaaccaccagaaggacagctgggttggcgactacccgcaatacggcggcgctgccaacgccccgctgctcggcggctacaacatgaaggacttcgaaggctggcagggccgcaacgactatgccgcctacatcaagaacctgtacacccatgatgtgtccactaagttcatccagcacttcaaggtgacccgctgggtcaacaacccgctgctgaccgccgacaatggcaatgccgctgccgtgtccgacccgaacacgaacaacggcaacgagcagattaccctgaaggattccaacggcaacgttgtagtagtctcccgtggttccaacgacacctctagcgcagcctaccgccagcgcaccatcaccttcaacggcgtgaaggtcgcatccggtgtggtctccgcaggcgatggcagcgccactggcgacgagtcctacctgctgccgtggatgtgggattccttcaccggcaagctggtcaaggattccgagcagaagctctaccactggaacaccaagggcggcaccaccacctggacgctgccggacagctggaagaacctctccagcgtaaaggtgtaccagctcaccgatcagggcaagaccaacgagcagaccgttgccgtctccggcggcaaggtgacgcttaccgctgatgccgaaaccccgtacgtggtgtacaagggcgaagccaagcagatccaggtcaactggagcgaaggcatgcatgtggtagacgccggcttcaacggcggctccaacaccctcaccgacaactggaccgtcagcggctccggcaaggccgaagttgaaggcgacaacaacgccatgctgcgcctgaccggcaaggtcgatgtctcccagcgtctgaccgatctcaaggctggccagaagtacgcgctgtatgttggcgtcgacaaccgctccaccggcgatgcatccgtcaccgtaaccagcggcggcaaggtgctggccaccaactccaccggcaagtccatcgccaagaactacatcaaggcatacggccacaacacgaacagcaatacggaaaatggctccagctacttccagaacatgtacgtgttcttcaccgcgcctgagaacggcgatgccacggtaaccctgtctcacaagagcaccgacggagcacacacctacttcgacgatgtgcgcatcgtggagaaccagtactccggcatcacctatgagaaggacggcacgctgaagtccctcaccaacggattcgaaaacaacgcccagggcatctggccgttcgtggtctccggttccgaaggcgttgaggacaaccgcatccacctctccgagctgcatgctccgttcacgcaggccggttgggatgtcaagaagatggacgatgtgctcgatggcacttggtctgtgaaggttaacggcctgacccagaagggcacgctggtctaccagacgatcccgcagaacgtgaagttcgaggcgggtgccaagtacaaggtgagcttcgactaccagtccggttccgatgacatctacgccatcgctgtgggccagggtgaatactctgccggcagcgtgaagctgaccaacctgaagaaggctctgggtgagaccggcaaggccgagttcgagctgaccggtggcgtcaacggcgattcctggttcggtatttactcgaccgcaaccgcacctgatctgcagggttccaccggcaatgcacaggacttcggcggatacaaggacttcgtgctcgacaacctgaagatcgagcgcatcgagtcccagacccgcaccaaggccgaagcgcaggacaaggtcaaggaaatccgcggcaagtacgattccaagcgtgctgagctctccgatgccgcatggcagcagtatcaggacaccttggtcaaggctcgcgtgctcatcaacaagaatggcgcaaccgctgaggacttcaccaaggcatacgacattctcgtggccctcgacgagtacatgaagaccgctcccggcaacgagagcagcgacaagtacgacgtggcagctgacggctccgatgagctgggtggctacaccgtggccacgggcagcgaagagcctaccgcaggcctgccgagcgaaggcccggccgatctggcacaggatggcaacgacagcacccactggcacaccagctggagcgagaacgcagtcggcaacggcaccgcatggtatcagttcaacctcaacgaaccgaccaccatcaacggcctgcgctacctgccgcgctccggaggtatgaacgccaacggcaagatcaagggctacaagatcacgctcactctggcggatggcaccaccaaggatgtcgtcaccgatgctgagttctccaccaccaccatgtggcagaaggccagcttcgacgccgtcgagaatgtgaccgccgtacgcttgaccgtcctgtcttccgcaggccagagcgactcccaggccaacaagttcgcatccgctgccgaactgcgtttgaccacggaccgcgaggttgaggaagagactgtcgctccggacaagaccgacctcaacgacaccatcgccaaggctaacggtcttaaggaatccgactacacggctgaaagctggactgctctggtcaaggcccgcgaagctgcacaggccgtggcggataacgataaggccaccgcttacgatgtggctctggcgctgacgaacctcgaatccgctatcgctggtctcgagaagaccggtgaggagcctggcccaggcccggttgaggtgaacaagaccgacctgcagactgcagtgaacaaggcaagcaagctcgagaaggccgattacacgaccaactcgtgggaagctttcgccgaggcactgaaggctgcacagcaggtgctcgacaacaagaacgccacccagcaggatgtggataccgcactgagcgctcttcaggacgccatctccaagctggaagctgccaccgagccgaagccgaatccggaaccgggcgtggtggacaaggctgctctgaacgcgaccatcaacaaggccgccgccatcaacctgggtctctacaccgacgactccgccaacgctctgcgcgccgcgctgaagaaggcccgtgaggtctccgacaacagcaacgccacgcagaagcaggtcgacgcagctcgtgaagccctggagaaggcaattgccgctctggtgaagcgtcccgctgccaagggtgatggcaacgttgtttccaacacgggctccgatgtcgccacgatcgctctggctggactgctgctggcaggtgctggcgccgccatcgcctaccgtcgcaatcgcgagcaactgtgaaagcgaggttatagcctaagcagtaataaataaggaataatccttatcctctcggccggcgccgggcagcaatgcctagcgccggccgctttcgtatgtatcagtgttctccagtcacccggcagacatcggaatacgcacgcgatgtcgctgctaggcgatgaatcgcaaatatgtgcggtcatcgaatgattcgtaattcgcagtgaatcctttggtggattggtactcgctgacgagttccggatcgtcgcgcttgagtcgctgcagttcagcctcactggccgcaagcatagggcgcaacagttcgccatgaattcaccctcggttcgttgggtgagcatgccccggttacatgctgacgttatatctgactgtaataccgatgaggctaggaaaaggaacgattatgcagtctgacaacaaccatcatgaatcgcatcacaacgatatgagctacagcaacgactaccaatacgatgtttatatgtatgccgagtatggcatcgagtggtgattgcaggcaaacacgaataaagagagccccgagtgagaattggtgaaccgcaccccgattgttggactgaagtaattcagattcgatgatcggaggtgcggtttctcatgtgtagggatcgcaggcgtcattacgatgacggtttcatgcgggtcgtcgccgacctgatccggggcggggccgggaggcgttctctcgcccgccggcttggcgcgcccgtcagtaccgcgggaaaatgggtgttgtcataccggtttggcggggaggcggcgctcatgggagaacgcgaaggcaacaggagatacgactacgagacgaagctcgcggcggtgcgcgaccatgtggagcatgggctgacgaaggccgaagtcatggagaagtacaggatcgcgggtcccgccccgttggagcgctggtgccgcgagtaccggtccggcggcccggacgcgctgcgtccgaaaccgaagggcaggcccaggggcgcgaaatccaagccgaggccggctcccacaagggaacagctccttgaggaggagaacgcgtacctcaaggcgagggtcgcgtacctggaaaaagtcgacgccctgctggcgtggagatcggcaaccgggacagaacggtgatcgtctccatgctggcggggccgggacatcggctccggcacctgctcagggcggccggactggcgaaaagcacgtattaccatcttctgtcgcatccggccgccgtgacccggccggacatcgagccgatggtcgccgagatattcgcgcgcacgcccaacgggtgcggccaccggcagatacgcatgtgcctcgtgcacgagttcggggtgcgggtgagccacaagagcgtgctgaaggtcatgaggcgcatgggcctggaatgccggatacgcaggccgaacccgtaccggaaatacagctcgtaccgggacgagacgggcgcgagggtggagaacctgctgaaccgcgacttcacggccgaccggccgtgggtgaagctgggcacggacgtcaccgagttcagggtcgccgacggcaaggcgtatccggctcccgtatgcgacatgggatccaaggagatcgtggcctgggacgtcagccggcatcccgacatggcccagcagtggcgcctgctcgccatgctcgaggagaagctgcccgaagacgccgacccgatcccgcactccgacatgggctgacagtaccggcaccggtggtggcgcgaccggctcgcgggactgaacatccgccagtccatgagcaggaaggacaactgcatcgacaacgccgcgaccgagcaggtgttcggccacctcaaggacgagttccacgccggacgcgagttcgcctcatacgaacagttcaagaacgaactggacgcgtacatcatccactggaacaccaaacgccgccagatacgactggagggacacaccccggaggaattccggaacatgtcccccacagcctaatcaggtacccttaataaaccacgtccaacaatcggggcgcagttcagaattggactcacgacctcttccttaccaaggaagtgctctaccactgagctatcggggcatgctgcgttatggcaatctgaatatcatggcatggctttgcgtatcgcgcaagtccgactcgcctttgcgattctcgcgcgcaagtatgtgaggcgaagcgtaactcatcgttgtgcgccgtttcgaggtgacggcacagactccttgttgtctcgattgatgtcggcgatgacggagcggagttcggtaagaaatgcgtcggctgccggagttggcggctggctcttcttccaagcgatggccagatgggtttgcatgggcgggtcgagcggctggaacacaagccccgactcccacgacgtatccacgagaccttgcaggcagatcgcacaaccgtagccttcctgcacgaagcagctggcgttatacaacaggttcatcgtgccgacaatattgagttctttgttgcctgatttgtaccagccggaaagatcacggcgattgagcacgccttggggacgatgaccggcacatccgcgagatccttgggatgaatggattcgcgcgtggcgagcgggtggtcgtacctcatgagcaggcccatcggatctcctgttggcagtggcaggaaatcataacggctcatgtcggtgggttgcacaagcacaccgaagtcggccaggccattgtcaagccgttcaatgatattctgcccatagtcgtcgtgcagccgcacgcggacttgcggatgcttgtgccgcagtcgtgtcatggctcgtgccacgatgcgcatcgctgcgctttgtgccgccgcgatatgtacatcgccggcgatgtcttcgtcggcggtcatctctttttgcgtgcgatcggcgagctcgacgatctcctgcgctcggcggtacatcaagcggcccttctcagtaagttcgagcgagtgggaccggttgccgcgaacgaacaatgttgcgccgacctcgtcttccaaatctttgatttgccgggagagcgctggctgactgatgcgcagcgcatctgccgcagcgctcacgccttcctcctcgaccacggcaatgaagttacgtaggattcgtagttccatgtgtgcctccccgcttattttatatccgatattgcatgtattcatgttctacttttgcatttgtaatactgtttggctgactttactgttgaggcaacagatgcgggcgcgacggtgaatgaagaatcacagggtggctttgagtagctttcgcccgctgctatccaatgatttcagcgaaagaacaacgataatgctcagcaataacgcggtagtggtgtacttctctcgtactggagagaattactcagtcggtgagatcgaagtcggtaatacagccaaagtcgcgcaggtgattgcctcgcgaattggggcgccgaccgtcgagattgtgccagtcgaaccctatccgaatgtgtatgacgaagccgtggcgcaggctacgcaagagcgttctgcgggagctcggccggcgttcacgctggtcgccggcgatggggcggataatcctgcggcgatgcttgactcggctgagactatttacctcggctacccaatttggtggtcggatatgccgatgcccgtttacacattcctggaaagccgcgattggagcggtaaaaccattgctccattctgcacgcatgagggcagtggtctggccgataccgtggcgtcgattcgtcgggttgtagtcggcgcaactgttctcgatggcatggaattgcgcggtgccgtcgcgcagaacgatgttgatgccaccgtgcgagccgtcgatggatggctcggatagcgatggcgaggtttgttgtcaatccggtgacgcattcaagcgtcattgcggtctcagtagtgggacgcaactgcaatgcggcttgatttgcatttgcgtcccacgttgttgcgtcccgcaagcgcaaaatcgacctttttgcagttgcgggacagtgtggattgttggaattccgccattcttgtgatgaggtgctgggagggctgtgggacgcaactgcaaattgagccatatcgcagttgcgtcccactcttatgcggggttctcgattgcgcttaaccgcattgagcggcgtatcaagcggcgagcttggccttgtagtcttcgccccagttccatagagcgtcgatgacggttttgaggctatggccagtgtcggtcagagagtattcgacgcgcggcggcacttcggggtaaacctcgcgatgcacaagtccgtcggcttccatctgtcgcaggttcgaggtgagcaccttctgcgagatgtgcccgattgagcgacgtagttcactgaagcgcttggtaccggtcagcaggtcgcgcacgatgagaattttccatttgtcggaaatcagtgtgagcgtcgtctccacgggacacgccgggagcgtgttgacatcgatcatagcatcacctcgtgtaatcgttggaatcatgcaatagttccttttaggtgactatagcactttaaagtaccttcttcccaaaaagtaagtactccaatatcgtactgtttcaacggcggaagcaccaggttccgccgttgaaatcaattaggcacagcgtgtaacaagcgcaatggattactacataggagcccatcatgacccagaacatcgcagttatcgcagccaacggcaagtccggccagctcattgtcagggaggccgttgatcgcggacttgacgtgaccgctgttgtgcgcggggagaacaaaaccgtcgcccagcacgccatcatcaaggatctgttcgacctgaccgcagcagatctcgccggattcgatgtggtcgtcgacgcattcggcgcatggacgccggaaaccttcccgcagcactccacgtcgttgaagcatctcgcggacgtcctctccagtgctgacgcgcgactgatcgtggttggaggtgccggtagcctgtacgtcaacccggagcataccgtgcagctgagccaaaccgatggcttcccggaggcgttcctcccgctcgccaccgcgatggggattctctcgccgagctgcgcgaacgtagcgacgtgcgttggacctatgtctctccggccgccgacttccaggccgacgggccgcgcaccggcaagtatgtgctggccggtgaggagttcaccgcgaacgaggccggtgaaagcgccattagctacgccgattatgcgattgcgatcgtggacgaagcgacggcggcaccggagaatgcgcacgtcaacgagcgtatttccgtgcgttggtaagcgcgtatatgcgggaagatatgtggaaagcgctcgccgaataagcagcaccccgaaatcaaaacgatttcggggtgcttgtgcgtgtgggcaagatcccaaccttcatggcgactcaggcctgctgccgcttgggttttcggactatcgcgcgctcgccgtgtcgtctcggttgccgcgtccgcggcgtgtcgtgatggggcttcgcgtcattcatgggatagctgcggtggggtggggattcgccatgtgccgcgccggtccgagccggtgcgttcgatcagtttggcttcctgcatcgcccggaacgtgcgccatacggtggtgtaggacacgtccagcgcgaccgccgcctgacggtacgtgatcgccggatacggggaaccggaacgctaaaggaaccagaggggaaaacaagagggtacaaaaagccggaagccctagaaaaaataagggttccggcgagggcggaggatacgagattcgaactcgtgaggctgttacaccaacacgctttccaagcgtgcgccatagaccactaggcgaatcctccatgcactgcagtgcttgctagaagtaagctccgtaggcaactcgaataagctaccacagctttcggataaatgcacattcagtgccggctgcggcgtgtcgctttgtggacaaggaccaccaatgagtgcctgcgctgatgtgcaggtcgttcgtacggcgtgtgcaacaggtgatctcaccgggggatgaaccagtgcaaatcaaagcgactcaaggcaagtcagcaaacccgaggcaaaccagaatgaacatgcgcatgccatcgcgtgaattattgccagcctcttgccgtgatgcaacatagtgattttaggctatgaaccttggtgaaacagttggtcatgcaatatgagggatggggagtggccagtcgcggggagttcataattcgggaagtctcccatctgtgagcgggacaatatcgaatattgagacaatctgcggtaataattgatcgaaaaacagtgcctaatacctcttaaatcctaaaaaatcaagactgttcctcaaaaaagtttttctttatattgagtagttggtttttgattacttagccgcgcagagagagggataggcatggttcgtcgcgcccaggctgctcttcggtccgttgaacacaccagcgtgaggcagctgcgagtcctggctgcgattgtatttctgttcgccatggtcatcgccactgtggctcctgcagtcacggctccgatggccttcgccgacagcagcaccagctcgtccagcgttgactacgccacctgggccgaagtctccaaggcgatggacaagcagctgaacagcggtcttgagacgtacaaggatggcaacaccgctggcgccacctccgatttcatgggcgcgtacaacaagatttacgtggcctccaacttcaccgcggtcgtgcacgacaccattggcgcggacaagcagctcgcccaacagcaggcattccaaagcgttcagaatctttcctacacgcctagcaacgacgatcaactggctcagcagattgatgcgttgaccgccgatcttgacgccacggcccagcagctcgacgccaacgccgatctcgccaagccgaaggcgtacgccgaagcgctgcaggcgcagctggccaaagagcgcaaggagctcgacgccaagaaaaagaagaacccgggcaagggcaatcgttcatggaccgacgtggccaacgaaatgaccccgattctcgacaatgcatacaaagcttacgaaaagggtgatggtgccaagggcgccacgctcgtgaacaacgcgtactaccagtattacgagaagctcggcttcgaaaagaacgtgatgaacgccatcagcggcaaccgcgtctcgcaggtggaataccagttcaagatgtgccgcaagtccatgaacgccggcgcatccctgaaagacaccaagaagctgatcgacgacctcaaggccatgctgatcaaggacgccggcattcttgacggtggtgccgccgataaggaagacggtttcaccaagctggtcaccagctcctccggccaggcgttcctcgtgcttatccgtgagggtcttgaagctctgctggtggttgcagccatcgtcgcctacttggtcaagtccgataacaagcgcttcgtcaagtggatttacttgggtgtgctcgtcggtctgctcggcgccggcttggtggctgtgatcttcgtgttcgccttcggcggctccggcccgattcaggagatcatggaaggcacctgcgcactgatcgccatgggcatgctgctgtggacgagtaactggatgctgaacaagtccagcgtggaagcgtggaaccgttacattcgcaagaagaccgaggctgctgtggctgatgccgaagccgccgcaagtgccgacaacgtgacgttgaaaaccgtggtctcgctggctatgctgagcttcctcgccgtgttccgtgaaggcgctgaaaccgtgatcttctacgagtccatctacacgatgagccgcgatactcgcggtatgtggatcggtggtctgaccgccgcggtggtgcttgtcggcatcttcctgctcttccgcttcacctccgtgaagattccgattggtccgttcttcctggtcacttcgattctgatgtctgtgctggtggtggtgttcgccggcggcggcgtccactcgctgattgagggcgacttgctgcccgccttctacctgaacggtgtgccgacgaacgattggcttggcctctacccgtacgtcgaatgcctagtggcgcaggccatcgcagccgttgcggttatcgcgctgttcgtggtcggcttcatcaagcagcgcaagctgaaggcgcaggctactgccgaggtcccggccgtgaaggcgtagcccgtctagctcgtccgtttcctcccataactgcagacaactgacagacttgcggcacggcctcggatcgatgccaattcctccagcccacgccgcacttatctcataactgaataattgcaattatctaagcgtgaatcctaattcaccagagatagagaaaaggaataacaatgatgaagaacaagaaactggccgctctgctcggcctgctgctcgccggttccatgaccgtgtccatggctgcctgcggttccaccaactccgcatccgacactaaggctgactcctcctcccagtcttccgactcctcttcctccgattcttcctccgattccggcgccggtttcgaagaggttccggttggcccgtccggtactgctgaagagcaggatcaggacgccggcccgctgaccgtgggcgctgtgtacttccagccgatcgatatggagccgtcttccatgggcctgaaggctgctgacgcttccttccacctcgaggccgacatccatgccaaccagaagggcaccgagctcggctacggcaagggcgacttcgtgccggatctgaccgtgaactacaccatcatcgataagtccaccggcaaggaagtcgagggcggcaccgccacctccggtaccttcatgcagatgaacgcttccgatggcccgcactacggcgccaacgtcaagctcgacaaggctggcacctaccagctgaagctctccatcgaatccccggcctccaagggttggatgctgcacgttgacccggagaccggcgtcaagggccacttctggaccgagccgatcgaggtcaccttcgacaactgggattacactcctcgccagtggtgattgactaagcagaaagccccctcgtcagaggggctttacgccgctttagggagataattcttaggacggtctaaaactcccctcagtccgcttcgcggacagctcccctcagagaggggagcctaaggtgaacagagaaaggacgcgaatgcttgaacaattcgtggcagtgatgccgggcactttggcccccgcattgctggtgatgagcctgagcgtgatgctcacggtcggcgaggggcgagataagccgataagctcgcattggcgtctcatcggcctgatcgtcggtctgatcgccgccatcgtattcgccggcctgcgcgcctcggccgtgatcaatcagcgcacgttcgtcaactacccggtgttgtggtgcgcgatcattgccgacatcctgaccatcgtcgtggtggtgttcgcacgccgcatcaccaccaattggcagcagcacaaggtgttcatgcacatcgctaacgccgtggccgccatcgacatcgcactcaccctgttctacgcgctgccggacgtgattctgcagctcaccatctgggtggaaccaggggagaccgcattcacttcggccatgctgctgcgcgctcttggtttcctgcttggcgtggccatgtccattattgtggccgccatcttccgcacgatgcgcaccactgccgtgcgctgggcgttcaccgtggccgtcgcggccatgatggtgattctgctgattcaacacttcactggtcttgcccagattctgcaggcgcgaggcttcccgatgaaccatacgatgttcgtggcgctggcttggtccatcaaccagaactccacgatgattatggcgcaggcgctggtgttcctgattcccgccgtggcctccatcgtggccggtttccgtatgaaaacccatgatgtgccgggagccaacgaggccacgttgcgccggcataaggtattccgccgccacgccatcgccgctgccgtgtggagccttatcgcagccatcggcgtcacagcaaccctgaccgtgggcgttgccgcgacccatcagaccatcaccctttcgccgccggaagcctactcgctcaaggacggcgtggccaccatccccttcagccaggtcgaggacggccacctgcaccgcttcgaatacaaggccaaggacggcaccgtcatgcgcttcatcatcatccgaaagaacggtggcgcgtacggcatcggcctggacgcctgcgagaactgcggcgacgctggctactacgagaaggacggcaagatcatctgcaagaagtgcgaggtggccatcaacctggcgaccatcggcttcaagggtggctgcaacccgataccattcccgtacaagaccggccacggcaagatcaccattcaaactacggatctggacgcgctgagcgcccacttccggtgagtcaggcaggagacaagaatcatgttctttctgcgcatgattactcgctcgttcacccgacagctgcgccggcgcctgcttatcgcgctgaccgtatgcctgtcggcgaccgtgtccgtatcgatgctgggcgtcgtgttcgacgtgggcgacaagctcaacgccgagctgtccacctacggttcgaacatcaccgtgcagcccaaggcggatgcggtcgtttccgacctgtacaacaccgagtcgggcggcgcgacgtccaccagcgacccgaccgcttttctgaaggagtcggacgcggccaagatcaagacgatcttctggtcgttcaacatcaccagcttcgcgccgcagctcaacatccacgccacggtgaacggtaccaacgtgccggtcgtcggcacgtggttcaacaagaacctcaagatctccaccggcgagactaccgtcgtgggcgtggaaggcatgcgctcgtggtggcagctggacggcaagtggcccaaagacgattccgaccagggcgtgatcggcaagacgctggcctccgaactcggcgtgaccaccggcgacaccatcaccctcaacaaaaccaccgcctcaggcaagaagaacgagcagaaaatcaagctcaccggtgtctacgattccggcgacgaggacaacggctcgctctacatcgcctcctccacggcccaggtactcgccgacctgcccgattcggtcgacaaaatcgaggtcaaggccctgaccacgccggagaacgacctggcccgtaaggccgccgcgaacccggccgcgctgagccaggaggaatgggagacctggtactgcaccgcctacccgagctcgatcgcctatcagatcgaagaggtgattccgggcgcggtggccaagcaggtgcgtcaggtggccgcgttgcagggcaatgtgctgcaaaagacgcaggccgtgatgattctgatgaccgtgctgagcctgatcgccgcagccgtggccgtggccaacctgatggtcgcctcgatcggcgaacggtcgggcgagctggcgttgctcaaggcgctcggtgccaccgatgccgcggtatcccgcctgatgctggccgaaacggcggcaatctcgctgctgggcgcgattgtgggcgcgctgctcggttccggcgtggcccagctgataggccgggtggtgttcggttccggcattacgatgcggccgatggtgttcgtgctggtgttcgtgctgctggctgtcaccgtgctgctggcgtccgcctcatcgattcgttcgattctgaatctcaagcccgcggaggtgctccatggtcgctgagtttatctacgtaggtgtggaaggagggaaccgatgaccaacaccggtatgttcttcagaatgctgttcagcgccgtgttccgtcggcgttcgcgcgcggtgatggctgtggtggcgtcgctggtcggcgcagccacactgttctgtctggcgatgatctgcctcgccgtgccgcagcagatgaacgaggagatgcgtgcgtacggcgcgaacctgattgtcacgcccaccgaatcgaccaatgctgacggcaaggccggcatcgacaaggcgatggtgcagcacaccactgaaatggtcaaggccaagggttccgcgaaatacgccacctaccgctacgagaacgtgcgcgtcaacgcctcgccgtacgttatggccggcgtgaatgcggcgcaggtcaagaacctcaaccatcactgggtggtcgacggctcgtggccgaccgacggcaaggtgctggtcggacgcgacatcgccgacgccatcggcctgagaatcggctccgccatcaccatcggctaccgtgcatccgataacgccagcaccaacggcacttcgtcgaactcctcgatcgaccagcaaaccaaagacggccgtgtctccagtgacatcatggacacctccggtaccgaattccgcgtggccggcatcgtggacaccggcggcagcgaagactcgatcatctacgccaccaacgccgacgtcaacaagctcaccggcatcacgcgcggcgtggacgtcatcgagtattcggccggcgccagcgacctcgcaggcctggtgtccagcatcaacgacatgacctccatgcacgtcaaggcacagcagatcaccaagatcaccgcctccgacacccgcatcatcaccatgctgcagacgctgttctggatcgtctcgctggtggtgctggtgctgacgctcgtcggcgtcggcaccacaatcagctcgatcgtctcgcagcgacgcaacgagattggcctgcgcaaggccctcggtgctagctcgcgtgccatcggcaccgagttctacatcgaatcgtcgctctacggcctgattggcggcctcatcggcaccgcaatcggctacggactcgccagttggctgtgcgtggcggtgttcgaacgctccatcgtattcaactggtggctggccctgatttccgtgctgttcagcgcgctggtcgccatcgtcgcctccatcccgcccgtccaccgcgccacccgcatcgaccccgccgtcgtgcttcgcgaagaataaagaaagagaaacgtcatgctacttgaactcgaccacatctcgaagatctacggcgacctgcgtgccgtggacgacctcaatctgaccgtgccggaaggcgaatggctcgccatcgtcggctcctccggctcaggcaagaccacgctgatgaacatgattggctgcatggacacgccctccaagggctccgtgaagctggaaggccgcaagctggaggacctgaacgccacgcagctggccgacgtgcgcaagaacctcatcggactggtgttccagaagttctatctggtgccgcacctgaccgccgtggaaaacgtgatggtggcccagtactaccattcggtggtcgatgagaagcaggccatggaggcgctggaaaaggtcggcctgaaggaccgcgcccaccacctgcccggccagctctccggcggcgagcagcagcgcgtgtgcgtggcccgcgcgctgatcaacgacccgaagctgattctggccgatgagcccaccggcaacctcgacgagaagaacgagaaaatcgtgctcgacctgttccgcaagctgcacgagcagggcaccacgattatcgtggtcacccacgatgcgctggtcgccagctgcgcgcagcgcgagatcatgctcaaccatggcgtgctcgtcggtgagaagtggaatgacgaggatgcgcgcaaggcctacgaggcggccggcggcaagcccgcctccacgggtgcacaggtcgagggcgcgcagaacggcgagaccgccattggtttcactgaccccaccaaggccgcgaaaaccggcggcgaggagtagggccgtcaggggcatcgagcagtatgtgaggaatacatggcaagctgatggtctctcccccagtcagcttcgctgacagcccccctcgtcagagggggcttaaggagcgtgaatatgaccgaaaagagtacgttgaagaaatccgcgacattggcggcggccggactggtcgtggctggcgcgctgctggccggatgcggcgaatccaaggccgcgccgatggacgatgcgtacgccggcaactcgggcgagaccgagaagtcgcaggaagagcagtcgcaatcccagtcgaacggctccgatagctccgacggctccgattccagctcgtcgcacaacgacccgtccaccaccacgtccgacaagaaggacaccggcaactacaaggacggcaactactcgatcaacggccagtacggcccggtaggcgaggattccatcgacgtccatctgaccatcaaggacggcaacgtcgagaccgtcaatatcattgggcacccgttcaccacgatttccaagaaccatcaggacgacttcgccaaagccattaacggcgtggtggacggcaaacctctgaagggtctcaaagtggacaaggtcgccggcgccagctggacctccgacgccttcaacaaagccctcgaagtcgcccgccaggaggcttcgattcaggagtaagaccgctacttcagcaatgctggccacagcagatcggccatgcgcgaggcccaggcggtgtcgtcgtccattgctttgccctcgatggcctcatacgccaccaaagatccgataatcgtggacaacagcaacttctcgtcaacgtcctcgcgaaacacgccctgcgcgactccctgcttgaggaacgcccccacacgctccagccacggggtcaccacttggtcgacgatgtgctggaagaactcggcctcgctggacaatacaatgcccacgcgcttgacgtcgatgtcgttgtcgcgcacccaatcgaccaatcgctgcaatagttgcgtgaaatgctcacgcgtggggctgggcactgggtcggaatccgggatggccagatacatcgcgctgatctcgtgcagcagctcgtcggcattatgatatcggcggtaaatcgtggttttggccacaccggagcgccgggccacctcctcgatggtcacgccgctgatgccgcggtccaccgcaatctgcagcgtggctcgcatgagcttgcgatccgtcgcctcgcgcgtgcgctcaccgcgcggtgtcgccgtcgtgtctgtcatctccgtcatctcttctcttcgaaatatgctcccgtacgctcccgctggcgagagctggctggcaaagccagactgagggtggtaagtccatgccgtttgtaggcaactcccggataatacctactagctcagcactttagtgctctcgacttgggctacataccactggttgaaccgcaccagtggcttcctgagcaacagcccaagcaacagtagcggcggcacgaatgccagcagcattccggcggcccgccagtaatccatgtcgtagatgccggcgatggccgcacgcatcatcgtcaccgcatgggtgagcggcaagagcggactgactttggcgatgaagtcgggcaacatctgcaccgggtaggcagcgttcgcacccgaaatctgcacgatgagcataagcacgccgattgccttacccacattgccgaaactcaccaccatcgtataggtgaagaacgagaacaccagcgaggccagccatccagacaacataaacagcagcggatgcacggcctgcacgcgcaggaacagcaaatcgccaccgagcgacaccgtggattgcagcagcgcaatcagcgcgaacaccccgtaatgcccaaggaagagccgatgcggccgcggatcgcccaatgctttgcgcgtccggcgagacacggtggttttcagcgtcaccaccatcagcagcgcgcccacccacagcggcagcagcgtgtagaacggtgccatcgacgaaccgaaattcgccaccgggaatacggccttgcgcctgagctgcaccggtgcggccaacgtactggccagcgtttcgggatcattgcccagcacctctttgaccatgcccatatcgccactgtttagtgcgtcgctcagtgtgctgttgaacgaagccagttcggcgccggcggaacgcagtttgccggacaccttgtccaaggtagtgcgagcgtcgctgagcatatcgctggcgtcgtcggaagtccctttcaggtcgccgagcgtggagtccaactgggtggcgccggaactcagtatgccggaggcgtcagcgacggtggacgacagggagtcgatttgcggtttcaccgtggccgagaaatctgacttgatattggcaatactgttctgcgcttgatcagccagattcttgacctgcgcatgctgatcctgcgcgtcctgattgccttggcgaatatcggtcgccgccgtattcagcgcttgccgcagcctgttttgtcgtgcgattgaacggtcaatcgccgtgatgatggatgagtcgttgcccagtatgccggccaacgtgttgcgaatttcagtgtatttctccgtctgcttgccaatggccgtggcttgacggtccaattcgtcggcgaccgtggtggcaccatcattcgcgtcggaatacagcttgtctatggaatcggacaccgcgccgaaactggaggcgctcgcgtccagtgcgctgctcatcgcgtcagcggtggtgcccagggctccggccacgtcggtgacttcctgtttggcgctggcaagatccttgccgccttgtttggcggcagaggaaacctgagtgattagtgagttcgaggtgtcgagcaaggcgccggccgtatcggtcaatgcgctgtatgtgccaagcagatccgcagtatcgtcaagctgtgtggcgaaattggcgatgttggcgttgaaggtattcagttgctctttggcctcgggcttggacagctgatcggccagcgaagacgcgatttccagcccggccgaagtgatggtcttagcgaacgtggtgttgatttccgccgcaacctcatccgtgccctcgttgagcagattcggtgccagcgcgttcttcttctcgttgcggtaataggtcagttcggcatgctgcacgtcgtcggagaagaaggtcatcatgtctttgctgaacgacttcggaattacgatggccgcgtagtatttgccggatcgtgcgccctcgacggcatcggctttggacgtgatcgtccaatcgagctgactgttggcgcgcagcgcgttcaccacctgatcgccgaccgtgactttcaccgggatcaggtcggaacgatacccctcatccacattcgccaccgcgaatttcaggttcttcatattcgagaacgggtcccagcatgcggccacgttgaaccaggtgaacaggccgggaatcatcaccaagccgatcacgatgatgatggagaccacgttgctggtcaggcgtttgatgtcgccggtaaacagtttccacatggtgttcatcgtgcgtgcctgccttccttggtcggcggaatagtggggatgattgcggtaacagcggcgctcgggtccgcttcttcgtggcgttcggcggaggtgtcgcgacgcttggccttatgcccgtacagcatggcgcggatcgactcgtcggagaggctgccgagctcggtttggcggcggatggaatcgcgcatgaattccacgaccatcaggaagcccatgatgatgagcacccatgccagccatgtgcccatgactacgattttctcgctggtggtcagcgcaaacacgataatgagcgcggccggcaccacgaatccggcaataagcgcacccagcagcagccggggataacggtaggcgaatttggcggcccgacgttcgatggcatgacggtattcgtcgtggtcggccagtgctgcaatggcctgagtgacacggtattcgctgccgggcagatgcaccggctcgccgataatcatgtcgctttccttgatttcccgcgcgaacaggcggttgagattggccagtttcggccgggcgccgaggccaagcgcaaaggccagaaccacgaaaaccagcaatttgccgatataggcgaaccagaggccgtcgtagaagccgccgatggtttcacgcatcgcgtcaatcgaataggtgaacggcagcagcgggtagatggcgcggaagaacgcgggcatcatttcaatcgggtacaggccggaggcgcccggcacctgcagaatgaccagcgccacgcatacgcctttgcccacgtgcatgaacgtggtggagagggcgaaaatcaccgacatatacaccagtgaggtgatgacgcaggtgagcagaaacactggggcgctcgcgcattgaatgccgatgacaagatcgccgatggccgtgaccaggccttggacggcagccagcgtggccagtagcaggaagcgaccgagatagccttgggttggtgtgagatcgtcgatgccctcatcatcggtttcgagtttgggaatgaccacgagcacgaacgcgcccacccacaaagacagggtggtgaacagcggtgccatgccggaaccataggaggcgaccggatagacggcctgttcgctgataacagtgggggagagcatgaagtcggcgattgtggcggcatccagtttgccgtcggtgccgatcagggaactgagtgaactggagatgctcagggctttgatgtcggtgaccagcgtatcgagcttggtttgtacgccggccagcgccttatcggtgtcgcgcagcgcggtcaccgtggtggaggctgctttgtcgagttggtcgagggtatgcttcgactgatcgatgagtgagccttgcgacgtgatgccggtcgacagagtgctggcggtcgagctgagggcgttgagaccggtgttgagctgaggaatggcgccggaggtgatggtgccgcgagcggtattggcctcgcgcaccgtggtttgggtggcggtattgagatgctgcgccaatccggcggtgtctgtggaggcattgccgatagtggtgttcaggctatcgaggttgcccagtgcgccggcaagctcgctattgcggctttccagtgtggcaatggcggattgcagcggttctcgattggcgttcggcagccctttgagttggtcgatgatgtcggcgttcgcttggttgatgtcttccgccgtattgatcagtccgcctacctgctgattggcggcgctgatggttccggttaccgtgcccacgctttggttggcctgtgctgcggcttggctcagcaggcttgagccttggtcaagcgcttcggacgtggaggtgacgaagccgttcagactggtctgggtagtgccgatcagggtggagacgccggccagaccttctgcagtgtcgatgccaagtgtgcgcgcgtcgtccagcgcctgacgtgcggtgcgtgtctgctctggggtgtcggtgagtttggtggtgagcttggcgatggtgctgcgtgtgtgctgcacatcgtcggaggccttggcaagggccgtgagggccttggctttggtggtgtcttcggtactgatggctttgccgtcaaccgtattgatgacttcggtaagtacttcggatacggtggagacgaatgtggaattgaccgtgcggtccacagtggacgcgccgacgtcggtgactttgggggcgatggcgctggctttttcgttgacgtaatactccagagtgggccgactcttgccgccggtcaccacgccggcgagatcgtcggaaaagtctttgggaatgatgatggctgcgtatgccttgccggattccacttggtccatggcctcggcttcggtgacgaaggtccagccgagctggtcgttgcttctcatctgcttgacgatttgatcgccgaggttctgcttgccgatgagcgcgttgtcggtgccgtcgtcattgttggcgatggcgacggtgatgcctttggtattgccgtacgggtcccagaagccgacgatgttgtaccacgaatacagtggcgggatgaacaccatgccgaacaggatcacccatgcggccggcaccttgaacaggcgcaggaagtcgcgtctgaggaccttgaagatattgcccactgatacctccggagcttggtgttgcttggttgctacgttttccgtagcgatacgttaatcgtagcgctacgtttgtagtagcgtaatacggctgccggagattaatggggtgattgatgatgtttttggcggaataacgctgctgcccagcggcttatcgtgtgtcgctgggcagagcgaaaggcgttctggaacttattgacaagatttctggatggtttttggacgtttcctgaacgcgatggataggctcggtgctcggcaatgtagacagacatgtaccgaccgcccatcaagttcagcaaaaccgcaatcgggtgatagggtgaggggacgctatgtggggaggaaaccatggttgaattcaaggacgatggcacggccactacccccggcaagccgcgggagaaccgtgacgccgagtccgcagtcgtggccgatctggtggccgtcgaactggacgacgccggcttgaacctgaacgccaagcgattaccgattctggcgcgcatctatggcgcggtcgtgctgctggacggactcgccacattgccgattatggtgatttccatcctctatgccgtgcgcgagattctggatggtcatgtgcacgtcgatgcgatgagcctgaccttcatcctgtccgcgattcatgcggtggtgctggtagtcagtgccgcatgcctgattgtgctcggcgtgatgctgctgcgcaatcatcgccggtatgccgcgcgctggacctacgtgctgatgccgttgacgttggccgacggcatgctgtcgctggccctgaccggccttggcttcaacctgctgctgccgctgattcagatgattattctcgtcgtgatttcggtgaccgccgatccctccctgagcgaggaacgccgtctgcagcgcgcgctcaggcgtatggacgatcgcgatgattatgaatcggctgtggcggccggcatgctaggccgcgaccagtccggcaagggctatattgcgctggactttttcaatatcttctggctgtttaccatcgcttcggtgggtggcctgattgtggagacgatctaccatatggcgctgtataacggtgaacttcaggaccgcgctggtttgctgtggggcccgttctcgccgatttacggctgtggtgcggtattggtaaccgtgtgcctgaatcgtctgtggaaggcgaatccgttcttgattttctgcgcttcggcggtgatcggcggcgcgttcgaatattgcaccagctggttcatggaagcggcgtttggtattaccgcgtgggattacaccggccgttggctgtccatcgacggacgtacttcgggccaattcatgttcttctggggactgattggtgtggtgtggatcaagtggctgttaccgcgactgctggctctgattaatcgcattccatggaaagtgcggtattcgctgactgcggtatgcacggtgctgatggtgatcgacattgccttcacgctgatggccttggattgctggtatgggcgcatggccggccagccgcaggattcaccggtcgcgatgtggttcagcgaacgctacagcgacgcttacatggccaatcgcttccagaccatgcatatcgacccttccaaggccgggcgtatgtgaatggccggcaagtaattacgcttcgcgggcagaaggtgcgtagaacctaagacagccctcgcgtgtgggtggtaagcgggatacactttcaagcgttgaaggaatgattccctccgctgatgcgctgttttgtgacgcgcgtgatgacgatgggacaatcaaacgaaaggcaaggcacatggccgaagctacagcaaacattggtgtgattggactggccacgatgggctccaatctggcgcgtaatctggcgcaccatggcaacacggtggcgttgttcaaccgccactactcgcgtaccgagaagctcatgaacgagcatggcaccgaaggcaacttcgtgccggccgaaacgctcgaggaattcgccgcgtccctgaagcgtccgcgtaccgccatcatcatggtcaaggccggtgctccgaccgacgcgaccatcgcgcagctggaagaggtgttcgaaccgggcgacatcatcgtcgacggtggcaactccttcttcaaggacaccatcaagcgtgagaaggaagtacgtgccaagggcttccacttcgtgggttgcggcgtgtccggtggtgaggaaggcgcgctcaacggcccgtctctgatgcccggtggcactgcggaatcctggaagaccttgggcccgattcttcagtccatcgccgccaaggtgaacggcgaaccgtgcgtgacccacatcggcaccgatggtgccggccactttgtcaagatggtgcacaacggcatcgagtatgccgatatgcaggtgattggtgaggcgtatgacattctgcgccgtggactcggcatggatgccgaggagattggcgacgtgttcgctgaatggaacaagggcgaccttgactcctacctgatcgagatcaccgctgagattctgcaccacaaggatgccgagaccggcaagccgttcgtggacgtggtcgtggatcatgccggcatgaagggtactggtacgtggaccgtgcagactggtctggaatgtggttctcctgtggctgccatcggtgaagccgtgttcgctcgtgcactgtcttcgcacggtgagctgcgtgaagacgctcagaaggaaggtctggctggaccgaacaagaccatcgatctggccggagaagacaaggccgcgttcgtcgaggacgtgcgcaaggctctgttcgcttccaaggtcgtggcctatgctcagggcctgaacgagattcaggacggtgccaaggaatacggctgggatatcaacctgtccgaagtggcccgcatttggcgtggcggctgcattattcgcgcccagttcctgctcgaccgcatcaccgaggctttcaggggcgataacccgccggcttccctgctgttcgatccgtacttcgagaagatcatcggcgaatcgcaggatgcatggcgtcgcgtgatcgttcgcgcggtggaggccggcatcccgaccccggtgttctccagctccctggcgtactacgatggtctgcgctccaagcgcctgcccaccgctctgacccagtcccagcgtgacttcttcggtgcccacacctacggccgcgtagacaagcccggcgtgttccacacgctgtgggctgaagaaggcaagcctgaaatcgaggcgtagcctcgtgatttcaggtttaggacagccctgtgggctgtccggccttcttcaggctcggcgatagccgagctgagaaaacagcaagcccgagatcgaggcgtagcctcgcgatctcgggcttaggggagcccggtgggctccccggccctcttcggagcgaggcggctatgccgccgagccaacactgagcctcgccgcaggcgagtccctaattgcaggggccggcggcgaagagggcaagtccgagattgaggcgtagccatagacgaattaagccccctcatcagagggggcttaattcactcacaactcggtgacggtttcttcggtggagaaccagatgaactcgtccactccgttggcgtaggaggacgggtaatccggtttgttgggctgctcgaagacatgggccagcgattcggctttgccggcaccggcggcgaagaaccacgtatggcgtgaacgcgcgatgagcggcgcggtcaatgaaacacgcagcggcggcatcttgggggagtggttcacacccacggtgagcctatcagtaaccttgacctcatcatgaccagggaacagcgacgcatagtgaccgtccggtcccatgccgagaatcatcagatcgattaccggttccggccccaattcattcaccaactcgcgctcatagtcgctcgcgacatcgtccagcaacgcatcattcgcggcatcggcggcggcgcgaacggaagcatcatcgctgtcggcctgatccatcacatcggcgatgtcatcggctgaacgggtatcggccgccatctcatgaatattcgactcaggcagcttgccatctgccaccagctggtcaagcagcaggcgacgggcctccaaagcattgcgatcggtgtcgtaagccggcacaaaacgttcgtcgctccaccagaaatgcacgcgcgaccaatcaatcgcgtcagccagcggatcgttcagcaccaagcccagcggctgcgcggccgaaccgccagacagcgccacatccacacgcgtgcgatgcgtgccatcaggcaatcgttcggcgagcaaatcgagtagcgccaagacaaaacgttgcgcgccagcctgaatcatcagatctttattcggatacacaatgagttttcgagttgccatgtatggtccttgtatggggtatgtgtcgtactttgcaatgtggattgtgttgtcagttgacaacacaatccacattgtgcgacatcgcatatgtcactttattactccgcgggcatgagcttcggcatcgcatgaggtaggaaacgatgagcaacggcgttggcatggctcggccacaattgccgaactcattccaacgccgctgtggcaacgggttctaccgacttcagtgacgaatcagatcccagccttcgttgatgacctcggcgtagatctcatcgggatcgatgcgacgcagttcctcggtcaggcagtcctcgatggtgcgcatcggcacggacacttcctgcggagtctggccgggcagcgagatcagcgcttggtcctcatacgggcgttccagcgagatcacaccgtcctcacgggtcaggtacacgccggtcacggcctgcgcgtcgggcacgaactcagtttcgactggtacgccaagtttcagacgcagccatgcgcacagcatttctataggcaggaagtcggccttgccggtcaccttcgcggcggtgatgggcaggtgcggcggctgatcgagcatcgaggcgagcattgcgcgccagacggtcagtcgtgtccaggacaagtcgatatcttccggtgtccaattgcggcgcaaacgctcaatcgtggcctccggattattggagtgcaacgcgtcggtgatgcgactgcgggccatcgcacccatcagatccttggccgggttcgacggcggtgtggtcggccaccacgccactacaggcgcatccggcacaagcagcgggataaccagcgtatccgggtggttgataaggccaccgcgcggacgcaagatgatgatctcaccggcaccggcgtccgcgccgaatcgcacttgggcgttcaggttggaatcgttcggatcgttcgggccgtcggtcaaatcgacggccggattatcgcgactcgcgctcacctcggcggccacttcggccgcgttcggttcgccttcgccggactgatcggcaggattggtatccggtactacggcaatcacgcggcacgggtgctcacggctggccgagttcgcgatttccagcgcatgctctaggtccgcgtcctcggtggcgatgagcagcgtcagcacgcggccggtcgccgattcgccgcgctcctcgtgcagctgttcgattttgtgcgcaatctcgcgggtgcgggtgttcggcatatcgatgatcatggcatcctccagtggcggccgtcgcgcgccagcatttcgtcggcctgtgccggaccccacgtaccggcgcggtaggcctgcggctggccaagcgtggaccagaattgttcaatcggatcgaggatctcccagctgaggttcacctcttcggtggtcgggaacaacggcggatcaccgagcagcacgtccagaatcagtcgctcataggcttccggcgagttctcggtgaaggagcggccgtagctgaagtccatgttcacgtcacggacctccatggtggagccgcccggcaccttggctccgaagcgcatggtgacgccctcgtcgggctgcacgcgaatcacgatggcgttcttgccgagttcgcgcacggcggtctgctcgaacggcagatgcggggcgcgcttgaacaccacggcgatttcggttacacgcttgccgaggcgcttgccgcaacgcaggtagaacggcacgccagcccagcggcgggtgtcgatatcgaggcggatggcggcgtacgtttcagtggtgctcttggggtcgatgcctttttcctccaagtagccgaccacttcgtgcgagccctgccagcccttggcgtactggccgcgcgcggtgttggcggcgaggtccttgggcaggcgcacggcggaaagcaccttggtcttttcggcggtcaggtccttggcggtgaagctcaccggctcctccatggcggtcagagccatgagctgaagcaggtggttctggatgacgtcgcgtgcggcgccgatgccgtcgtaatagccggcgcggccgccgatgccgatgtcctcggccatcgtgatctgcacgtggtccacatagttggcgttccagatcggctcgtacatggcgttggcgaaacgcagggccagcaggttctgcacggtttccttgccgaggtagtggtcgatgcggaacacggagctcgggtcgaacacttcggataccacgctgtcgagttccttggcgctggccagatcatggccgaacggcttctcgatgatcacgcggcgccatgcgccctcggacgagcgcgacaggccggaggcggccagctgcttggcgacctgtgggaatgcgcgcggcggcaccgacatgtagaaggcatggttaccctgcgtgccgcggtcgcggtcaagctcctgcacggtggcgctcagacgctcgaaggcctccgggtcgtcgaacgtaccctgcacgaagcggatgccggcggccagattgcgccaagtcgactccttgaacggcgtacggcaatgcgcctggacggcggccttgacgaattcgatgaaccgttcctgtgtccagtcgcggcgggcgaaaccggtcagaccgaagctcggcggcagtaggccacggttcgccaggtcgtagacggctggcagtagtttcttttgtgccagatcgcccgtgacaccgaaaatgacgaggctgcatgggccggcgatacggggcagtctgaggtcgcacgagtcgcgcaggggattgctccaattgggggattcactcataatgtacaagggtagtcgccggcggctatctatcgctagaggcgatatgcgatttgggctgcgatttgggccacattgcgtgtgctgtgccgtgcgttgggccaatcgcgtacgcaaacgtgtacgcaacgccgtagttgaaatatcccaaaacggtgtgtattttagaagagttgcccctttagctcaacggttagagcagcgtccttttaagtcgtgggttgtgggttcgaatcccacagggggcacaacaaatcctcggaatcgcaatggttccaaggatttttttgtttcgaccagcctggctcctagagtggtgtcccatgtcatgcaccacgattcttgtcggcaaaaatgccagttacgacggttccaccatcatcgcccgcgatgacgattcgggctcgggccgttacgatcccaagcgcttcgtcgctgtcgcccccgacgaccagccgcgccactaccgcagcgtgctgagccatgtcgaaatcgaactaccggacaatccttgccggtacaccatcgcaccgaacgtgctgaataatcgtggcattctggccgaagccggtgccaacgaacacaacgtggcgatgagcgccaccgaaaccatcgctgtcaacgagcgcgtgctcggtgcggacccgatggtcgagttgcggccggctgtcggcgaaccggacagcaccgattatcaggccgagcagcccggcggtatcggtgaggaagacatcatcacccttgtgctgccgtatgtcaccaccgcgcgcgagggcgtcgcgcggttgggcgaactgctcgaaacctacggcacctacgaatcgaacggcgtgattatttcggatgtggacgagatctggtacgtcgagaccatcggcggccaccattggatcgcccgccgagtgcccgatgactgctatgccacgatccccaaccagctcggcatcgacgacttcgacctcgccgatgcgttcggcgagcagcgcgaatacctatgcagcgccgacctgcgcgagttcatggccacgcatcacctcgaccgcacaatgggaacgccggtctcttccaacggccgtcacgcgcatagcgccggattcggaacaaccgttgcccttcccacccgtttcaacccgcgcaaggccttcggcaccgcgacgccgaaggaccatatctacaacacgccgcgtgcctggtacatgcaacgccgcctcaaccccagcgaggactgggattcgccggccgcccgctacacgcccgaatccgacgacatcccgtggtgccgcgtgccggaagacaaggtgagcctcgaagacgttgatttcctgctgtcctcgcacttcgaaggcacgccgtacgacccgtacggcacgaccggcacggcggaatcgcgccaccgttaccgtccgatcggcgtgaaccgcaccggccatatggtggcgattcaggtccgtccgtatgtgccggcggccaatcgcacggtgatgtgggtatcgttcggctctggtccgttcaccgccgccgcgccgttctacgcgaacgtcaacgacacgcctgcctacctgcgcgacaccacgcccgaagtctccaccggcaacctgtattggacgaaccgcctgatcgccgtcgtggccgacgcacactggtatgagacgaaccggttcatcgaagggtatgccgagggcgtgcgcgcgttcggacaccggctcatcgagcgcacggatgagcagttgcttgctcgaagcgatgccgaatcgacggatacgaatgcatggccgctcgatggcggccacggcgatgagaaggatgtgcagggcgtggcggatgtgctcgaagcggccaacgacgagatggccgactacctgcgcgagcacacaaccaagctgctgaacgacgtgctatacacctccagcaacctgatgcacaacagcttcgcgatgtccgaccgttgggccgagtagcaaaacctcgactggggaggtaatagggatgccctgctgataacgcgtcagcagggcaaaaccacaatccgaatcagttaaagccgacgatgcgtttggcgatgagatagccgttgcgcacgatccagcggccggttttgccgggcagattgagcgcgcgggacatcagctgcgagcgcacatccttgccgatggccggcgaataggcgtcaatcgcatcccacagctcggttttcttaacgtagttggccggatcgcgcgagagaatcaggaacgtcgaggtaacgcacgattcgatcgccaggaagtgaatcatgtaccggtacagcccctccggcaccgtaccgcgttcgggcgtggcctcggtcatcagccgattgacgagccgcaactggtccacacgcttaatcatcacgtcggtctgcacgctctgaccctcgcgcccgatgaagtagtggtagaacggcacatcgaggtactggatgcgcttcacccacgggaacggctggtacgagtaatagaaatcgacgtagaacgtgtgctccggcagcttcagcccggaatcgcgcaccacctgcgtgcggaaggtgagcgcatgcatgatgatgtactgcgccagaccgaacttgcccaggtcatcccagccgagcacgcggccggcctccattacacggcggaagttcactacggtcttgtgacgcttggccaccttgtcatacacgtaattggtcaccagcatgtcaatcggttcgtcggtgtcatgctgtgcacgcaacgtggccagaaccgtgtcgatggcctgcgggtcgacccaatcatccgcatccaccactttgacgtacatgccggtcgccgccgcgataccggtgttcaccgcgccgccgtggcccttgttctcctgatgaatcgcgcgcacggcgcccggattggtgcgttccagcttgcgcgcgtactccagcgtgccgtctttcgaaccgtcgtccacaatcagcacctcgaggtcgctgatgtcgcttgccgaaagcagcgagttcacgcaacggtcaaggtaggactccatattgtatgcggggatcacaaaggtgagcgtctttgccgtgctggccatgaaagtcttacgtcctcacatatttagtcgttatgttcagtttcctgttcaaaccgtagcacttcgcctcccgactcggcagagtgttgcgtaacctgtgcccctgaacgcatgttctgcaaccctgaatcttccccggtggcgtgctcgggatccgattgggcagaactcgtctggtctgaatccgggctgccggaatcggactcgcgcttggctcggcgctcggcctccttccgcgccttggcgccctcaaagaacaactggggcttggagtcaagccggctcaggccatgccaggccaaatccacaatgtatgcagccagctgctccttgctcacctttggccggtcggcccagtactgcccggtgaatacggtcatgcccaccagcatctgcgcgtagtacggcacgcccttggcagacagcttctgccgtttgaatgtttcggaaagaatgtcttcaacgcgtacggcgatgtctcccatcagcgagctgaatgagccggacgggtcggtgctcggcgagtcgcgtaccagtacctggaacccctcggcattctcttcgatataggtgaggagcgcaagcgccgtgcgttccacaatctggcgcgggtgcacggtcggatcgtcgagcgcggcggtcagcgtaccggtcagcgcgcgcatctcacgatccacaatgacggcatacaggccctctttgccgccgaaatgctcatacacaatcggcttggagactttggcgtgcgcggcgatttcctccacgcttaccgcttcgaagcctttggcggcgaatagcgagcgtccgacttcaatcagctgctcgcggcgctgcagcgacgtcatacgtgaagaatgtgccatgcggttcagcttaagtcgccgggtggaattgtcggcctgagactgccgaattcgtaggggattccatctgcgggctagacttgacaggtatggatatgaatactgtgctcgccgttcttggcgtgattgtggcggcggttatcgtaatcgccctgagcatctggttgggcaagtcccgcaagcgcgatttggatcgtgcgatgggcaaggttgcccccgacaacaagaagacccgcgacgccaaggccgccgccgacgctcggctggccgccgaagccgaggaagctaaggctgcgactgccgccgagccggccaagtcagccgaatcggccaaagccgagcctgcgccagccgcgcaggccgaacccgaaccggcagctgcgcccaagcccgagtcccaacctgcctccaagcccactcccgccaaacctgaaacccccgaatcggtcggctctcgactgacccgactcaaggcaaaacttgccaagtccggcaacccgttcggcaaggccctgttcgacatcctcgccaaagacaatctctccgaggccgattgggaagacgtcgaagacacactgctgcttgccgacgtcggtgcggatgcttccgcccaactggtcgatgacctgagaaccgacgcccgcatcactggtaaagccgacccagccgaagtacgcgccacgctcaaggagaagctgctcgatctggtcggtcgagatacggaccgccgcctcaatgccgaaaagccgggtgccgccaagcccagcgtcatcatcatggtcggcgtcaacggcaccggcaagaccaccactgccggcaaactggctcgactgttcgtggccgaaaacaagcaggtcatgatgggcgcggccgacaccttccgcgcggccgccgccgaccagctcgaaacctggggcgcacgcgtcaatgtgcccgtcgtccgctccgacaaggacggtgccgacccggcatccgtcgcctttgaggcatccgccaaggccaaggaagcgaacgcggacgtgctcatcatcgatactgccggccgactgcagaacaagtcgaacctgatggacgagctcggcaagattcgccgtgttaccgaaaagaacctgccggtggatgaagtgctgcttgtgctcgacgccaccaccggccaaaacggcatggcccaggccaaggtgttcgccgaagccatcggcattaccggtgtggtgctctccaagcttgacggttccgccaagggcggcatcgtggtcagcgtgcagaaggagctcggcgtgccggtcaagctcgtcggtcttggtgaaggtccggacgatttggcacctttcgatcccgaaggtttcgtggacggcattctcgcgtagacggtcgagttcttctcagtctcgctttgctcgacagctcccctcagcgaggggagccctgcgtccgtccacgttgtgggcgcgggaaacgcccgcaacgcaccaaacctagccccgaagcatattcgaaacatgattcggggctttcccatatccgttggaatcatgccggaatcagcccatccgatgccaacctaattgtcaggtgcgcttaacaatcgcgtaacttgccgtaacgaaaccaaaacgagaccggcttttactgacgaactgttagcccccacaagggggacggcattgtagagacaaagtcgacgccggccgcgcaaagcccccggtgccctgaacgaaagagagggaggtagacatgggagcgattgattccggtaacaccgcatggatcctgacatccgcgtccttggttttcctcatgacgcctggtgtggcgttcttctacggcggtatggttcgtgccaaggccgtcctgaacatgctgatgcttgaggcggccgccctgtcggtcaccatgattatctggaccctgtggggttggtcgattgcttacgccggttccgacatcggaggcatcttcggcgacccggccagcggcttcctgctgaaggactccatggtcgcccaggacggcgtgttcaccgccaccggtctgaacggcaacaactacccggtttccgtggacgtcgccttccaggtcgctttcgcgatgattaccgtcggcctgatctgcggcgccattgccgagcgtgtgaagtacagcacctggatgattttcgtggcgctgtgggtcaccttcgactacgctcctatggcccacatggtctggaacggtggtctgctgtctgctgacggcgccatctccaaggccatcggcgcggccgcccacgatttcgcaggtggtactgtcgtccacatcaacgccgcagtcgccgccctgatcatcgtgctcatcatcggcaagcgtaagggcttcggcacgcagccgttccgcccgcacaacgtgccgttcgtgatgctcggcgccttcctgctgtggttcggctggttcggcttcaacgctggttccgccttcgccgccaacggtactgctggttacgcttgggtttccacctccgccgccaccgcagccgcaatgctctcttggggcttcaccgagaagattcgctccggtcactacaccgccatgggtgccgcctcgggtatggtcgccggcctggtcgccatcaccccggccgccgatgtggtttccccgctgtgggccatcgtgatgggtgccatcgctggtgtcctgacctgcctggcctgcggtctcaagttcaagttcggctacgatgactccctcgacgtcgtcggcgtgcatggcgttggtggtttcaccggcaccatcctcatcggcttcttcggtgaaggcaccggtctgctggctggtggcgactggaagcagctcgtcgttcagctggtcatcgctctcgtcgccatcctctactccgcagtgatcaccgcgatcatcgccttcgctctggagaagaccatcggttggcgcgtcaccgaagcccaggaagtcggcggcatcgatcttgccgaccagggcgaacgtgcttacgattttgctggtactgccagctccgttctcaaggaggtgaagtgaaatgaagctgatcaccgctatcattcagccccataagctcgacgatgtcaaggaggccctcgcggccgccggcgtgcacggtctgaccgtgtccgaggccaacggctacggccgccagcgcggccacaccgaggtctaccgtggcgctgaatacactgtggacctgattccgaagattcgcgttgaagtgctgtccgatgacgcggatgccgaaacgctggtcggtgtgatcatcaagtccgccggcaccggcaccatcggtgacggcaaggtgtgggtcgctccgctggactccgtggcccgcgtgcgtaccggtgagaccggttccgccgcgatctgataacacagacgtccatgcttagaaggggatggactgcataggaaaggtccccgcacgccgcgaattgacgccgtgcggggactttttttggcaatgaaagatgaagcaatgacttcagcagtagatggcttgaaacaacgattcatggatatgagccagccggatgacgacggcgtctaccggaatggtgcgaccaagcgcaaagcccgcacggaactggccatgcaatgcctcactgagctgtggaatgcggcctgcaaggatgtctctttccccgtgcccgactccggcatcggcttcgccgcggtaggctcgctggcacgtggccaactgggccccagctccgacctcgacctggtcatcatctacgagcctcgcacgttgaacgaccagcagctcaacgagttggccaacaaactctggtacccgctatgggacagcggtctggacctcgaccactccatccgcacgcgcgcccaatgcgaggaagtcaccgaccatgaccttcccgccgccatgggctggctggacgtgaagcccatcgccggcgacaccgctctgatcaccaccaccgccacgtccatcctcgaacgctggcgcaaggccgcccgcaagcgcctgcccgaactgctcgactccgccaaagcccgactcgacgaattcggccggctccaatacgtcaatcagcccgacatcaaagaggcccgtgggggttgcgcgattcggtgctcgtctccgcgctcgccgcctcatggctggccgaccgcccgcacggcatttacgacgaagctgtggaacgtctgctcgacgtacgcgactgcatccatctggtggccggcaaggataccaacctgatgctgacgccctatcaggccaaagtggctgccatgcttggccttgccgatccgacttggcccgaaaacgagcgtgccgcctactcgatcgacgatctgcagacactgcttgcccgtatcggtcggcgcatctccttctcgcttgattccaccgcttcccgcgccgaacattcgctgacccacgaaaagccgcgattcgcgttcttccagatgttctctcagcgctctggtggcaagcgcgaagccccgcaattcgacgtggtggctcccggcgtggccaagcacgaaggcgaattggtgttggcgcccggtgccgagcctgccaaggatgccaagctggcgttgcgtatggccgtggcggccggcgaattcggtcttcccatcaacccgtctaccttggttaatctgaagcgctgcccgattcacgacaaccagtgggatgacgaatcgcgcgagctgtttatccgtctgcttgcgtgcggatcgaatcttatggaagtgtgggagagcatcgatttcgtggacattccgggtcgatggatgccggaatggctcggcgtccgcaaccgtccgtccgcctcggccgcccaccggtacaccatcgatcggcatatggtggaggtcacgtcgcgtctgggtcgtgagacaccgtccggtggacggtacgatgacgatcatttcaaggcattgctgttggccggtatcacccacgacatcggcaagcgcgcgttcgtggccgatcacgccgccgagggtgcccgccatgtgccggtgattctcaagcgtatgggctacgcgccggacatcgtcgactgggctaccgtgctggtgcgtgagcatttgacgctatccgaatttgccacgggtaaggacccctatgatccggccgtggcggaggagttggccgaccgcttgcaccacgacaagatgctgctggatatgctgttcgacctgacccgggccgacggctcctcgctcggtgccaccgccggtgagaccatcaccaagcaatacggctggtccaagtggcgcgaacaaatcgtccgcggcatgtattccgccgcccgcgccgctatgtaaacggaatcgcccagcgcttcgcgcggccgatacctacctcatccatgcgtccgagcgcacgcgtagtccgttggacagaccgcgcccacccatgagcaccacgttgaacgcggcccagagtacggcggtacgcatcaggtcgctcgtcagcgccggcgtcaccatattggccagtatgagtatgagcgtcacatacaccacggcggtcagcgtgcatgtgacggccagatagcggtagtcgcgcgcgccgataagaatgccgtcgattgccatcatccagccttgcagtgggaagaagatgcccatcgtcaccatgcccacggcgatcagcgtctgaatatgtggcgtaggggagaagaagtgcccggcgaacaggccgactaccgcaaaagccgtgccgattaccgcgccggtgaccagtcccgcacgcccggtcgcccgcgtcagccgccgcgcctgctgcacgctgccagcgcccagcgctgtggccaccagcgtctggccggcgatgcccacggaatccagcatgttcatcgcaaaattccaagaggagttcacggcctgaaacccggccaacacggcagtacccatgcgcgcggcacaggcgaccgtagtcaccatggccgcacgaatcgccaatgtgcgaatgaacaatggcagtccgtcgcccccggctgccgcaataccggccaaacgaggccgcagactcgcaccatccgcccgggaccacagaatggcggggattaccaggaacagccccatgaaccactgagctaccagcgtcgccactccggagccggcaatgccccaattcagcacaataacgaacaacacatcaagcaccgtgttcaccaccgcgccgcccaccgcagcgatcagcgtgatacgaaccttctgcaatcctcggaaaatgccgttcgccgcatataccatcagcatgcctggcgcacccagcacgattgcgcgcgtataggtcacggcttgttccaatacttcgccctgaccgcccagtgcccggcataatggctcggcagccgcgaacaatcccaatcccagtacggtgccgatgctcaaggccagccacaggccatcaatgcctgcctgcagtccctcgcgacgacgacccgctcccagcagatgtgccacctgcgcagtggtcgagtaggccaggaatatgcatagtccgactgccgtgaggatgatggtggagccgattgacaggccggccaacgccgcatccccgatatggccgacgatggctgtgtcgataaggatgaaggtcggttcggcgatgagctggccgaaggtcggcagggccagcgccatgatccggcggttggtggagcgggcgtcggtcgggccgttgctgacgtttgtgtttgcgccggcatgcggggtgccgaagccatcgcggcgtgtagtatcgccggaactggtggctttggcgtcggaagagtctatgggcacgctcacacgcatatcacgcctgactgcgttgcgcaagcacctgttgtgggcgcggaatgttatccccagactatccaccaagttatccccagtatgtggataacttagtggattatccccagaattatccccaaaatgtggataacttatttttctatccacattttgctttctgcgtgtcgtggcgctgactcataggtgaataaggaatgaaccgatgcgggcaaccgtttcgtttccatacgatatcgttcacctgccacgccacatcctatacttggaggctatgccagaaggaagtgaacactcgtatcagaatgggttcggcggtggcctggatcgtggcgatcgtggcgaccgcgcgggccggggcggcacgcagacgtcggcggcggccggcgacccgattttcgaccgcgtgcccccgcatgatgacgacgcggaaatggccgtgctcggcggcatgctgatgagtaaggatgccatcggcgaggtctcgcagaccattgacgtcaccgatttctaccagcccaagcatcagacgatctataacgcgatcatcgatctgttttccgccagtcagccggtggacgtggtgctcgtggccaaccagctgttggcggatggcaacctcgacaaggtcggcggcgcggactatctgcacagccttgtcgcatccgtaccgaccgccgctaatgccatgtactacgcggagatcgtccatcagcgggccattttgcgcaatgtgatcgccgccggcaccaaaatcgcccagctcggttattccgccgagggatcgcaggctgaggatgtggttaacctcgcccagtccgagatctacgagatgtcgatgggcaaggtgcgtcaggactatgccgccatcggcccggtggtccacgacgcgctcgaccagctggacaaactgcagcaaggcctcgtcaacaagggcgtgccgaccggcttccgcgacatcgacgacgtgacccagggcctgcagcccggacagatggtcgtcgtcgcaggacgtccggccatgggtaagtccacgctcggcatcgacttcgcccgcgccgccgcgttgcaccacaacatgacttccgtggtcttcagcttggagatgagcaaggtggagctcgctcagcgtattatctccgccgaaaccaatattccgatggccgccctgcgccgcgccgacgacatcacccccgaacgctggaacaccctgaaccagttctggaccaagatgcagaacgcgccactgttcattgacgacagcccgaacatgagcctcatggagatccgtgcgaaatgccgtcgtctgaagcagaccaacgatctgaaactcgtagtcatcgactacctgcagctgatgacctcgggcaaggccgtggaatcccgccagcaagaggtgtccgaattctcccgtgccctgaagctcttggccaaggaactcgaagtgccggtcgtggccctttcccagctgaaccgtggcccggaaatgcgtaacgacaagaagccgcagctctccgacctgcgtgaatccggctcaatcgaacaggacgccgacgtggtgttcctggtccaccgccctgacttctacgacaaggaagaccgccctggcgaggccgatatcatcatggccaagcaccgtaacggcccgaccgaaaccttccacctcgccttcctcggtgccacgtccaaattcaaagacatgccgcaggactacaacgccaatcagggggtgtgatgatggcaagcaacgtttcacgcgatgtttcgcaagaccaatcgtccgtggtgcagacctgcaaaccgtggtatgcgttcgccaccgtggccgcaggccgcttcgtgcggtttgcatcccgcgtcaccaaacatggcggttcggctttgcccggcaaagtcgtagaaaagattgaccccggcttcctgacccgtacgctcgggcagttgccgcttggcgtggtattggtgtccggcacgaacggcaagaccaccaccacccgcatggtcgcctcgatgctctccgatctggggctgaaggtgttcaccaatccgaccggctcgaacttcgtgcgcggcgtggtctccgcactgcttaccgaagtcacgctcggcggcaaattggacgcggacatcgccgtgctcgagctcgatgaggcgtacgccgtccacttcgtcaagcaggtcaagccccgttatgcattgctgctgaacgtgatgcgcgatcagcttgaccgattcggtgaaatcgacaccacggccaaactgctcagccatgtggctgcggcgactaccggcactgtggtactgaaccgcgaggacccgcgtatcgccgcgctcgccgcgaaggccccggctggcaccaccgtgcgatacttcggcctcgccgacgatttgcgccactatttcccgtccgatgacgacatggccacgaccgtgtcggtggaaggtgtggccgggccgctcccctcagccagaactcctctcagtccgcgaagcgaactgagaggagcttccacaggcacggcagaacttcccgccgacgtgacacttaccgccgtgggcgaccacaaggccaccttccagatggacggtcagggctacgccaccgacgtcaagcttgaaggcgtctacaacctgtacaacgcggccgccgcgctcgctgtggtacgtgcggtgatgcaagacaatgccgccgcatccaaggccaccgccgcagccaacgcctgcgccgtgtccgccgacgagcttatcgccgccgtttcccgcgtcacgccggctttcggccgtggcgaggtcatcgacgtcaacggttccccggtcgaactgctgctggtcaagaacccgatgggcttccgcctctcgctcgccagcttcgacccggccaacgcggacaccatgatcgccatcaacgacgaatatgccgacggccgcgacatgagctggctgtgggacgtggacttcacttccctgcgcgcgtccggtgtcgccatggtctccggcgtgcgtgcctgggacatggcattgcgcctggggtatgaccaagtgccagtcgccgatacgaacaccgacctcgaacaggccgtcaccgcattcgtcaacgccaatcccggcacacgcaagcacatctactgcacctacaccgccatgctcaaaacccgcgccgtactgggccgcatcaccgaagtacgggacgcgggcgtgggcaagtaaccacccttcggcgctcgcgcgccacctcccgccagcggaaggggcatggtgagggaataagacgcttcccggcagcgggagaacatcgacaaggagaacgtgacatggccagaacaattgatgtggtgtccctgtatcccaaagacatgaacatctacggcgattccggcaacgtgctgactatccgccgccggctggaactgtacggttacgaaccggtcgttcaccagtacaatcaaggcgacgattggcccgaccaggtggaccttattctgggaggcggcggccaagacaccggccagaagaaaatcatcgacgacttctaccatcgcgccgacctgttgcgttcgcttgccgcagacggtacgccgatgctgatgatctgcggcctgtaccagctgttcggcgagtactttgaaaccgtggacggcacccgtctggacggcatcggcgttatcggtgcttataccgtgggccagaacgtgcgtatgatcggcaatcttgttgagcattccgaccagttcggcgatgtgattggctacgagaaccactccggccagaccttcctgcgcgaaggcgttcagccactcggcaccgtcgatcaggatggccgaggcaacaatggcgaagaccataccgagggcgcgcgcgtgcacaacgtgatcggcacctacatgcacggctcgttgctgcctaaaaaccccgccatcagcgatttccttatcgaaactgccgtgactcgtcgttacggtacgttcgatacgtccgatcagacccccgaacaagccaaggagcttgcccggctcgatcaagtagccaccaacgcgcgcaaggctgccgccgaacgtcctcggtgaattctcggtgagtcctcggtaagtaccaatcagcgaaaaatcagtcgaaatcagtctgagggtctagtacattgccctgttgtttgcgctaggcttggtggtacgagacatggcaccaggccatgtcggacctcgaaggaggggtatcatggctgattttgatcttctgggtgatggcctgcgcaaggtcctgctggcgggcatcggagcccttgccaccggatacgagaagagcagcgagctcgtcgacgaactcgtcaagaagggtgagattacggtcgagcagggcaaggcgctgaacaccgagctcaagcgcaaggtgagcgagacggtggatgacgccaagaaggccgccgccgaagccggcgacaaagctgctgccgcagccgacaccagtgccgccgacaagcccgctgacgagggcaaggccgagtgaccaagcccacacgcgctacgccggaatcagggtcgaccccgctttccagcagggtcgaccctattctgacgcctgcgaaagccgaacgtgaggcggcggcgaaccggtccgtcgacacgtcggacacgctcaagcagaccgttaccaaggcgactccgagcgtatccgacgaaacgctggcactgttcggacgcaggaacgatttcgccacgcgctaccatctgacgcgtcgtggcaagatcaaacgactggggcagatcaccagaatcgtcgagcaattcgacgtgctgcacggcctgactccggtcaaaatgcgcctcatgttcgaggcgctcggccccacgttcgtcaaagtgggccagattctgtcgatgcgctccgagattctgccgcaaagcttctgcgacgaactcgccaaactgcgcgccgacgccgacccgatgccgtattccacggtgttggatgtgcttgccgccgaatacgggcgtcccgccgacgaggtgttcgcgcatatcgaccccaagccgttgggctctgcttcactggcgcaagtgcatcgcgccacgctgaaaaccggcgaagatgtggccattaaagtgcagcgcccgggtgtgcgcgaaaccatggcccaggacgtctccatcatgcgctccatagccaaggccgccactaaggtgattcgcacctcacagatcgtggacctgaagggcgtggtcgaggagctgtgggacaccttcgaatcggagactgactttctgattgaggcccgcaacctcgccgaattcaagcgtttcgccgcccgattcaaatacatggactgcccgacggcgtacaccgaactgtgcaccgagcatgtggtggtcatggagtacatcgacggcatctccgtctcccacccgggccggctcgtcgatgctggttatgacttgaaggagatcggcaccaagctcgtcgacaattacgccacgcagattctcgacgacggcttcttccacgctgacccacatcccggcaatatcatcatccggggcggccagatcgtacttatcgacctcggtatgaccggtcggctcgaccagcgcacccgtgcagtcctcaaagaaatgattttcgccgtcgccaaacaggattcgcccgctctggccgaggggctgctgcgatttgccggcaccgaggccgatccggaggactacccagcactgctggctgatctggacgtgatcgtcaaggaattcggcactgtggatctggccgaactggacattgccgccttcctgaccgcactgacgcagatggccggccgccacaacatcgaggtgcccagtacggtgaccaccgtcggccgcgcgttggttacgctcgaaggcttgctggacgagttcattcctgatgtgaatatgatcgaaatcatttccgaccatatcgccacgtcgaaatcgctgaagaacgccaccaaagacgagatcaagtcgctgggcgttgagggacatcaggctttgcatgccacgctcggcaccatgaccgaactcaagaccgtggcccgtatgctgacccgtggtcagttgcgcgtcaacatggaactggtcggctctgaagagccgttccagctgctttcggatatggtgaatcgtctgacgatggccctgattgtggtcggtttgttcgttggctcgtcgattgtctactacgccggcatgaagccgattatcttcggcattccggtcatcggcttcatgggctacgtcgtggccttcgccctcggcgtatggatcgtcatcgacatctacttaaaggggcgcaaaaccaagaagcggtagggcatcgattgatatcagtccagcgggagggtggattcgcgctggataaggtggcagggtacgtagtcgacaccgtgatgcgggttgccgtcgatggcatcgaccaagtatcgtgccgcacgccgtccgatggtttcggtttcgttgtcgatcgacgtcagtgcgggcctcgagctggaggtcagtaccgaccagttatcgtggccgatgacggcgacgtcatccgggatgcgcagtccctgctgcttgagcacgtcaatgcagccgcgggccaactgatcgttctggcagaccactgcatcgaacttgaccccttggtcgagcagcaggcgggtggcggcgcggccccagccttcgtcccatttgccgtaacgaattgggccggcgggttcaatacctaattcggagagtgcctcgagcgcgcccttggtgcggtcggtggcagcggtataggtttcgtcgccgccgataatggcgatgtgccggcggccacacgagatgagatggttgatggccatgcggccggcgtccacgttgtcgcaagtgaccgagcagtctttggggtcggtggaggggccgtagacgtagaccagtggcacgccccagtcatggccaagcgtgggcctggggttggtctcgcactgcacgatgagcagtccgtcgaccttgagggacagcagtttctcgacatgctgacgttccaaggcggcgtcgccacgagcgttggccaacaatactgaggtcgattgggctcgcaactcgttctccgcgccgataagaatcggtgtggagaaacgaccctgcagatcggaggtgaccaggccgatagtgccggtggtgccgcgggctagggattgagcgagtttgttgggagagtagttgagttgcttggcggcatccagtacacgctgcttggtttcttcgctgatacggggtttgttgtgcagtgccttggatgcagtggccgtcgagactccggccaatgccgccacatcctcaagtcgcgctgcccgtccggttgctggctgggtcatcatgcctcgattccttggttcttcagcagtatatagcgcattgttttgcgatgaaatacctcatacggtgtggtgcgccattgcatctgggaataattgtagcttcaatgcgaaaactttcgcaaacatctttttttcggcgtggcgtagtcagggaaattgttcaagtgcaaggtaagtgaaagaaagcgttacttccatgttcgcttttgtttgatttgctcgacacgccggaataatcattgatattaagccaattcaagcacgttattcatagtcgaatcacagtctcgaacccgtttgatgtgagaaaaaacgcgaaaatgcgaaagcgcttttgcaaaaacttccatgttcgtttatattgagaaaaggctttcgcagtgttacctgctccgggcaaaggagcgagcagggcgaaaccaaggaggcggaccgtccgccaccgcctctcatagttgagcggatatatagagaaagaagcgaacatggtgtctttcaataaactgacccgtactcttgctggcatcgctgccgccgcgttgatcgttccgctggccgcctgtggtggctccggcaatggtggcactgccaccgccgaaggtatcccggccaagggcaccgacgatggtaccgagatcaccctgtggacccgttcccctctggagcgtcaggccaagaacgtggtcgaggcttacaacaagagccacaagaaccaggtcaagctcgagatcatcccgaacgacgatatggaaggcaaggtcggcggcgcttcgcagaccgactccctgcctgacatcctcgccggcgacgtggtccgtattccgtactgggcttccgagggcatcttcaccgacatcaccaagcaaatcgatggcctggacaacaaggccgacctgcagcagggccacatcgaagccggtactgttgacggcgccgagtacaccctgccgttcatcactgacgtttccgtgatggtctggaacaagaacctgtacaaggaagccggtctggacccggagcagggtccgaagagcatcgaccagttcgtcgagcaggccaagaaggtcgccgccctcaacaaggatggcgtcgcaggctcctacctcgccggtcagtccggtggtgctctggtcttcgacctcttcccgtccgtgtgggctgacggcgaatccgtcatgaacaaggatggctccgaggccaccctggacaacgactccatgaagggcgtcttggacgcttacaaggagctggccaacaccaccaacggcctgggtgcaggctccaaggaagagaccggcgccacctggaccgctccgttcgcgaacggcaagatcggtgtcatgccttacccgaacacctccaccactgctctgttcgatgctgagaaggacggcggcttcgaggtcggcgttgctccgatcccgggcaccaaggaaggcaagacctccacgttcctcggcggcgatgccatgggtatctccaaggactccaagcacgttgctcaggcctggaacttcctctactggctgatgcagtctgacgctcagaaggaagtcttcgctgaccaaggcgacaccgcctccaacatccagaccctgaagaccgcttacaaagacgctgacccacgcatccagaccatcaactccgtgattatcgacggcaacggccagaccccgaagtccccggccttcaacgaagccttcaacgccgctggctccccgtggcagctgctcgtgcagaacgccgtgtggggttccggtgacctcaaggccgacaacaaggccgtcaccgacgtcctgtctgcccagtgattcggtggtgatgctcctcaccatcactcatcaaatcacagcaataactgaataacaactgaacagattgagccggtccctcccttgtgagggcaggagccggctcaaccacataatcgaacttctatcttcttcttcattccttctcttccttcatcactacataccttatgaatgcggtgtgttggcggggcttcggagtcctccttcctcgaagccctgacatcggattgcattcggattccgtgattaccatttcacagtaatttcccaaaggagagagaaacatgtcgagtgtttccaagagcgccggggctgtgcccgtgcataagtccaaggcgaaggcggcgcagaccaggcgaggtctgctgtacgcacttccggactggctgatgattatcgtcctgttcttcgtgccgattgttctactggtcgtcatggcctgctctcgttggagcctgctgggtggcaaccgcggcgtgaacttcccggacaacttcgtcaaggtgttcgagaacaaattgttctggccctcgatttggttcacgctcgagtacaccgtgatcgtcacgatcttcctgttggtccttggcctgggcatggccatgatcgtgcaggagagctcgaagtggaacaacgtgctgcgtacctgcttcctgctgccgtccgcgacgggcctggcgtccgcgtccctgctgttctacgccctgtattccccgcaggtgggccctgtcaccaagattctgagctcgttgggcctgatgcaggagggtggttcggtgctggccactggccagtcggccctgtgggccacgattatcgtgattgtctggcgtttctcgggctactacatgctgctgatgatgatcggtctgcaggccatccccggtgatctgtacgaggcggcccgcatggacggcgccggttcctggcgtatcttccgctccatcaccctgccgctgatgaagccgaccatcgtgatgtgcctggtctactgcgtgaccggctcgatcctcgcgttcgatcagttcttcattctgaccaagggtggtccgaacaactccaccatgaccgtggtgcagctcatctacaacttcgccttcgattccaagaaggatctgggtatggccgcggcgctctcgctgatcgtgctggtggccctggtcatcatcaactccatccagatgcgcggcatgcgcgacaacaccaagtgagaaaggggaggtaacacattatgactaccccattgtggaagcgtatcatcgcccggatcctcgaggccctgctggccatcatcttcatcagcccgctggtctgggtcatcatctgctcgttcagcccgcaggccggttcggcccagtccaagggctggggcgtggccaactacctgaccctgttcggttatcaggaaggtctgcccaagtacctgttcaactcggtaatcgtgactctggtcgcggtcgtgttctccgtggtcgtctgtacgctggccggctactcgttctcccgcttcgactacccgggccgcaacctcggcttcatggtcaccctgtcgatcctgatggtaccgtacgcctcgctgctgatcccgctgatggtctggtacaagcagatcggcctgaacgacagcctgctgggcgtgggcctggtcatcaccctgttccagctgcctatgagcacgttcatcatgcgcaacgcgttcgacgcgatccccaaggacatggaggaggccgccatggtcgacggctgcaacagcctccaggccttgttcaagattctggtgccggtggtcaagccttcgatggttacggttggcctgctcgccttcctcgaggcatggaacaacttcatgattccgctgtacttgagctcttcgtccaagtccacgctgccgctggcgatggtgaacatgcgtcagcagaccatgggcgtcatcgattacggtgccaccgaggccggcgtcgtgatcctgctgattccctgcgccatcctgttcctcgcactccagaagtactacgtcaagggctttatggctggagccgtgaagggctgatcatgaacgttacaatcacttccccgttctggaagcggcgtcgcgaccagattgtcgaatccgtcatcccctaccagtggggcgtgatgaacgacgagatcgacaccacggtgcccgacgacccggccggcaaccagctggctgacagcaaaagccatgcggttgccaacctgaaggttgccgccggcgaattggacgacgaattccacggcatggtgttccaggattccgacgtctacaagtggcttgaggaagccgcctacgcattggcataccacccggatcccgagctcaaggcgctgtgcgaccgcacggtcgatctcatcgcccgcgctcagcagtcggacggctatttggacactccgtaccagatcaagtccggcgtatgggccgaccgcccgcgcttcagcctgattcagcagagccacgagatgtatgtgatgggtcactacatcgaggccgccgtcgcctaccatcaggtgaccggcaacgagcaggcccttgaagtcgccaagaagatggccgactgcctggatgccaacttcggccccgaagaaggcaagatccacggcgccgatggtcatcctgagatcgagctcgccctcgccaagctgtatgaagagaccggtgagaagcgttatctgacgctttcccagtatctcatcgacgtgcgcggtcaggatccgcagttctacgccaagcagctcaaggcgatgaacggcgacaacatcttccatgatctcggcttctacaagcccacctacttccaggccgccgaacctgtgcgcgaccagcagaccgcggatggccacgccgtgcgcgtcggctacctgtgcactggtgtggcccatgtgggccgactgctcggcgatcaggggctgatcgacactgccaagcgtttctggaagaacatcgtcacccgtcgcatgtatgtcaccggcgcgattggttccacccacgtgggcgagtcgttcacctacgactatgatctgccgaacgacacgatgtacggtgagacctgtgcttccgtggctatgagcatgttcgcccagcagatgctcgacctcgagcccaagggcgaatacgccgacgtgctggagaaggaactgttcaacggttccattgccggcatctcgctcgacggcaagcagtactactacgtcaatgcactggagaccacgcctgacggactggataacccggaccgccaccacgtgctctcccaccgcgtcgactggttcggctgcgcctgctgcccggccaacatcgcccgactcatcgcctccgtggaccgctacatctacaccgagcgcgacggcggcaagaccgtgctgagccaccagttcatcgccaacacagccgaattcgcttccggcctgacggtcgagcagcgttcgaacttcccgtgggatggccatgtggaatacacggtgagcctgcccgccagcgccactgacagctcggtccgtttcggactgcgcatccccggctggtcgcggggctcctacacgctgaccgtgaacggcaagcccgcagtgggctcactggaagacggcttcgtataccttgtggtcaacgccggcgatacgttggagattgcgctcgagctcgacatgtccgtcaagttcgtgcgcgccaactcccgcgtgcgctccgacgccggccaggtggccgttatgcgcggtccgctggtctactgcgccgaacaggtcgataatcccggtgatttgtggaactatcgtctggccgatggcgtcaccggtgcggatgccgctgtggctttccaggccgacttgctgggtggagtcgataccgttgatttgccggcagtgcgcgagcacgccgacgaggatgacgcgccgctgtacgtggatgccgacgaaccgcgtgcgggcgaacccgcgacgctgcgcttggtgccgtactactcgtgggccaaccgcgagataggcgagatgcgtgtcttccagcgtcgataaatatcggcgatatgccggcctgcgcgcaactggccggcaaaaaaatacttatgccgccatcgtctgtaataagtcgatgacggcataggccggatgtcagtatcgattggagccgaaaacacatccggggaatgaggtctcctgtgcggggtaatacccgtgcaggagattattttttaattatatgctcctgctgtgagagctgtcggcggagtcgactgagggtggtcataagcggtaccgtgtaagccaccctcagtctcgctttgcgagccagctcccgccagcgggagcctgttggttcctgattcagcgaggctgaatcggcgcgccgtaggtactgcgacacggcgaaacgcagcaatgctctaatgcgaaagtaaatgcgaaaactgagaaattgccgggtttttgttgtgtaagatggttgatatcgctgagggaaagttgcgaaaccgtattcgctcggttatgatgtggaatcagcttcggtgaattgctccaaccgtgatatccatggcggatatcacaccagattcactgaagatactcattccggtgaacccaatagccaataaaggaaactgacggagaacgggctctgcggcccagcatccacagaagaagtcctggtcgcatagatgcgacgtagcctgagcgaagacgcgaaagaccggggcggagaggtccaagcaggaatgcatcactcaacacgaaagcggtggcttgcgtcaatcggcgcggttgcagcggtcgccacactggccaccggcggtgcagtcaccgcgcaggcagccgatgcgcccgtcatcaagaatgcggatgtggcatatccgtcgttcaagggatctgatgatccgatgaagacggcggcgaacaacaccacatataaccctgccgtcagctatctgcaggagacattcgataacgacgtgaagaacctggccggcatcgacaccgaccatgacttctggatcgataagattctcacccgtactggtgcacagccaactggtaaaggcacgaacgacaagggtgcttactcgtatgaaggctccgacggcaacaactacctgttcacccgtggtcgcgccgcctacatgtacacgcacacgcctaatcagctcggttttgtgggtgataccgcctactgggaccagaccagcaggagcggcttcaccgttaccgtaaacgctgatggatcaaaccagacccttaacgaagacgcctcccagcgcaagcagacgccgagctacttcacctccctgttccagaccggtggcaagagcctcaagatcaaggaagtcaagtacatcacctacaacaacgtgatggttgcgaacctcaccgtggaaagcacgcaggaccgcgatgtcacactgaccacggcctcgccgttcgccgccgagggtgctgatggtgccaccgaacttactggccgcgtgaacgtcaagaacaacctgacgaccatctatccgcgcttctccgccaacaaccaggacggttccaactggatcgtcagcggtggcaaactcaccagcacgttgagcctcaaggccaacgaaccgcagaccgtcaagattcagctcggcctgatcgccaacgaactgcctgactccaccaaggaatatgaggcccgttacaccggcgaccttaaggatgctgccgcctcctacaaggattccgtgaccacctacaacaagtggtgggtcgataacgctccctacgtggacactccggaagacaatatcgataagaccgtggtctaccgctggtggctgagccgtttcaacatgctcgacgccaacatgcctggcaacaccttccagtacccgacctccatcgagggtgtgctcggctacaacaaccaaatcgtgctcacctccggcatgttcatgatggacaccaagtggttccgcaaccccgagtactcctacggcacctggctttccgccggcgataccgccaagaagagcaaggcgggctattactactaccacgacaatccgggcgacccggccaactggaaccatagctacacgcagtacatcacgcgcgccggctgggactcctacaaggtgcacggcggtccgtccaccgtggccgaggagctggccgaccagggtgccgaggacgtgcaaggtctactcgcttccaagagcgagccggacaacaacgacaaccagaacaacaatgacaacagcttgattgactggtcctggtggtcgatgaccggtaacgatgccgacgccgtttccttctctgagccgggtcgctccggccagcgcatggatcgcgccgatggttccgccaatatgtgggccaacgctaacgcggctgctcaggcatacaaggctgctggcgataccgccaacgccgagaagatgcaggccatcgccgacaagatccagaaagaagtcaccactgaactgtgggacaagtccgacaacctgctcaagcacaagtggctgaacgacggtgctttcgccaagtacaaggagatcaataactactacccgtactccgaaggcctgatgcctaccggcaacgaagattacaacaaggctctgcgcctgttcgaggattccaacgagttcccgatcttcccgttcttcaccgccaaccaggcggacaaggcggcgctgaacttccccggttccaacaacttctccattatcaacgcacagccgctgctgcaggtctattcagccggcatccgcaattacgatgcagccaagaatggctacatcaccaatgagcagttcaagaagctgctgtactgggtggcgttcgcgcactaccagggcggcgataacaactaccctgatcaaaacgagttctggaacgaggacaacaacaacgtcggcgatgtaaacggtgacggcgtgatcaacaacctcgacaagaaccttgacgccgcacagaacggcggcaagatcacctaccgctcctggatccaccacacccagctcggcaccacgaactggacgatggtcgaggacgtagccggtatggtgccgcgcgaggacaacaagattgagctaaacccgatcgaaatccccggttggaactacttcacggtaaacaacctgcgctaccacgatcaggatgtctccatcgtatgggacaaggacggcagccactacggtggtcctgctggctacagcctgtacgtgggcggcaagctcgccttcacctccgacaagctggcgcacctcatctatgacccggctgcgggaacggtcgaggtcaaggacgattccagtgcccaggttaccgtcggcgccgaagccgtcaagaacgtgaaggccgccaatcaggttaccttcaatgccgatcagcgcgtgaccgacctgttcgccaagtccggcaccaacgtcgactccgcctccaagtccaccacgaacgtggccaaggacgcggacgtgaccggtaccacctacgccgagaaggacaccaactacccggccaagaacgcggtggacggcaagaccgtgatggaatcgttctggggtaccaagggctctgagaacaagaccgacacgctcaatatcaagttcaaggacggcaagcagaagatcgacgacatccgcttgtacttctaccagagctcgtccagccagaccatctccggctatgccgagcccgccaactacaagttggagtaccagaaggatgacggcacatgggccccgattgcggatcaggtgcgcaccccgaactacgcgggcgcgaactacaaccgtatccagttcactccggtggagaccacgaccatccgcgtcaccttcacgccgcaggccggcatggccgtcggtgtcaaggagatcgaagcctacaacaccggtatcaaggctgacggcacttccgagaaccagactccgcaggtggatgcttacgtgtcttccagcacctcatctggtgccaagctcgtcggtacggtgaaggatgacggtctgcccgcagaaggcgacgtcaccaccacatggtcccaggtctccggtccggaaggcggtactgcgaagttcgtggacgcctccgctgccagcaccaccgtcaccttcaacaaggagggtgactacgtcctgaagctcaccgcttccgatggcgagaaggaaggctccaaggaaatcaccgttcacggcatcccctctgacggtaccgtgaacgtagccccgcagtcgagcgcctctgccagctacaccaacggctaccagccgaaggacaacgccaagaaggtcatcgacggtcaggtggtatacgccaacacgccgaacgagacctggaacaactggggcgactccactggtgtggagccgtggctgcaactgaagtgggccggcaaggtgccgctgaagaaggccaaggtcttcttctggaccgatggcggtggcgtgccgatggtctcatcttggaagctccagtacgctgacgctgacggtaactggcaggatgtgaaactggctgacggccagtcctacacggtcaaccggaacgaaggcaacgaagtgaagttcgccgacgccgtcgaaaccgacaagctgcgcgtggtcttcccgaagggcgccatcgtgggtgcttccgagttcgaggcgtacgccatcgagccggtgagcgtggacgaagtcaaccgactggtgcagaccggttccaaggctgatgatctgaagctgccatccaccgtgagcgccgtatacaccgacggttctcgccgtgacctcgccgtcacgtggggtaaggtgaccgacgctcagctggccgccgatgccgtattcgatgtcaagggcaccgtcgccggtgcgctgaacggtacggttgcacacatcgcggctcgttccgataccgcatcgcagaccgtgggtaatgcgcagccggttgagcagaccgtctaccagaacgccaagtccatcgacctgcccgccacggttccggtgaagttcccgaacggatacaacgacgaccgcaaggtcacgtggaaggatgccgacatcaaggccatcgacctgaccaaggttggtgactacgaggtggctggtaccgtcgacgacggttcatcttccgcagctgccaagctcactgtccacgtggttgccgacccgaacggttcctccactccggagcctgagcctgagccgttggtcggttggattgaaggcaaggcgaccaggaccaccatttcgcctgattccgaggcgacctggtcaccggccgaaggcaagctcaacgacggcgtagtcgtcgatgatacttggccgaccacggatgatcagaacgtcaacgacaaggtctggggttcttggggcaaggcaaaggacggcatgtacgcccagtacgacttcggtcagtccgtgaccattgaccagagccgcgcccagttctgggccaacttcgctgagactgacgattcgaagggtggtctggaagtcccggacgcttggaagattcagtacctcgccgaggatggttcttggaaggacgtcgagcccaccgaggattacaccgtcgtgcgtaattcgccggcttctcgtgcggataccgatgccaagggttggagcgctgtgaccttcaagccggtcaccaccaagtcgctgcgactcgtgctcactccgtacaccggcagcagcaccttcggggccgccgtggccgagtggggcgtgcatggtattgacggcaccgagcctgaacctaccccggtcgacaagaccgcgctcgagtcggctcttgacacagccaacggcctcgatgcaagccgctacaccgccgcttcatgggctgagttccagcaaatcattgacgctgcccaggctgtgtacgacgatgccaacgccaccgcagaacaggtcgccgagcaggtgaccaagctcgaggacggccagaaggcactcgttgcgctcgccaccgacgtggagaagtccacgttgcaggcggccatcgatgcggccaaagccgaggccgcttccggcaagtacacggataagagtgtcgaggccttgaacaaggccatcgaggctgcggaaggtgtgctcaaggtcggtgaggtcggtgaggtcactcaggccgccgtccaggaagcgtccgcttcgctgaacaaggccgtcaaggccttggaagagaagcccgccgccgaaacggtgaagaaggagtccctcgaggcttccatcgagcaggccaagaaggctgacaagtcgaagtacaccgaggaggcatggcaggctctgcagagccagattgccgccgctcagaaggtgtacgacgacaaggatgccaagcaggccgatgtcgatgccgcacaggatgcccttgacaaggcattttgggccaccaaggttgagcagaagcccggctcccagcagcctggtgtgaccgacactgataaggatgataaggacaacaagggtgatcgtgtgcctccgactggtgccgcggtttccgtagttgctgcggctgccgtgctgctcaccgccgcaggcgtgaccatcctgaagcgtcgccagtccggcgaccacggttcggctcgccactcggcctgacccgcaacggagtcattctgccgagtgagccccctcacagagggggctctagccttttccttctacccatcattactcttttcactcactcaatgaggagcactatgagtttccatgtatccgcgcaatcggttcgcgcggtggccggtggactcgtcgccgcagcgacattgctgtcaggccttgcccttgcgccgaccgcaatggccgccgattcagccaccgctgacaacgcgcccagcgttgccggtcacgcgtataacgaactgccgtataacaatcctgatgtcaccgtcacccaaatcgacaatagcgcactgcccagctacatgcgcaaccccatcgggcagaacgagggtattgacaccccgaacgatctttcgcagaactactactctgcagatgcatccgcgctgagctatgacggcaaactcttcgtcttcaccggtcacgatgaggcttcgcccgactacggctccttcaacatgaaggactggggcgtatacgtcaccgatgaagacggcctgaatcaaggcaaatggacacattacaagaccatcgccaaggcaggcctgttcagctgggccaccggcgatggcgcgtacgccggccaagtcgtagccgacgataacggcaccccgagcgacacttccgatgattggttctactactacgtgccggtgaaggacaaggcttctgaggcggctggacaggacccgttcgccatcggcgtggccaagtcgaagagtccgctcggcccgtggaaggatgccatcggcaagccgctgctcaccacatcgcaaacccagattgaaaccatcgatccggcattctttgtggacgaggatggcaccggatatttgcactttggtacgttcggcactcagctcgccatcaagatgaagaaggacgccacaaccggccgcacctcatacaccgaggtggaaaccaaggctgatggcaccacgccgaacctccacaccatgaaggacgcggacagcaacgcgaacggcccgaagggattcttcgaggcggcgtgggtgttccgtaagggcgatacctattacaacgtgtacgacggcggtaagcccggttcgggcacggccacctgcgtggaatcgaactatcaagcttgcatccagtactccacttccgacagcccgctcggcccatggaagtaccaaggcgtaatcgtgccttctggctcggccaccacgatgcacccctcggtgctccagttcggcgacaaatggtatgtgacctatcacaccggcgacaaggaaggcggcaccgatttccgccgtgccgtgtgcattgatgaagtcgattggaccgccgacggccagatggtttccaccgcccatccaaccaaggccgagaaaacgcagccctccaccaacgtggctccgtacgcaaaggtgagcgccacgttcactgaaacgcctgcttggaagggttcggtgaacgacggccgtgtgttgcaaaccgctgtggtcccgccgaatcactggaccaactaccgttctatcccgcaatcgcagtccggcgattctctggtctaccaatgggatggcactgtgcgcgtcaactcgtctaaggtttggttcgacgtggattccaacgctctgcgcgcgcccgcctcgtggaagattcagtacttggacgcggacggcacatggaaggatgtcaccaacccgagtgcctatacaacgaccacaggcaaggccaaccccaacgccgtcaccttcgatgcggtgaccactactgccttaaagctcgacatgaccggtcaagctgtggatggcggctatgcctccgtggccgttgctgaatgggaagtcggctccgactccagcgaatcgccggcaatcactgcgccgaagagcgtgaccaccgccaccggtactgcgcctactctgccggccacagtggatgtgaagtacgggaacccaaccgttgcctccccagtaatttggcgtccagttgatgcttcctcgtatgccaaggtcggttcgtttacggcctacggcgtggtcgccggcgtgcccggtgaggcaagcgagcagggcaatgtgtcggtaaatgtcaccgtgcaggacggctaccagcctgccgctgataccacgaagccgactgtaaccgttgccgttactgctaacgcaggcaatagcgagtggctcaccaccgctccgttcgccaccgtgcaggccacggacgacaccgcacctatcgccaagctggagatttccgctgatcaaggcaagagctggaccaccatcgacgcgaatgcaaacgcggccattgccacgctttcccagcagggcgatgtcgaagtgtgggctcgcgccaccgatcaggccggcaacgtttccgacgtggccaaggccggcggcaaggtggactccgccgcgccaaccgtgaccgccgccgccgataaggaggagcgcacgctgaccttgaccgctgatgacggcaccggttccggtgtcgcatcaattgaataccgcattggcacagacggtcaatgggccacgtacagcaagccgattgctgcaccgagcgcgtcgcgcgccaccgtgtactaccgcgccaccgataaggccggcaacgtgtccgcttcggcgaaaaccgacattccatccgacacttccgtgccgctgaccggctacattgagggcgatgccaccgccaccgatgtggacggcaaggcatccggctgggtcaagggtgccgccgcgttgaacgacggcaagatcattcccgatatcaccattgccaacgaggatgtctggggcacttggcccaacaccggtgagatgcgcctcgactacgagtgggaccgtgaagtgactatcgactctagccgcgtgcaattcacctcggatgatggcggattgggtattccggcatcgtgggaattgcagtactgggacgccttggcgaacaacggtgccggcaacttcgtggatattcccgacgccacctacactgtgaccgccaattcaccgtctgctggctgggccaccggcgatgccaaggggtggtctgatggcacgtggaacactccggtcaagactaccaagttgcgtatggttatcacgtccggctcggcttctccggctgttgccgaatggcaggttcatgccattgacgacagtacgcctgagccgcctgagcccacaccgatcgacaagaccgagctcaagcaggcgctcgctgactcgcctaaggctgacgatgcctccaagtacaccgagacttcatgggcggagtacgcggcggtattggattcggcgcagcaggtgtataaggctgaggatgccaccgaagctgcggtggtggatgccgcaacccagctgaagcaggcagcgaagaagctggtgcttgtagctacggtgcaagatcgtgccgcgctgagcgctcagctcgatgccgctgctgccgtggatcgcacaaagtggactgatgaatcgctggccgtgcttgattcggcagtcgctatggcgaatgcgctgacgagtgatggtcaggccgcccagtctgacgtacaggctgcgactgaggcaatcagcgatgccatcgcgggtctggttgagaagagcaccacgaagcctggccagggtggcgataagcccggttccggcacggacaagcccaaccaaggcaacgattccaaccagaacaagggtgatgcagactccggcaagcacaagaagatacctgacaccggtgcagccgtgcttggtgttggcatcctcgccgtggtacttgctgttgcgggtgtaatcatcctcaagcgccgcaagtccggtacctgctagtcccactcgctcggcctagcatcaccaagcccccgcgcatgaacagcgggggcttcacttttgttcaataacaagcattatgtgcgcgtatgagactacgatggtggggaatctacgaacaggggcagcaatgacggcatacatggaccataaggatctcgccaacgaagttatcgatcaggcgcgcgcacaagagattactgatggtgtgcatcgcgtgcttgaccggattgcctcagcggagtccgcagccgggcgtgctgccggttcggtccaattgctggctgccaccaagacgcgcgatgtcggcgagattctggcggctatcgatgctggtattcgcgtgattggtgagaatcgtccacaggagattactgtcaaggctgacggtctggcaaaacgactgggggagcgtggttattcgctaggcgtgattgatgccgctgaggctgacacggccaatgccgcagctgcaacgcatattcctttccatctcatcggccaattgcaagccaataaaatcggcaaggtgctgccggtagtggacaccatcgaatccgtggattccatcgaactggcggaaaagatcgcccgccgtgccaccatgcgcggcatcacggtcggcgtgttgctggaggtgaacgaatccggcgaggaatcgaagtccggctgtgcgcccagccacgccatcgacttggcccagcgcatcggtgcgatgggcggactgcgcttgcagggattgatgaccattggcgcccatgtggatgatgagcgcacgattcgtgcgggcttcgcgcatctgcgccgcacgcgcgaccagattattgcctccggtgccgaaggcacggccgactgcaccgaactgtccatgggcatgacccacgacatgacctacgccatcgaagaaggctccaccatcgtgcgcgtcggcaccgccatcttcggcgagcgcgccttcatctgattggagctatacgaaaaaacgccgcttgatcaatagccaagcggcgttttttcgtaaggattttcggcgtatcaatcacgcatagatattgcgcggacgcatgtcctcgggcaggccgtcgagcagaatcgccacggaaccttcctcgaacacggagcgaatacccgcggccagcagcggtgcgcaagacagtacggtcatattcggcaggcgcttctcttcgggaatcggcacggtgtccataaacacgatttcatgcgcgccgcagtgagacaggcgctccacggccgggccggagagcaggccatgggtggcgaccagcgtcaccgacttggcgccggattcgttcagggtgcgcacggcttcgcagatagtaccggcggtatcgaccatgtcgtcgatgaccacgcagtcgcggccgtcgacatcgccgataatgccatgtgcctcggcatggttcggacgagtaatatcacgctgtttgtggatgaatgccagcggcagattgcctagcttggcggcccactgttcggacaccttgatacggccggcatccggggacacgatggtggtgttgcccagatcaagggtggaacgcacgtaatcgagcagcaccggcatggcggttagatgatcgaccggaccatcgaagaaaccctgctcctgagcggcgtgcagatcgaccgtcataatgcggtctgcaccggcggcgtggaacagatcgaaaatcagacgggcggtgatgggctcacgaccgcggtgcttcttatcctggcgcgagtagccgaggaagggcgccaccacggtaatcgacttggcggaggcgcgcttcaaagcgtcgatcatgatgagctgttccatgatccacttgttgatatcgcccgaatgacactgcagcacgaacacgtccgcaccacgcaccggttcggtgaaacgcacgtacatctcgccattggcaaagtcataggacgtggtttcgaggatttcggttcccaaacattcggccaccttctcagctagctcggggtaggcgcggcccgtgaccaatacgagtcgtttatccggagtgccttcaagaatcgccgacatgcgttcgcatcctttgtttgagtcgctgtgtgatttacgccttaaccagtgtacaagcaccccgccgcagcgaacgccacggcggggtgcttatttcgtaagagtgttgagattgccgaaattactcggagaactcgacactgaccttattgtctttgatggtgaagttgccgttgacctccttgccttcaagcgtgtacgtcagctgggcgctcacggtgccatcggcattattggaggtctgcgagatgcgcgcgttggtgatgcgcgtgttctcgcccgaggatgccttgctggtcagcagtgcgcgctggttcgtattcacgtgaggatcggcgatggtgttggccttgtcgtagttgccggaggagatggcggccacatagctgttcgcaacgctcttcgcgctgaacacggcggaagacagcacgccatacacgataccgaacagcacgaggaagccggccacggcaccaacgatgatgaagattttcttctgttgctcattcatggtggtggaggtcgcgccaggtgcggctaccggtgccgctccgggagtgatgggagccgcgggctgcgtgggcttggccaaaacggtggacatcgcgaaaccggcaagaatatgggcataccctgtcccgcctcatatatagactgtccaagttgcccgaagaggcggtgccggtttggtgctgcgtcatgggctaacacgcatacacactcctgccacggaacgtccgtggccgaatagtccgaaggaggtgggtgatgtctgcgcacaagtacgaactgatgttcatcgccgatcctgagctggatgagcgcggtctgaagaagctgaccgagcagtatctggaactcgtcaccaaggaaggcggctctttcgatgagcccgattactggggccgtcgcaagctcgcctatgagattgccggtaagaccgaaggcaactacgtcgtggtgaagtacaccgccgagcccgctaccagcgatgagcttgaccgtgttctgaacctcaacgaatccgtgatccgtacgaagattcttcgtaagggctgaatcaagcgtttagtcagctgaacagctggtattcaaggtaagtaagaaggaccgttatggcaggtgaaaccgtcatcaccatcgtgggcaacctcactgcggaccccgagctgcgcactattggcagcggtgcgaccgtggcgagcttcacgattgcttccaccccgcgaacctggaatcgtcagaccaaccagttcgaggatggtcaggcgctgttcatgaggtgctccgcttggcgtgatctggccgaccactgcgcccagtccctgaagaagggcatgcgcgtgattgccaccggtcgcctccagcagcgttcctatcaggcacaggatggttcccagcgaaccgtcgtggagatgcagctcgatgaaatcgggccctccctgcgctacgccaccgcacaggtgactcgccagtcgtccggtcagggcggcttccagggtcgttccggtggtttccagggtggtcagcagcccaatcagggctatggcaaccagggtggccaaggtggttatgccggtggccagggcggttacaacggtggctatcagggtggtggcgctggatactcccagcagtctgccgctcccgccaacccgtccgctcctgcggtcgacccgtggagtaatgccggtgcatctgatgccggtagcttctccacgttcggcgcttcctccgatttcggcggcgacgattccgacccggagttctgatcagtacttgcctccccgctgccagcagcaatcaatatcaagatttataaggagaacatcatgtcacgtaagaggccgcaaccgccggtcaagccgttcaagaagaagccgaacccgctgaaggccgccaaggtcaccgagatcgattacaaggacgttgcgctgctgcgtaagttcatttccgatcgcggcaagatccgttcccgtcgtatcaccggcgtgaccgtgcaggagcagcgtgagctgtccaaggcgatcaagaacgcccgcgagatggccctgctgccgtacgccacctcgggtcgctgagttagggaggctttgaacaatggctgaaaccaaggttattctcaccaagaccgtgtccaacctgggccattccggtgacgttgtcgacgtgaagtccggctacgcccgcaactacctgttcccgcagggcctcgctttcgcgtggaccaagggcgctgaggctcagatcgtcgctatgaagcgcgctcgtctggccaaggccgtcgctacccgcgaggacgccgtcgccgctaaggccgccatcgagggcactaccgtcgagatcgccgccaaggtgtccgagtccggcaagctgttcggtggtatctccaacgaggccatcgccgtcgctctgtccgacaaggctgcggtgaacccgaaggccatcgaggtcgagaccatcaagaccaccggcgatttccccgccaaggtggccctccacccggagatcaccgcttccttcttcgtgaaggtcgtggccgagtgagtcattccggcctagtgctggaatcacacagaccaagagtctgagcttaagcatcatccccgtgcggtttgcgccgcatgggggatttttgtattagcaaaaacgccggaaataggcgcgacacgccgagagttgcattcgcttcaaatctgagtatatttatcacctgttgcaaggaatacttcaacatctaaccaagcccctgtagctcagttggttagagcagctgactcttaatcagcgtgtccagggttcgaatccctgcgggggcacagacaaccggaatcgaaagattccggttttttgttttttccagtatcagtccgtagctggtgcggaaaggccgtcttcgcgcgtgacggccggacgtgtaaggagcaacgtcatgcctcagatattcacgttcaccgtatccgaccccgaaggcatgcacgcccgcccggctggccggttggttgccaaagcgcaggaatatgaatcgagcatcaccgttgcctacggtggaaaatccgtggatgccaagcgtatcttcggtgttatgggacttgatgttcaacaaggtgacgaggttacggttcgggtgcagggcaacgatgaagctgtcgctgctgcagagttcgagcgattcctcaaggagcacctgtaatgagaacgatacagggcgtcagcgtatccgctggcattgctatcggcacggtccgcgtgctcgccgccgtagattatgccgtagaacgccgcttaatcgacgacccgcaggccgagatggatcgattccgcgcggcccgtgacacggccgtcgctcagctcaagcaactgcgtgacaacgtcgccgctgagttcggcgaaaacaaggccgaactgttcgacgcccatcggcttatgctccaggacccggactatgcggaatgcgtcgaaggtttgattgcgcaagacaaggtgaacgccgaattcgcggtgaagagcgccgccgaacagttcgccgccatgttcgctgcgatggatagctcgaccatgcaggctcgagccgctgatgtcaaggatgtttctcgccgcgtgatgaacgtgctgcaaggcaaacgcgatagcacggcgcaggatggcagtgtacaaggcgatgctgtgcagaacggtattgtgcagaacgggatcgcgcagaacggcgaaagccacatcatcttcgccgaagatcttgctcccagcgataccgcgcagctcgaccgcgctaaggttttgggcctcgtgaccgccaagggctcagcgaactcgcacaccgcgattctggcgcgcacgatgggcctgcccgccatcacaggtatcggcgacgcctttgacccggccgatgatggtcacgttgccgtaatcgacggcaccagcggtgcggtattcgtcgacccggacgaggccacgctgaccgaataccggcgcaggaaggccgaggctgaggagcacctaagcctcctgcggaagctcaagggcaagcccaccgaaaccaagtccggtcagcgggtccacctgtacgccaacatcagccgtccctctgacgcagccgccgtgctggccaacgatgctgagggcatcggcttgttccgcagtgagttcctgtatctggaacgcgaggactggccgaccgaggaatttcagttcgatgcatacggacaagtcgcacaggagatgggcgaccgtccggtcatcatccgtacgctcgacatcggcgcggacaaacaggtcgactacttcaatctgagccacgaggataatcccgcgcttggttaccgggcaatccgcatctgcctgacccgcccggagattttcaaagtccagttacgcgcattattgcgcgcctcagcatacggcaacatcgccattatgctgcccatgatcacctctgtgcaggaggtacgcgacgccaagcggattcttgaagaagccaaaagcgagctgcgcggcgagcgcatcgacttcaacgagagtatccagatcggcgttatgattgagacgcctgcgtcggtcattatggccgacgagctggccgccgaagtcgatttcttctccatcggcaccaacgacctgacccagtacacgctggcctgtgaccgtcagaacccgagtctcgaacgctttgccgacccgcattcaccagctgtgctgcgcatgatccagatgactatcgaggctgcccatcgtcatggcatctggtgcggcatctgcggcgagcttggcgcagacttgagcctgaccgatacgttcctgcgcctaggaatcgacgaactgtccgtctcgcccaccagcgtcctgcccctgcgcaacgtcattcgcaaccactgagattcaaggtcgcttcggctgattccgatggctttttgggcattgcattcggctggacattcgacatcgcatcttgccggcatttcgtcgtggggcaaagtgtacaatcaccacgtttgctttcgcgcccagcgtaaatcgcgtcgccggctccgcgaacggatttccagtcacacagaatgccgtgaacagtcagccatgcctgttgcgcggcgaagagaaaagaagaagcagtggattatcctctctttaccaagctggccgccgagttcttcggcaccgccattctgatgatcttcggcaacggctccgtggccaacgttgagctcaagaacaccaagggccaccacgccggctggctgaacatcgccatgggctacggcttcggcgtcatgttcccggtgctcatgttcggtagcgtctccggcgcgcacatcaacccggccatgaccatcgcccaggccgtcaacggcctgttcccgtggagcgacgtgctgccgtacatcgtcgcccagctgctcggcgccctgctcggccagctcatcgtctacatcacttactacccgcactacaaggagaccgaggacgccgaggcgattctgggcaccttctgcaccactgacgcggacaaccagaaggtcaactacttcctcaacgagatgttcggcaccctggtgctcgtcttcggcgccctgtgctgcctgtccctggcttggggcaagcaggattacgccgccgcctccatcgtcgtcggcttcattgtgtggggcctcgtgacctccatgggtggcccgaccggccctggcctgaacccggcccgcgacctcatgccgcgtctgctgcacgccatcctgccgatcccgcacaagggctcctcccgctggggcgaggcctggatcccggttgtggccccgattgtcggcgccattatcggcgcttggctgttcgtgttcttcttcgccagctgattcgttgattgattcatatatgcaaatggcctccgctcgttttgggcggaggccattgtcgttgaatcaggtaaacgcagagactactgctccaggaacacctgcggggccttcatgaagttcgtggcacagtgttcgccgcagaagtaataggacttgccctcatactcgcgcgtgatcgcatcggcgttcacagccacggtcatgccgcacaccgggtcggtggcggtttcgccgtccgcaggggcggtgtggtgcatgtgcattcccgtatccatagtgttctccttgttggttggattattggattggtcagatacgtgattggtttgattcagcgtggtgcgatcgtcgatgatgacggtcggctcgtgaggcgcgttggatgtggcggagccggtgatgttggcggcgttggcggattcggccgatccggctgattcgacatccgccgtgctgctgcccgaaccggcgggaccatcggcagcacccacgttgatgttcgctccatgcagccggttcgcgttcagcaccaggcacactgagctcaacgccatcgccagacccgcgatcatcgggctcaacagccagccggtgaacgggtagagtacgccggcggccaccggaatgccgatgacgttgtagccgaacgcccaccccagattctcgcggatgttgcgcatcgtggcattggacaggttgatggtcttgatgacgccgcgcaagtcgccgctcatcaaggtcacgtccgccgactgcatcgccacgtccgtgccggtgccgatggcgatgccgagatccgcctgagccagcgcgggggcgtcgttgatgccgtcgcccaccatcgcaatcagagtgcgggattgtgcggccgtgcgggaggtgccgtacgcggacttggcggcggcctcgtcgcgttcgcgctgcagtttggcgatccagtaggccttgccgtccggcttgacctcgcagatcaccgtatcgatgccgacttcgcgggcgatgcgcccggctacctcggccttgtcgcccgacagcatcaccgtgcggatgccgcgtgcgcgcaacgccgcgacggcctcacgcgagccttccttgactgtgtcctgctcgtagctcggcttgtcccagtcggcggccgcgtccaccacgccgcgcgtgatggtgccggtcttgtcgaacaccacggtgccgatgcgacgcgcctgttccagcgccttggcactggtgaccagcacgccgttggtggcgcccaagcccagcgagaccgtcaccgacagcggcgtggccagtcccagcgcgcacgggcaggcgatgatcagcacactgaccgcagtgaccagcgcgtgcgccagttgcggcgccgggcccagtgacacccagatggcgaacgtccagatggcgatgatcatcaccgccggtacgaaataccgggcgatcttatcggccagttgctgcaccggcgccttggtcgcctgggcgcgggccaccatcgccgcgatctgcgagagtaccgtgtccgcgccgacttgggtggcgcgcatcacgcagtcgcccttgagcagcacggtggccccggtcaccgggtcgcctgcggttttggagaccggcttggattcgccggtgatcatcgattcgtcgatacgcgcctcgccggccacgatcacgccgtccgtgggcacgcgctcgccgttcttgacgatcagcaggtcgccggtgacgatggcgtcgatgtcggtgtccgtgaaatgcgccggattacgccattcgatgccgtccacattgtctgcggaagtggcgttgagcttgtgcgcggtgcgcgggcgcagtctgataagcgactgcaccgccttgccggtgccttcgcgggccttggcctccagcaggcggccgaccagcaccagggtgatgaccacgccgaccgattcgaaatacggctcgcgcgagccctccgggaacacccacggggcgatgcaggtcaccagcgaatacaggtaggcggccgaagtgcccagcgagaccagcgagttcatgtcgggggagcggtgcgccagcgcggggaagccgaccgtgtggatcggacgcccgcagtagaacatcaccggcgtgatgagaatggcctgcagccacgggttcaccatccaatgcggcaccagcgcgggattggccatatgcagcatggtgacggcgaataccggcaacgtcagtaccgcgcccacaatcaccagcttcgtcagcgccttgatctcattggcgcgttcagccgcctctcgccgctcggcctccgccgcatccacaaccggagctccaacccgcaagtctgagggagagaccccctcggcttcggccgagccgtcagcacgcgggcgaagcccgtccttatccgcaccgtccttactctcctctccctcaaccctcaacaacccatgcaccatattcatgccgcatgcaaacggatattcgcccgccggcaacgccggtagttccacgtcggtggtggcgttgcccggcagcatggcgtcaagccccagatccgcgaacaccacatgcgaagtgcattcgccggtctcctgtcgatcgaaagtcagcgtgatcggcgtacccgtgcgcatgctgatcacggcgggggagtacccgcccttgacggtgattgttgcggattggcgttcgccggaggcgtccatggccccggccgtggctttctgcgttccgaagaagaaccgcagtaccagccatgtcaatgcggccgccgctatcagcgccgtggcggccgagaagatgctgagctccataaccgttccttccccttgtttgttgtactgaacaacagtgtataccctatacccctagagggtatataatggggtgtgttcagctgacggataagtatcagggggtttgcgatgcatggttatgacgaagacaaggccaaggtcatcgcacgattgcgccgtatcgaaggacaggtgcgtgccatcacgcagatggtggaggatgacaaatactgcatcgatatcctgacgcagatttcggcgtcgaattcggcgctgaaatccgtggcgttattgctgctggacgatcatctcaaccattgcgtgcggcaggcgtcgattcagggcggcgaggtggccgatgaaaaacttgcggaggcttccgcggccattgcgcgtctcgtcaaatcgtgacgagttttaccgtcattcaccatcgatgacatactgggtaccatgtttgagcaaataggaaccgtgattatcgtcatcgtcgtgctagtggttggtgcagggcttggcctcttcgccggcttcgtgctaggccgtcataagggtcaggagatggctcgaggcgtcaaaagcgaggagctggaagaggccaagacctcgctggagaatgcgcgattcgagaacgctgagctcagtgctcgcaatgctgccgcacaggctcagattgaaggcgtgaaccagcaattggctttcgccaagtcacaacttgcccaggcgcagcaggctgagcagattcgcattcagcaggaacgtgagcgtgcagctgcggaggcagaacggaagcgtcaggcggatgctcaggccgccgaggccaagcgtgctgaacaggaagcacgtttgaaagaacagagcaaggtgctcgaggcgcttgcgccagtggccaagaatcttgataccttgcagaacaaggtcacgcagatcgaagagggccgcaagagggaaatgggcgcattgggagcccaactcaaggggctcaacgatcagcaggcccgtttggacaaggaaaccagttccttgtccgccgcgttgcgcaacaacaaggtgcgtggcgcgtggggcgaggcccagctcaagaacattgtcgagtccgccggattgctggaacatgtcgatttcgacacccaggtggtggtcacggatgccgatgggcgtacgttgcgcccggatatgatcgtgcatctgccgggaggcaagaccattccgattgatgccaaagtgccttatgccgattaccagcgtgcctgcgaaatcccggacaccgccagccccgaggatattgcccgccgcgatgatttgctgcggtcccatgccaaggcgttgcgcgagcatgtacgtgctctcggcgaaaaggcctattggaatgcctttgatgtagcacctgattttgtggtggccttcatccccaatgaggcactactgcaggccgcgctcgaagccgatcccacactgatggatgatgcgttctctcgcaaagtggcgctcacctcgccggtcacgctctgggccgtgctgaaatccgtggcctatgcctggcagcagcagtcgctcaccgatgacgccaagcagctgttcgatttgtcccgagaactgtacgaacggttctccacgctgggtgattatgccatcaaattgggcacccagattactaagacggtcagcgcctacaacaagttcgcgtccagtttggaacgccgtgtgttgcccaccgctcgcaagctgcaaaaaatcgaaccgaccaagatcatcgaggaagtaccgatcatcgaatcagataaaggcaatgtgagcgaactgtccgcccctgaagtggtgccggccgatgaaggtgatactcatctgactgcctcaggcgatagtctggagtcatgactgaatctggattccgccccactggtaccccggaccttgccgtcgcgaagagccataatgactttgccatgctggagccgcgtgaacagctagccaccttgctgaaggagcatgtggtgggccgtccgttctccgaacttgccgcggtgactttcgaccaccgtgccgccactgtcatgggccatgtactgattgacgctttggaagatgcgggctattcgattgatgacttcgatgctgttggtgccttgaccgcagcatctgtgcccatggtgtctgccatgatccaggccgccgcctctcgtggcgaggacctagatggattcgtgatggacttcgtctacccgtccatcaagggcccctccatcgaaggccgccgtgtggtgctgttggatgcttggctgtccgaaaagtcgtacgtgcagacaagctcgctggtcaccctgcgcaacggcaatgagctgagcctcgactttggcatagtggagcagctgggtgccaaggtcgtggccatcgcctcgctggtcggtggcggtgccaaagacatcaatgtggtcaacccctccaccggcgacgagcaaacgctccccttcatccaggtcttcgacgaatccgaactgcggtaaatccacctttgacgtccctcgcataaagtcagccgggctgagcagcgaagctgactaagaggaaccggtgaatagcgttatcgaggagaaagattgcacgcacccaaccagatttctttggctgccaaggcttcaggtgaaccggaattccgtgaaatcggccttgggccgtggtctgagacccatcccggtgagcctcgtcccgatgatccgacttcttcgaattatgacggtcgtttcgactcggtgctgttgaacgacggagaccgccgcaacgtattggaccgttaccgctactggaccgttgctgccattaaggccgatcttgacgctcgagggcgtcacgacttcgaagttgcggtggaaaactggacccacgattttaacatcggttccatggtccgcaccgctaatgccttccaggccaagcgcgtacacattgtcggtccacataagtggaatcgcaagggcgcgttgatgaccgaactgtaccagcacgtcgaacaccacccctccatcgccgaactggtggaaagctggcatcatcgcatcgccggtgaaatcgcctatgaacgagccaaggccggtgccgccgccatccatgcgcatgatgtggctgtggatggagacaacaagcaccttcatgagctgctggccgaaatcgatgcttgtgatgcacgcatcaaggagcttcaagccgcccgcgtcatcgccctcgacattattcccggcgcagtgccgatggaagcctatgccttccccaagcggtgcctgctgctcttcggtgcagaaggccccggattgagcgagaaggccctcgcattggccgacgatgtggtctacatctctcaattcggttccgtgcgctccattaatgcaggcgctgcggcggccgtggccatgcacgcatggattgcccaacacgccgtatcaggcgtgtagccatgcgccgacaatcctgccgcatggatcggcggtctcatcgtcaccagaaaagcggatatcaaataatgacccgagtgcctgccctgctgaaatggtctcaaagggtaggaaaatgcggtttcccgacaactgcgtgtcacatacggctcatatagttatggccatgccaacattttcacgcgaagaaatcgtgcatttgggcgatctggcccgaatcgcgctcaccgatgaggaaatcacccgtctgcagggcgaactgaacgtcatcgcagactccatcaacaaggtccaggaagtcgcctccgacgatgtgccgccgaccgccaacccggttccgctggaagcctacctgcgcccggacgtcgccgaaaccccgctcacgcaggaagaggcgctcgccggtggcccgaagaccgaggccggcatgttcgtggcaccgcgaatcctgggaagcgaggagtaatcgatgagcaacgaaaccgcaactctcgtcaaactgtctgctgccgagcaggccgctgccgtcaagaagggcgacgtcacctctcgcgagctcgtcgaagcccacctcaaggtgatcgaggctgccgagccgtccatcaaggccttcctgaaggtttccggcgatgtggctctcgagcaggccgacgccttcgacgccaagtccgccgaagacaaggccgccctgcctgagctggctggtgtgccgattgccatcaaggacatgatcgtcaccaagggcatcgaaaccaccgccgcctccaagatcctcgagggctgggtgccgccgtacgacgccaccgtcatcgaaaagctcaaggccgccggcatgccgattctcggcaagaccaacctcgacgaattcgcccaggggtcctccaccgagcactccgcctaccagaccacccacaacccgtgggataccgagcgcgtgcccggcggttccggtggtggctccgcctccgcagtcgccgcattcgaggcaccgatcgccctcggcaccgacactggtggctcgattcgccagcccggcgccctgaccggcaccgtgggcgtcaaacccacctacggcggcgtctcccgtttcggagccatcgccatggcctcctcgctcgaccagatcggcccggtctcccgcaccgtgctcgactccgcactgctgcaggagatcatcggtggccacgacaagcgtgactccacctccatccccgaaggcccgcgcccgatggtcgccgccgcccgcgaaggcgccaagcgcgatctgaagggtatgaaggtcggcctcatcaaggaactcggcggcgacggcttccagcccggcgtcgaggcccgcttcaacgaggccgtcgacaagctcaaggagatgggtgccgaggtcgttgaggtctcggtcccgcacatcggctactcgctaggcgcttactacatcatcatgccgtccgaggtcagctccaacctggcccgttacgatggcatgcgctacggcctgcgcgtgatgccgccgaccggcgtgccgcagaccgccgccaacatgatggcctacacccgtgaagccggcttcggcgacgaggtcaagcgccgtatcatcctcggcacctacgccctgtccgccggctactacgacgcctggtacggctcggcccagaaggtccgcacgctgattatcgaagacttcaagaaggccttcgaacaggtcgacgtgctcgtggcccccaccagcccgtccaccgccttcaagttcggcgagaagatggacgacccgctggccatgtacatgaacgacatcgccaccattccggccaacctcgccggcgtgcctgccatgtccatcccggccggcctgtccgacgacggcctgcccgtcggcttccagttcatcgccccgcagcagcgcgacgaagtcatgtacaagccggccgcggccctcgaagccgcgctggaagacagctggaacggcccgatctggaacgacctcaagaccccgtggcttgacggtctgggcaagtgagcatcggaaggaaagaaacaacatcatggctgaaaaactgatgaagtacgccgatgccaccaagaagtacgatgtggtcttcggtctggaaacccacgtggagctgtccacgaacaccaagctgttctgcccggcccacatcgagttcggtggcgagccgaacaccgagctgaccccggtgagccttggcctgccgggctctctgccggtgatcaacaagaccgccgtcgattacgccatcaagctgggtctggccctgcactgcgaaatcgccgagtggagccagttcgcccgtaagaactacttctacccggacatgccgcgcgactaccagatctcgcagtacgacaagcccaccaacggcaacggctacctggacgtcgagctggaagacggcaccgtgttccgcgtgccgatcgagcgcgcgcacatcgaggacgacgccggcaagaacacccacgtgggtggcgccgacggccgtatcgaaggtgccgaccactcgctggtcgactacaaccgtgccggtgtgccgctgattgagatcgtcaccaagccgatcgagggggcgggcgaccgcgctcccgaaatcgccggtgcctatgtgcgcgccatccgcgacatcgtgcgcgcgttgaacatctcccacgctcgtatggagcagggcaacatgcgcgctgacgtgaacgtctcgttgcgcccgagcccggacgctccgtacggcacccgttccgagaccaagaatgtgaactcgttccgcggcatcgagaagaccatccagtacgagattcgccgtcaggccgctcgtctggacgacggcaaggagattctgcaggagacccgccactgggatgaggctacgcagaccaccgctggcggccgtctgaagtccgatgccgacgactaccgctacttcccggaccccgacctcgtcatgctccacatcaccaaggagcacatcgaggagatgaaggcccagatgccggaaatgccgcgcgagcgccgcaaccgcctcaagtccgagtggggcctgagtgatctgcagatgcgcgacatcctcaacgccgacgccctcgacctgattgaggaaaccgtcaaggccggtgccaaggctgccggtgcccgcaagtggtggctgggcgagctttcccgcgaagccaacgccaagggtgtgtccctcgaagagctgccgatcaccccggccgatgtggccgaggtcgagaagctcatcgcctccggcaagctcaacgacaagctcgccaagcagaccgtcgaaggcgtgcttaagggcgaaggcactccggatgaagtcgtcaagaagcacgactacaagatcgtcgaagacaacggtgccatcgaggcggccgtcgacgcggcgttcgaagccaacccggacgttgtcgagaagctcaagagcggcaacatgaagccgatgggtgtaatcatcggtgccgtgatgaaggccacgcgcggtcaggccgacgccaaggccgtcaccaaggtcgtcatgggcaagatcaagggctgattagattcactggctcccgctggtgggagctgtcgaacggagtgagactgagggtggtcgccatgtacggatgaccaccctcagtccgcttcgcggacagctcccgccagcgggagcacttatttgtagggaaattctccagttcaaatccgttagacagctcccgccagcgggagcctttattgattctgtaagaaagtcgactcagagcatttccagcgttcacccagtcgagtaagatatgttcggcactggaccgtgagccgaaacaagccgaaccgggggacgtataccgatgaccgcaaccaacgagacgctgagcatggctaccgaagcgcaactgaagcgcgatctgccacagagcatcgtcattccgccaatccgtggcgaaatggtgcacctgcgccccgccaccgtcgaggacctgcctcgtttggatgaacttgatgccttctatggcgcatccaagatcacaggtaaggatgcggtcaccgaacgcgccatcgtacacacgtgggtccgccgctcccaggcttgggaagccggtcaggcacccgccgaatccggtgtgggtgatccggaatcccgccgcaccatcgcatgggccgtattgactgacgccgaccatgacgatgacggtcagctcgatgcggccagcaccgataatgtcatcggcatgattttccttatcgacatcgacggctggtccaagtccgcccgcatccagatcatcttgggccgtgaataccgtggccgcggctactcccgtgacgccatgccgcgtgtgatgacctacggtttcgcgcccgaaccggccggcttgggcatgcaccgcatctgggtgagcgtgccggaaaagaacagccgctcgatttcggtctaccagtcgctcggcttcgtgccgtccggcacctcgcgcgacgcgttgtgggatgccgaaaacaacaaataccaggaccttatcgtcatggacacgttggctgacgagtacgatccgattcgttcgcttgacgcttttggcatgcacttgattgaggacaacccgggtgtcaaggaagcgctgtccgcgcgcgagcattccatcgccatccagcagaacaagccggaacccgagccggcacagcgtggtgaggcagccggcgccacgacgagtgacgtgcagtcccaggcccagacgccggcggccgcacagccagtcgagccacaggccgagcaccacgacgatacgcagaagaacacgcgccacagtctcgaagaggaaagcaactggccgtacggtcaggcagaacgcaagccctcaaaggaagcatggtggcgtacgctgggccgcggccgcaaacgcgatacggaaagtgagtgagtaaacaagcatgagtgccgaggatctcgacaattacgaaaccgacgccgaactcgcgctgtatagggaataccgtgacgtcatcaagctgttcacctatgtggtggagactgagcgtcgcttctacttggcgaataaggtcgatttcaacgtgcgttccgctggtcaggacgtgtatttcgatgtgcagctgactgacgcatgggtatgggatgtctaccgttccagccgtttcgtcaagtccgtgcgcatcgtgaccttcaaggacgtgaacgtcgaagaagtccagaaaaccgatatcgacattcccgacgatattcactgacaggcaatcgtctgatacagcctgtattgacaatgcgcggcattccgtcatcttacggcggggcgtcgcgcattgttcatacaacgcatagcaaaagttcagactcgtaaccttgccatcgtgtgtcttgtttgcttgcggctgatagaaaatgctgcatgaacacacaccatatgcagcagggccttaagggctccatcgcgggcgtggttgctgccgccacattgctggccggtggcatcctgaccgttccgcacgccatggctttggaggccgatggccagtattacagcagcaagcagccatatgtggcacctagcgaagcgaccactgccagctatagccaggcgccggaaggctacgaaacggtatacaccgagtcgatggctcgccacggttcacgcggcctgtccagctacaaatacgacgcattgcttatgaagatggccgaagccgccgaagcggataacggttttaagtctgatgccatcaagtccgaattcatgaagaatctcaaagccatcaccgccgcaaatgtggagaatggctacggtatgctcaccggtcagggtgctgaccaacatcagggcattggcgcacgtgcctacgagcgcaacaagacgctgttcgacaacgcagccaaggacggcggcaagatcgcctaccagtcctccggcgaagcccgcgctactgaatcaggcgagaattttgctcgcggtttcaacgcggcctcgaacaataaactggcgaacagcactgtgacgcccgccgatccggccggcaccggcgaggcggcggctttcgacaagacgccgaacacgctgtacttccacaagtccgaaaacccggacggcactgagaaaaccggtgaggccaagcagcgtgccgacgattaccagaacttcgtggaaaacgatgcgattatcgcaggcgctgagcaaaccatcgccgaaaacgaggacgtgaaaacagcctctcacgatttgctttcacaaatcttcaccgatgacttcctcgccaaactggccgacggcacgtacgcctggtacaacactgtcgatggcaccaagggcggcgaggccaactgcgcgccgggagccgaccccagcaaggatgccgacgcctgcggcgcagccaagaagaagatcgcctccgaatacgatgccgcgatggatctgtacaacctgtacatcatcgccgctgatatggagaacgagaacaccggcagccataccttcgacttcaaccagtacttccaaggtgagcaggcagacgacgccaagttgttcgcctgggcgcttgacgccgaggacttctacgagaagggcccgagctacgccggccaagacgagacctacacaatcgcacagccgctgcttgacgatttcttctcgtcgattgatgagcgcgtaaacggcggatccaccgttgctactttccgctttgcccatgccgaaacgatgatgccgttcgccgcgctgcttggccttcccggttccacccagcaggcggccgccagcaccaccgacgtgtacacctacgccaacaatgaatggcgcggtgaatcggtgactccgatggccgctaatgtgcagtgggatgttgccgtcaaatccggcaacgacccgaagaccggccgtgcctacacgccgctcgttcgtatgctctacaacgagcaggaaatcgccttccgctccgaatgcacgccgattgccgatggttccacgtggtacaagctcactgagcttaaaagttgcttggcctccgaccaccaaaccctaggcgacgatgcgcatctgactgatgattccacaacgcagccgggcacaggacctaacactggtgaaggaacgagtaccactccgaataacaatggtgcgggaactcatcagcccagcaacactcaggctaatggtacggaaaacgagttgagtcgtaccggtgttgccgttactggtgttgcggggattatgatgctgcttgcacttgcaggcatctcgctgaatctatggaaagttcgtcgctgacgaattagcctaagaccaaaccgattcgccgcgctgtgtgtgacgcaacgttgccgaatacccctacctcacgattcgatgcgtcgcctttctgctgatggaaagacggcgcatcggtcgtatatcgggagaattctgtaagcattcgctcatctttcggtgtgcgattccggggcttctagtagactgtctctgattttgcgtttataaggagcataatgaccgacaagcaatccgtagtgattatcggcggcggtccggctggacttaccgccgcatgggaactcatcaaggacggcggtgccgacaagtacgacgtgaccgtgctggaggggacccgcgaattcggcggtatctcgcgcaccgtgaagcacaacggcaaccgcatggatatcggcggccaccgtttcttctccaaagacgaacgcatcatggattggtggaagaccgttctgccgttgcagggcgcaccctcctatgatgacaagaagctcggccgcgaccacgacatggagccgggcggccccgatccggagacggaggacaaggtgatgctcaagcgccaccgagtgtcccgtatcttctggaaccgccacttcttcgattacccgatttcgctgagccccaacacgttgaaggccatgggcttcaagctcaccatggtggccggcttcagctacctgaagtccatgttccacaagctgccggaagacaatctggagaacttctacatcaaccgtttcggccgcaagctgtattcgatgttcttcgagggctacacggagaagctgtggggccgccacccctcccagatctccgccgactggggcgcccagcgcgtcaagggcctgtccatcatgggcgtgctcaagaacgccttccagaagctgctgcccaagaagcgctccaacgcggaggtcgagacctcgctgatcgaggagttctggtatccgaagtacggtcccggccagctgtgggagaccgtcgagtccaattgcgaggccgccggcgtcaaggtgctgaccgacgccagggtggtcgaggtccgccagaccgatggtgccgtgtcttccgtggtgtacgaggattccgagggcaaccgcaccgagctttccggcgaccagttcatctcctcgatgccggtcaaggacctggtcaacgccatcgacgcggccggcgccgatcccgaggccgttgattccaagcccgccccggccgatatgaccgaggtggccaacggcctgccgtaccgcgatttcgtgaccgtgggcctgctggtcaagcacctgaagctcaagaacaccaccagcatccccaccctcggcaatccgccgatcgtgccggactgctggatctacgtgcaggacccgggctacaaggtcggccgtctgcagatcttcaacaactggagcccgtacctggtcaaggacgtggacgacaccgtgtggatcggtctcgagtacttctgcgaggagggcgactcgttctggaacatgagcgaggaggatgtcaccaagttcgcgatttccgagctcacccgcatgcgtgtgatcaacggtccggacgaggtcatcgactcccatcgtgagcgcgtcaggaaggcgtaccccgcctacttcgacacctatgagcacatggacgagctcatcgagtacctcgacggcttcggcaacctgtactgcgtgggccgtaacggccagcaccgctacaacaacatggaccactccatggccaccgccatggaggccgtcggcaacatcaagaccggcaagacgtccaagaagaacgtgtggtccgtcaacaccgaaaagtcctaccacgaagaaaagtgaataaaccttgttgagctccctcgtcacagagggagcttttttggttttcggcgggccgttttgcgttggtcgagttggcgttgtacagtgaacgaagttcgcagagactcagagacgcagcgaacattcatgagcggtgcaaccgcaataatcactcttaacgcctggataggcatgggtctgttcggtatggaaagggcaaccagtggcaaatagccagaatcttgaggatatgaagctgcctgagctcaaagagctcgctaaacagatgggcctgcgcggcacgtcgaccatgcgcaagcccgagctgctcgccaccctgcaggcggcgcgcaatggtggagagccgccggccggtgtgaccgtgcgcgcccccaaggccgccaaaaccgccaaggtcgtcaaggctccgcagtccgatgccgctgaggccaacaccacagacaatgctgacgtggccacccagtcgccggctccggctccggctgccacggaaccgcagctcgatttgccgcttcccgtggccgacgatgccaagaaggacgagaccgaaccgcgacgcacccgtcgtaaggccgccgatgatgccgcatccgaaccgcgtgcggcccgccgtcgtcgcgatgacgaccagcccgatttcgctcgccgcaagccgcgcaagaaggccgatgaggccggcgatctgctggccacgctcgatttgggagatgcagcgcctaccgagcgtcgccgcgagcgtcacgaggacgtggaagttccgctgattcgccgagtccgtgatgatgaggacgagcagcctcgccgccgtcgtcgcactgcggaaaacagcgaagaaaccgtgcgtgacctcgacgatatcctggccacgctgcccacgcagaagcacgaggaaacgtccgaagacggcgagcagaacgacgatcacgagttcgtgcgtcgtaaccgccgcgaccgtagcgatcgcaacgatcgcgatacccgtaatgatcgcagcgatcgccgtaaccgtcgcatgcgtggccgtgatcgcgacaacgccgatgatgatcgtcgctatgatgatcgcgataatcgtagcgatcgcaatgaccgtgatagccgccgcgaagagccgcaggaggatctggtgccggtggccggcatcgtcgacgtgctcgactcctacgcttttgtgcgcacttccggctacctgcccggcccgaacgacgtgtacgtttccatgggccaggtcaagaagtacggcctgcgcaagggcgatgccgtgcatggttcgattcgcgccccgcgtgaaggcgaccgccgcaaccagcgccagaagttcgtgccgctgcaggccatcgattccatcaacggccaaagcgttgaagaagcgctcaaccgtccgcagttctccaagctcacgccgctgtacccgcaggagcgtttgaagcaggagaccgccccgaacaagctcaccggccgtatcatggacatcgtttccccaatcggcaagggccagcgtggcctgattgtctccccgccgaaggccggtaagaccatcaccctgcagaacatcgccaactccatcgccgccaacaaccccgaggtccaccttatggtggtgctcgtggacgagcgacccgaagaggtcaccgatatggagcgcacggtccagggcgaggtcatttcctccaccttcgaccgtccggcctccgatcacactacggttgccgaactggccgtcgaacgcgccaagcgtcttgtggagctcggccaggacgtggtcgtactgctcgattccatgacccgactggctcgcgcttacaacatcgcagcccctgcctccggccgcatcctgtccggtggtgtggacgcgcaggccctctacccgccgaagaagttcttcggtgcggcccgcaacatcgaaaacggcggctccctgaccatcatctcatctgcgctggtggaaaccggctccaagatggacgaggtgattttcgaggagttcaagggcaccggcaacatggaactgcgcctgtcccgcgagctggcggacaagcgactgttcccggccatcgacatcaacgcttccggcacccgccgcgaggagctcatcaccaacccgcaggaactgccgattatctaccgtctgcgtcgactgctgggcggcatggagcccgagcaggcctaccagacgctggtgccgcgcctcaagaagaccgccaccaaccgcgacttcctcgccgccatcgtgcagcaggccaacaccggcaacgcggtcaacggcaactgatcagaccgctgaacaatagtgtaagggctgcaccctgattgatacggggtgcagcccttgtcgtatctgatgcaaatacatcaactatcacattgcagttgtagtattgccgtcaacgttcacatgcacgctgacgatatatgagatgaaagaggcatcactgggttcgattgttttgggagtgggcagtggtgcggccatgttcggcgatgcggatgccagccatatcctcaccggcgactatgacatctgagatatctgactttgcgcatcgtgcaaagccgtaatcgggagtatcctcgaatctatgagcgaaacgagcagcgactggcaaaggaccaccatcgactccgcccaggcggcggcccacccggaaaccgcacaagcggtggcgcgcatcaaagcgctgcgccaaaccatcgataacatcgattcggcggtcatcgcattactggccgagcggttcaaggccacctcgcaggtcggcgtgctcaaagccaacgccggattcgcgcccgaagacaccaagcgtgaggactatcagatcgaacgcctccaccgcatcgccatcgatgccgggcttgatccggaaattgccgaaatgtaccgtgaattcgtggttaccgaagccaagaagcgccaccagcgcatagccgatgccggtggtgacccgggcgtactcgacgtattcgcctgattcgcccgcagcgaatgggcacctttcggatattcgtctatagggcaagttgcctgcagcgactacattaatacgggaatggaatgcccgtagtggtcgactgtatgaatgggatacgtagatgagatgtggtgccgcactggtcagttgcgcattgtgcgtggcttcgattctcggcggtgcttggatgtctcgtccgactccggttgattacggtccggtgctcgctacggcaagtgatatgtacgccgtcaccgatgccgaaggggagccggtccgttggtatgtggtagggaagggcggcgccggcaatggcgccagtgccgattccggcaatagcggttccactgataccgattccgccaatagtaattccggcacgtccaaggtttctcgtatccccgcttccgccgccaccctgccatggaaagtcagcgtcacctactcgcttgacggtccgaacgtcgaggcaaacgaggttgccggcgcgtctggactgatcggcgtgtatatcgatattaagccgcaaaccaaggaagccaaccgtacgatcccggttgtcgcctttaccgtgcctacgcaggtagccgatgatgtttccgctgacaactccattacggtgaccacgcaaggttccaataccgtagtcgccgcagctggaaaagccgcaaccggcttggaattcagctgctatatgaacgccaaagacttctccatgagttccgtggcgctcgccgtattgccttccaattccagcagtccggcagttggtgctaatcccgatgccgcgaatgctgcgaatgctgccgcacagcctgctgccgatacggatgtcgcccaactcaccgcctctgccgccacactggtcgattcactgaccgacgccggttctggtgaacagcaacagctcatcgagcagcttcaaaccctgcgcgataacgaacgtgcgctgaacaagtctgtagtggccgaacgcgaaaccgcccataagcggacgtttgaagactatatggccgcgtatgtgggctcatataccacgcacctgtctggatcgattggcacctccacccagttgccggcgttgatgggcacggccggcgaactgtccggggacacgcctttggctcaagccgtactcgacttggccaacgcggtgaacaacgtcagtgccgcacatcagcatgccggtgcggtcgatgcgttggacgaggtgattcgccgcatccagcagcaaggcaccaccggactggtggatgatctgatcgccgaggcttcggaggaagccactcaaggctccaagcaatacgccgatggccagagccagctctccgccgcaatgattccgtattcgatgaaatacacggacgtttacacggccaatttgagcgccctgaccggcggcacgtcctcgggcgccaccgcttacgagagccaagccatcgccgaaaccaacggtagcgatgaactcgccgacgctcaatccaaggtcgatgccgcgatgagcacgcttgccaccgcctccgagcatacgggcaaagccacggccttgcgccagattgtattgcgattctccgatcagttcgaaggcggcgcgtcctcggcttccggcagtgatggtgatggttcgtccggtgatgtctcttccgatccggtgaccgaggctcaggcactgaccggcctggtcgattcgcaatcgcaatcgttctacggcaagacccgggtcgcccaagccaagcgtaaggccgatgccgcccgtaagcaggccaaagccgcgcaacagcagcagtcgcagcattccaaggcctcactggtcgatgacaccatgtccatgtctgctggcgatgtgatgaactatgcgggtggtcttacttcggccatcggtggtggtgataagtccgactcgtctaagagcgctggttcgggaacgaacgactcagccaagtcgagcgacactggcgattccggcaacggcaaggcctccaacgccagcgattccggcaacaatcttgacaccgctccagtactgttcggctttggcactggcggcacgctgttcaagcacgatatgaacgcgctgattaatgagaccgtgaaaatcagtgatgctggcacgctcttggcgcaggccgtcgcgcagctcgacagccccaatacgcaacaaaaaaccgccgaaacccgatatctcatcgtgattccgacggtgtgatggtgtatgcgggatatttgcgtgccgtcccacagtcgtgtcatccgaacgtcaaaaaacaaaagaggggaacctcaataggttcccctcttttgttgttgtgcgtaacgttcagtgctttggcttcttagctggccgagccgttaagcgggaagcccggtgggcttcccgtaggctcggaacgagcggcattgccgtgagacctactgttgttgtgcgtaacgttcagtgctttggcttcttagctggcggctcaccgagctcgctggcttcgacggcgacctcggtttcgggcgtgccttcggcggcggattcctcggcgtgcttggccaccaagtcgaacttgccgaccacgcgaccggcctgcgcgatatcgcccaaggcggcgtgaatcgcttccacaccttccgaagcagcggacagtgccacagacaggattggggtcttcatggagaccttggcctcggacttgatcttacgcagctgctccacggccttgccggcccaagtcagcagctcgggggaagcaccggtggcggcctcgacatacgggtccacgaccggccaggcggcgcgatgcacggaaccggaaccggcgtgcatccagctccacacttcctcggtggcgtacggcaggtacggggccagcagacgtgcgaaggcgtccaggcccagacccagagcggtgcgggcggacttcacagccttctcggacggcacattgccgtgctcgtccggagtgccataggcgcggttcttgaccagctcgatgtagtcgtcgcagaactgccagaagtaggactcgatgacttccagcgccttggaatgctcgtaggattccagcgcctcggtggcctgacgcaccaccaaagccagcttggccatagcggcgcgatccagcggttcggtcacatcggccgggttccacgcggcctcggcggcagcgcccacgtgatggttctcgtcctcacggccgatggccagcgcgaacttggtggcgttcagcagcttgatggccagtcgacggccaatcttcatctggccgatgtcgtacgtggcatcgaggcctaggcgagcggcggcggcccagtaacgcacggcgtccgcgccgaacttctcgatcggctcgttcggcaccacgacgttgcccttggacttcgacatcttcttgtggtcggggtccagaatccagccggacagcgtggcatgggcccacggcaggcacttgttctccaagtgcgcgcggtccacagtcgagaacagccaggtgcggatgatgtcctgaccctgcgggcgcaggtccatcgggaaggtggaagcgaacagggccttggaggcctcgtccggctcggcccagtgggtcacgatctgcggggtcagcgaagaggtggcccaggtgtccatgatgtccttttcggcggtgaaaccaccgggcacatcacgctgggactcgtcgtagccctccggcacgtcgatggtcgggtcgatcggcagacgatcctcggacggagtgatcgggtgatcgtaatccggctcgccggaagcgttcaccgggtaccacagcgggaacgggacgccgaagaagcgctgacgggagatcagccagtcgccgttcaggccgtgcacccagttctcataacgcacgcgcatgaagtcggggtggaactcgagttccttgccacgctcgataagctcggcgttcagcttggcgtcggtaccgccgttcttcaaataccactggcgggaggtgacgatctcgagcggcttgtcgcccttctcgtagaagttcgtcatacgcttggtcggggtcggctcgccgtccagatcgccggactcgcgcagcttgtcgacgatgatcttgcgggcggagaacgtggtcttgccagcggtttcggcaaagacctcgcggccggccgggtcctcgatccagtccggggtatccatcacgatacggccgttgcgctggatgatcgggcgggtgggcagcttcaggtcgcgccaccactcgacgtcggttacatcaccgaacgtacagcacatggcgataccggcacccttgtccatttcggcggccgggtgcgccagaatcggcaccttgaccttgaacagaggggagtagacgtactggccgaagtactgcttgtagcgttcgtcgttcgggttggcgatcagcgaggtgcaggccgccagcagttcggggcgggtggtctcgatgtagatcggggtgccgtcctcaaagcggaaggccaccttgtggtagaagccggggtattcgcgcgattcgagctcggcctgggccacggcggtctggaaggtcacatcccacaggccgggggcgtcctgctggtaggcctcgccacgggcgaggttgcgcaggaaggccttctgggccacacgctgcgggtgctgaccgatggtgtggtaggtctgcgaccagtcgatggacagacccagcttgcgccacagggcctcaaacagcttctcatcctgagcagtcagacgctcgcacagctcgatgaagttcttgcgggaaatcggcacctgatccttggcgtcaatcttcttgccatcagtgccttcaaacggcggcttgaagtccgggtcgtaaggcagagacacgtccacgcgcacgccatagtagttctgcacgcggcgctcggtaggcaggccgttgtcatcccaacccatcgggtagaacacgtcgtagccgcgcatgcgcttgtagcgcgcaatcacatcggtgtgcgtgtaagagaacacgtgacccacgtgcagcgaaccggagacggtgggcggcggggtgtcgatggagtagacggccttgcggtcgcgggtgttgcggaatttgtaggtgccgtcttcatcccagacggtgcgccacttgtcctcaagtccgtccacgccgaccttgtcgggcagcggggtgaggttggcgttgatgatggatttgccttcagtcataaggccaaagtttatgcacgttgcatgacaagccgaactgtacagtaaacagcccagtaggctgttcgcaggcgaggtacgaacgatcgaacgatagtgagccaaggactatcgggcgtagcccgtccgtgactgaaggttgcctacttcaccgtcaacccggccagcggcatgcggcgattgatcatcgaggtcgggtagccggagaccttggtggacgccacagtgaagcatttgcgggtatacagccaatcactggccgcatcctcgctgatcagccgggcgtacgccttcattcgtgcctcataatcggcgtcattagtggcggcgcgagcatccgcataggcctgttgcgcttcggtatggtcgtaatggaacatggaatcggggtcggcgaatatgccggcatcatccgtgccgtccatgctcatcacggtcagttcccatttgccgtccttgattcgtttggcataatcctcatcggagagcacttcaaggttcaccgtggggcgcggctgccgctcgatctgctgcttgatggtttcggccaacgaccggtattcttcgggaaccaccagattcaccgtagtcaggtattgcgcaccaaagtaggagaacatctgcccagcttggttttcgtcatgcgggtacagtccggtcaaatcttcgtatccgggttccagcaggctgatggggccgcccaatgctccggctgcgtcgggttgggcggaggcgatgccggctgcgtcgatttgatagcggaaggctttacgcgcctgttcgtcggagagcagcgaatcggtgccgttgttgtaggccagcagcaccttatccgtagtggccccctccttgacggtcaggccatccttgccgttcaagccggtggccgtcgaagccgaaaccggtgccgccatatcgagactgccgtcggtcagggccttgctgagcgcatcggcgtcggagtattgcataaattcaacgacattgctggccgctttggtgccatggtaggtatcgctgcgcgccagcttcagggaatggccaggctggaaatcggccacggtgaatggtccggaacctatggccttgcgttgataatcggcactggacgactcggaatcgtagacaatgccgagtctgccggacagcgctcgcagcagcgtcggattgggcttggcaagcgtaatgaccaccgtggtggcgttcggattggcgaccgacgccagatcgcccaattcgtcgacgtccgccaccttgttggtcacgttctgttgcaacgaccacacggcgtccgaggcgtccaacgtatggccgttcgagaaggtgacgcccgattgcagtgtcagggtgacggtcagtccgtcatcggaagtcttccagcttgtcgccagtcccggctgaagcttgttgtcttgatcgacggtcactaatgtctcatacacattgtcgacgagcaggcgttcggctgccgcagaggaatcggaccgaatatccaaggattgcggcatatcgtcgatgccaatggtcacatcggcatcgagggatgatcccggctggaaccggttttgcatgaacgtccatcccacaaccacgagtgcgccgagtgccacggcgactccgagaaaaatcccccacttggaccatgtattgtcccgcttgctgtgctgcatggttttcagtctagcggtggattcagcctagaatccgcaattcaccatgatgaggtatgagttagcgcttggacgtgctcttgccggcgggcggcgcatagctagggcaggtgtcggacagcgggcagttggcgcagtcaggggtacgtgcgtggcaggtggcccggccgaacagaatcagtcggtggctgagattcgtccactcttcgggcggaaaacaggaggtgatttccttctcgattttcacgggatcggggtgtgcggaccgccaatccgaccgccaacgcagtcgtccggttacgcgcatcacatgcgtatcgaccgggaatccggggatatcgaacgcgttgccgagcacgacgttcgcggttttgcggccgacccccggcaagctggtcagttcatccatcgtgcgcggcaccacgccgccgaatcgttcgtccagtgccgtggccagtccgatgagatgctgggttttcgaacgatagaaccccagcggatgaatgatgtcttcgacttgggccgggtttgcggccgccaagtcacgggcggtggggtaggtggcgaacagttccggggtgaccgtgttgacacgcttgtcggtggtctgggcgctgagcacggtggcgatcagcaattcgagcggattcgagaaatgcagtgcgcaagcgggtgccggaatcacctggcgcagaatgtcgtattcgtcatgcatgcgcgtgagacgcgcggatttggtttctctcatcgtatggacctaagcggcgtaatatcgatgattgatagtttgcagcgccgctggtctgtcaggcgacggtgttgagatcgggagtatcgtcatcggtgtcgatggcggcagaggatgctttggcggcctgctgtgcggcggcagtttccttatccgtctccggcgggtcgaatcggtagcccacgttgcgcacggtgccgatgaggtgttcgtattcgccgccgagcttggcgcgcagacgacggatatgcacgtcgaccgtacgagtgccaccgtagtagtcgtagccccatacttcctgcagcaactgggcgcgcgtgaacacgcggccggggtgctggaccaagtacttgaggagttcgaactccttgtatgccagatcgatggggcgtccatgcagggaggcggtatagccgttggtgtccacaatgaggtcgccggagcgaatctggccatcttccaccgtggtggtggattcggcgggagaaccggctgctgcggctgcgggagcgttgccgcgctcggagaccaatcgcaatcggccctcgacttcggccggggaagcggtggcgaccaccacatccgcaatgccccactgggagttgaccacggtgaagccgccttcggtcagcaccagcacgattggcgtggacaggccggaagcgtggatgaggcggcacaaggttttggcggtcgccagatcgtcgcgtgcatccagaaacagaatggtgttctccggcatcttcaccaagctggctgcatccatcggcagtacgcggacgcgatgagaaagcagggcgagtgatggcaaaacggtggcggggtcgctggcgaaagtcatcaacgtaagatccgtcacgctaatcccccttatcctgcaatgtgttacgcaattgctcggtgtggctgtacgagtcgtcagcggcgttatgccgctttcgcacggttttcattattctacgcgcttgtagtggacacataggttacaagtttgcggaatatggaacggtggacgtccatcaaccgatgatacggccgagcaccagtgcggttgcggcgatggtcacgcccatcagcattaccggcatcaggccggtaccgatccacggataacggatatccgggtccggatcggcgtcgcgcacccacaacgtggaagccacggccaaagccagtcccaaaacgatgaggatgatcagggcaacggttcccgcaacggtgcccttggcgagcatcgcgcccaaatcaggtaggaagcaccagccggccacggcgagagctgccacaccggaagtcacggcgtgagagagtgcgcggataagatgttcgcgcttctcacgagccatctggcgtccgaaggagaagaccaccagcaccaccagcagcaggcccatggccagtgcccatgaataccaaggaagtaccgagccatccgcagcggtctgatccggcggcaccttgccggtcgggaacggcacggtgacgaaaatcagagaaatcgcgccaaacaccaaagtgacgatacgatccagtatgctgccgcggaacggccagaatacgacaaatgcggccaacgtcagagcggcgataatcaaagggatgatggggacggtgccaggggagggaatgaccgtggctgcgatgaacagtacataggacgtcagttgggccaacaacatgctcagagctttgttcttccaaccctcctgggtgatctcggtcatgatacgcctctcagataatcgaatttctatcccaatcctacgtcgggcattggaacggtgaaatcaaacaaaatagccccttctggtgaaggggcttatggcactaaatcagaacgcgataacgcccaaatgctccaatagcactttgatgccgagtagaatcagcaccacgccgccggcgatctgcgccggcttctgccagcgggaaccgaacgcgcggccaatgtgcaggcccgcagcggagaacagtccggtgaccacaccgatgctgaggatggcgaatgccatatgggctttggtgaacatgaaggccaggctcacgcccacggcgaacgcatcgatgctgcaggccacggccaggggaagcatatgcttccaatcgaactgggcggtctccttggagttttcctcatcttcttcgaaggcttcgtgaaccatgttgccgccgatgaacaccaacagggcgaagatgatccaatggtcgaattgggttacgtatttgctgaatgtagatgccgcgaaatagccgagaatagggaacagcatctggaatccgccgaaccagagggtgcttttcacggcgtcttgtactcgtacgcgggatacggtcaggcctttgccaatggatacggcgaatgcatccatagctacggaaacagaaataagcaggatttgaatgattatcgaaatcatggtgtgacagaaggttcatcgccggattaccgtgcgatgggcctcgaccagcgttcctacacgccgcctacgcctagttgaaaagacaaaacattactgtatcacaaaatacaagctccctctgttggggagctggcgcagtgaaactgcgactgagggagagtagagcggctttgccacaaatacaacaaaaggccccgaaggggcctcctgtcaacgattcagaatcgaatcacttctcggaatcggcgagacgctgacgcgcggcaatgatttccttttcggcggcgtcagcaccagtccagtagtcgcccggcaggacttccttgcccggctccagagccttgtactgctcgaagaagtgcttgatttcggccttgtggtactcgttgacgtcgtcgatgtccttgatgtcatcgaaacgaacgtcggcgggcacgcacagcaccttgtcgtcgccgccggcctcgtcgaccatgtggtacaggcccacggcgcggcactcgaccacgcagcccgggaacacggagttcggaatcatcacgagagcgtccagcggatcgccgtcctcgcccagggtgccgtcgatgtagccgtagtcatccgggtaacccattgcggtgaacagggtacggtccaggaagacgcgaccggtctcgtgatcgacttcgtacttgttcttggagccgcgcggaatttccacaacgacgttgaaggtttctgccatgtcatttctccttgaaaatcgacagttacgttatcgtctcaccacaataccctgtttacgcctgcaaaacaggtgcggaactcaagaaaccgtgctgagattatgccgacactatgcccaaacagacgaaatcctccccttgaggggaggatttctagcggtttacgcgcacgataaacccatgcacgtcaacggcatcactgttgcattaccgttgcagtaccgcatcactgcacggacaggatgtgggccacatccgcccaaggagccagagacacgtagttgtcccaaccccactggaattcgcggccggtcagctcgtcgcgcacgttgagcgggcggtcggtgggcagacccagctcgctgagttccaggtgaatcatcgactggtgtgcgttgtgtccatcgaggttcacgaccacaatcagcgtgtccgcttggccggtaccggtcagttcggccggcgtgtggcgtgcgaaagccagaatattcgggtcggacgtaggcagcacggtgaggttgtggtagctcaacgcggccgggtgggcgcgacgaatcttgttgagtgcggtgagcatctcggccacgccgtactgcttggccttgctccaatcgcgaaccttgacctcgtacttctcgttgtcgatctgctcttcgaagccggggcgctgcttgttctcgatgagttcgtaaccgttgtagataccccaggacggcgagcccatggctgccagcaccgcacgcacgcagtggccggctacgccgttgtctcgcacgtaagcggtgagaatatccggcgtggtgggccagaaggtgttgtgctggtagtagccgtcgtcgccattggtgaccggcagatactcttccagttcgtccttggtgttgcgccacgggaagtagcagtgggactgggtgaagcccacgtagctcagggcgcgcatcatgcccgggcgggtgaatgcctcggccaggaacaggatctccgggtgcttcttggtcacggcggcaatcacgtcctgccagaaacgcaccggcttggtgtgcgggttatcgatgcggaagatggtgacgcccgcctcgatccacagattcatgatgcgttcgacttctttttcgatgccgggcatgtcggcgttgaagtcgatcgggtagatgtcctgatacttcttcggcgggttctcggcgaaggcgatggagccgtccggcttgtggcggaaccagttcgggtgggccttgacccacgggtgatcgggcgagcactgcagggcgaaatcaagcgcgatttccagacccagttcatgtgcacgctggcacagggccttgaaatcgtccatggtgccgagcagtggatccacggtgtcgtggccacctagctcggagccgatgccgaacggggagcccgggtcatcggggccggcgaccagcgtgttgttgcggcccttgcggttggtcacgccaatcgggaagaccggcggcaggtagacgatgtcgaagccctcggcagcggcgcgttcgaggccggccatcgaagtcttcagcgtaccctgaatgatcttgccggtgttcggatcgatggtggcgccttcggaacgcgggaagaactggtaccaagccgcgaagctggacttcgggcgttccaccttgaagcgctggggctggctggggagatgccgtcgcgcagcgggtgagtctcgtgcagggcggcgatggtcgggttgtcgccggcggcgagacgatcctcggcgctcagcgtctgatcggccatggtctcagcggccttctccaaggtcttgcgatcgcgtgcggtcaggccggtgtccggggtttcggcccaacgggccagcaactcggcaccggaattgagtgcgttgtccacgtcgtccatcacacgcaccttgatgcgggcgtcgtgcagccaggagacgtacgcgtcttcccaaccttcgatggtcacggtccattcgccgagctgacgcttgacggccgcgtagccatcctcccaaggcttcagatcgctgtgctcgccgcacttgaccatcacggtccaacgatcgaggccgggatttacgcaggtcatggcccggcgcatggtttccttgccgcgcgggttgcgcacgatggcggtggcacccaccttggtacggccttcgatgaacacctgggcggtcatctcaaacggttcgccgagttccacacgggcggggaagatgccgcgctcctcggcgggagtgatgtccatgacattgatgcggccgaactggccgggctcgtttgcttcgatggacggtgcgggggcttcgacagccaggcctttcagcgctgctgcggcgcgtgccgtttcggcgctgactctcttgcgcttggttgcggggctctttcgggcagaagtcgcctttgacttcgttttcgtggtgctgttatcggtattactagtgcgcgtggtcgcgcgatgttgtactgctgccataaggccctattctaagggcttttgaacatatgttgcgcattgtggataactatcaggtaaacgttcggtcaaccgcatgaggtggataactcggcggaagagttatccacaactcgccggcaaacggcaagctcggaccacataggtcgaaaaaccggctgtagcgaatgaaaatctgccatgatcgtggcctacccgcacacagtgcagtatgcggggaaacgtaccaggaaaggacgaatgatgataacgacatggcggcaacggggcatggccatcgtagcgatgctgaccggtctgataataatggtgggagtggtgttcggctcggcgaatacggcgtatgccgcgacgttgacgcccgccgacgaaagatatcacgtggcgtttccatacaacgatatggaatattacgtcggtgtcgcggggctggacgcttcgggcaacaagtactactgcatcgaagcggggaaactgagcgactatgtgataggccccaccacggtgcttgcctccgatgagaacgcccggcgtatggcatggatccttgaccggtaccgcgacacggatgccgccacccatgcggcgatcggcatcatcgtgcaggatcacttcgggcgcgatcgggacgagtgggcgagacagatggcggtcattcaaggccggtaccccgagatcgtggcgaaggcggcccggatatgggatcaatcggccggcaagacgcctgcgggcacgacggtggaacgcaccgatgccgaggctttgcgcagcggttccatctcggtgaaagtggtgaaccgcgccggtgacgcgatcgcgggagtgccgttcaccgtcaccttgcagggggcggcgcggttcgtccaaggcggcaacacgttctcgggggtgtcgacgagcgccgggtcctcgatcgcgtgggaggcgaccggcgccggcgaggtgacggcgaacaccacatacgagtatgggcggatgcacgtcatggacagcactcaggacatgctggcctttgactcgatggcttccactggcggcgcgtcgacgacatttcgggtgcgtaaggattttgttccggcggtatccaccaaggtctccgagaaggtgcttgatgtggcttctccggtgttcgatgacgtgaccagtggcgtggcggatgcggacagttattgggtgcccgatttggaattgcaggcccgcggatactatttcgatggtcttgatacgggcgatgtgggcaatgtcattacgccgaatgcacaagagagcgccgatgcttttcttgcgcgattggcgactttgggttatgagccggtggcctatggcaaggcctctttcaccggggtggggcagcaggcacgtgtgcaggccatgaccaagccggatgacggtgccgcttaccggaccaagcagaatagcgtttttggcacatgggtatgggtgtttcggcggtccgagcagagcaaacaggcgcaggaataccttataggcgactggataagtccgtttatggaggctacggaaagcaatacaagtcgcaggaagctagaagtcatgtcgacggtcactgagcattcggcggatatcggtgccgagctcagcgacaccattaccgtatcgggattccctgcggatcatggccagtatgccggcaacgaagagtatgagttcgcggcggatcggccgtatgcgacggtgagcgtatggtggtccggcgatcccgacaacccctccaacgatgaggcgtacaagccatccgggggagaggttcccacggaagacgacaaccaccggttgctggccacctgggagattcccgcgatgaacggcacgttcaaaatcggcgccggggcgttggacgcgcatggcgctcctatgtatctgaccgccgaacggcctgggtggtacgtgttcgtctggcggttcgaggggatgaccgtgtttccccggcgtccagccggtatgacgatgcctgggagcgtgtgcgggtgttgcccccatgcgagtcggagaaaccgtgcgaaccggagaaacccgagacgccgccggcgccggcggaggcaaccacgcccaaccctcgcccgtcactgcccgtcacgggtggcgatgtgtcgcttgcctcggttctggccgtgtcagctctggcgataggcgccatactgtccatcgtcgttcggtggcgtcgtcgctatgaccgattcaagcactggacgatgcgctggccgatacgttgacccgctgcggcatgatgccgatgatgtcggctggatggtgaaccacactccgcttctgagcagaagaacgggagctgggcacgaagtcgatcgtaacatacgacttgtgcccggcttccgcttcgttgagaaacttcacgcctgtcgcctcccgtggattagacaactgaagatccgcgatgaaaatgacgagacgtttatgatcgccgacttccctgggcaccgtagctgcctgatcgcctttcatccatatcgccacggtaaacggaaaggccgctgatttcggtaccgaaatcagcggccatataaccacgttcgtagcggggcatggatttgaaccatggacctctgggttatgagcccagcgagctaccgagctgctccaccccgcgtcggcttgtctctcagacagctctatctacaataggtgcagatttcagaaagtcaacatcggcgtgtcgcgtcatcttcccgcggttttaaaacgtgaattggctcacgcagcgaggggtttggggcggagtcggagtcggggtaataacgcgccataaatggccgttataggaatgccctgaaccgttatcccgaatattgacataataggaacatgcctatcaagatccccagtggcctgccggccagagatatcctcgattcggagcgcatcttcgctctggagaagcccgaggcggagcgtcagcgcgtccgcccgctcaaactggtgatcctgaacttgatgcctaagaaaatcgagactgaaacacagctgctgcgtctgatttccaagtcgccgctgcaggtcgaaatcgacttcatgaagacctccacgcatgaggccacgcacgtttccgccgatcatctcgtcaagttctacgaaaacctcgatgcgttcaaagacaactattacgacggttttgtggtcaccggcgcgcctgtagagcatatgccgttcgaagatgtggactactgggacgagttcaagacgattctcgactgggcctccacccatgtgttctccaccatgtacctgtgctggggtgcgatgggcgcactgtactaccgctacggcatccacaaggtggattaccccgagaagattttcggcgtattcccgcagtacctgcaggatgaatactgcttcctgaccaatggcttcgacgagattgatctgcagccgcactcccgcctcgccggcgtgaacgaaaacgaggtacgtgccaaccatgaccttcagatcttgacttgggggccgcagtccggcccgggcctgatcgccacgcgtgacttctccgaagtgttcgcgctcggccattgggagtacggcaagtacacgctcgccgaagaatacgagcgcgatatggccaagggcatgaccaacgtgcccttcccgaagaactacttcccgcatgacgatccgaagctggaaccgttgttcgcctggcgcgcccacgccaatctgctgtggcgcaactggctcaactgggtgtaccagaccacgccgtatgacctgaccgaggtgccgcagctcagggctgagaagaagctcggtactgatcgttcgattcggcatgagccgggcgggccgcgccaggatgatttcaagccgtttgtgcatgacgggtatggggtgattcagggctgagcctacgatctcccctcagtcgcctacgacgacagctcccctcgacggggagctcctttgcttctccttcacggctcggcccatcagagggagctactgttggaggttgcgttcgtagcgtggacggttgttcgtccacgatgtggacggcttgatgaacgtaatgccacacatccgcgtaatgcgaccaatagtgcacaacgttcgcgaaacgcccgggaaaaccttgcagcagtagggatttcaggagactcgccggtataatattgacattgtctagacgcaggcaaataatcactcttcagtcattcggagccgaatgcccagcgcagactccgtgtccatgcccggcagactccacaccgaggagacaaaaaaagacgaaagtaacgagcacgtcacatttgcctgcccggtgggtttaaactgacacctgacattgaagaagcaggaggcgtgatatggtcggttcgctcagcgcaggattgctgttggctgacgaggcaggcgctcatctgccctcggttgatgacttccttcccccggagattctgttccagggaactccgtttgccatcaaccgcattattttgattcgtatcgtggcaaccatcgtgctgttggtggtgctcggcgtgaccgcaaagcgcgccaagctcatccccggccgttggcagggcgtagtcgagtacggtctcgacttcgtgcgcgacaaggtcgtgtatgacgtgatgggtgaggcccgtggcaagcgctacgtgccgatgatcaccaccctgttcttcacgatcttcattttcaacctgtgcggcatcattccaggtatgaacatggcggccaacgccacggtggtcatgccgctcgtgttcgctgtctggacactgatccagtactggatcgccgccatccgctcgcagggcctcggccactatctgcgccacgagctgttcacccccggtgtgccgtggccggtctatttcctgctggctccgatcaacctgcttgagctgttgatcatccgcccggcctccctgaccatccgtctgttcgccaacatggtttccggccaccttatggtcgccacctgcctggcgttcgcacagttctggatggttgacgcggtcaacaagctgcagggcatcccggtgggtgcgctgtggttcgccggtggtttcgccatgacttgcttcgaggcgttcgtcgccttcctgcaagcctacgtcttcgcgattctttccaccgtgtacatcaacctgagcttcccggaagagtgacgggcgactaacccgccgcttccggtccccggtctgggaaaatcgcagaccgaccaaaccccaagatttataacgtcgccaagtacgttagaaaggaaacacaatggatatcatcaccctcgcagaggtcgccggcaacctgtccgtcatcggttacggtatcggtactcttggccctggcattggtctgggcatcctcttcggcaaggccatggaatccaccgctcgtcagcctgagatgtccggcaagatccagaccatcatgttcatcggcctggctctggtcgaggtgctggcactgatcggcttcgtcgccgccctgatcatctgatctgcgcagatcaacagacgaaaaccgattatgtccatcactgaaaggagggcttgatgacacaagcagcaagcgggattgacctgttcattcctgaggtttatgacatcgtatggtcgctgatcattcttgtcatcgttgcggtgttcttctacaagttcttcatgccgaagttcaatgcgatcttcgacgagcgcgccgccaagattcagggcaacatcgccaaggcggagcaggctaggaaggacgccgacgaggccaaggccaagtatgaggcccagctgagcaccgcccgtgtggacgccgccaagattcgcgacgacgcccgtgcggaagcgtcccacatcatcgccgacgctcgttcccgcgccgagtccgatgcggcccagatcaccgcatccgcacagcgctcgatcgaatcccagcaccagcaggccatcgtctcgctcaagggcgaggtcggcgcacttgccaccgccctggccggcaagatcctcggtgccaagctggaagacaacgacgtgcagtcctcgatgatcgattcgatgatcgacgacctgggcgccaagaagtgaccgtgaccatccgtaaccagaaagggaggtgaccatgcgaggagaggcatcacgtattgcagaccgcgagtcgcgtgattcgctggccccgaaactgcgcgacacccgtgaggacgcgtggcggatcggcaacgaactgttcacgatcaccaaggtgctcgatgacagcattcagctggagcgcgcactgaccgacccgtcccgcccggttgccgacaaggtggccgtcctgaaggaactgctcggtgacaacgcgcatccgatgaccatggagatcatgactgacttggtctcccgccgttggagccgtgcgcgcgacatcgccaacgcagtggaagacttcggcgtggacgccatgatgtactacgcggacgccactgacgccacgctgcaggtatccatcgagctgtccgagctgcattccgcactgctgaacctgccggtcgtacgcgccaagctgtacgactaccaggccaccagcgaggcccgtgtgaagctgttccgcgaggtgttctctggcaagaccctgaacaaggtcaccatgaggctcgccgaacacgccacttgcaacctgcgccgccgccgctacttggagaccatccagtggctgatcaacaagttctcccgccacatgggcgagtcgatggtcaccgtgaccaccgccaccccgctgaagaaggagcagatcaagcgactggtcgaggtctactccgccaaggtgggccgtcaggtgcacatcaactcggtggtcgacccgaccgtgctgggtggcatgcgcatccaggtgggcgacgaagtcacggacaacaccgtggtcgcacagctgcagaacttgcatcgcaaggtgcagacggaggcgactccggcctgaccggccgagccaatccgtccaacaccacacacaagcaaagacttgactgaacaataaccaatagaaggagtgatcatggcagaactgaccatcgatcccgcctcgattcgcaaggccctcgacgacttcgtgtcgtcgtacaagccgagcgacacccccacccaggaagtgggctatgtcgccacggccggtgacggcattgcacacgtgacgggattgcctggttgcatggccaatgagctgctgacgttcgaagacggcacgctcggcctggcgttcaaccttgacgcccgtgagatcggcgtggtgatcctcggcgatttcgctggaattgaggaaggccaggaagtgcgacgcaccggcgaagtgctttccgtgcccgtcggcgacggctatctcggccgcgtcgtggacccgctgggcaagccgctcgacggcctcggcgagatccagggcattgagggtcgtcgtatcctcgaagcccaggcccccgacgtgatgcaccgccacccggtcgacgagccgctgtccaccggcctcaaggccatcgacgcgatgaccccgatcggccgcggccagcgccagctcatcatcggcgaccgccagaccggtaagaccgccatcgcgatcgataccatcatcaaccagaaggccaactgggaatccggcgacccgaagaagcaggtccgctgcatctacgtggccatcggccagaagggctccaccatcgcctcggtgaagcagagcctggaagacgccggcgccatggagtacaccaccatcgtggcctccccggcagccgattccgctggcttcaagtacatcgccccgtacaccggctcggccatcggccagcactggatgtacaacggcaagcatgtgctcatcgtcttcgatgacttgtccaagcaggcagaggcctatcgttcgatttccctgctgctgcgccgcccgccggggcgtgaagcctacccgggtgatgtgttctacctgcactcccgcctgctcgaacgttgcgccaaggtctccgatgacctgggcggcggttcgatgacgggtctgccgatcgtcgagaccaaggcgaacgatgtgtccgcctacatcccgaccaacgtgatctccatcactgacggccagatcttcctgcagtccgatctgttcaacgccaaccagcgccccgccgtggacgtcggtatctccgtctctcgagtcggtggcgccgcacagaccaaggctctgaagaaggtctccggtacgctgaagatctccctggcacagtaccgttcgctggaatccttcgccatgttcgcctccgatctggatgcggcttccaaggcccagctgacccgtggtgcccacctgaccgagctgttgaagcagccgcagttccacccgtactcgccggaacaggaagtcgtgtccgtatggaccggcacccacggcaagctcgacgacctcgacctgaaggacgtccttccgttcgagcagggactgctggactacatcgaccacaacaccgatatcctcaagaccattcgcgagaccgaggaattcaccgccgacaccgaggctgccctcgataaggccgtggacgagttccgttcgacgttcgtctcttccgccggcaagccgctggtcgagaagaagccggacgttgacaaggccgcgccggtcgatcaggaaaagatcgtggcgggagaaaagtaagccatgggctcgcaactcgcattgaaatcacgcatccgctccaccgagtcgttggcgaagatcttcaacgctcaggagatgatcgcgtcttcgcatatcgccaaggcccgtgatgtggccctgaacgcgaagccgtacaccgatgcgattttcgatgccgtgcaagcgttggtggcccacacccatatcacgcatccgatcgcggtgaaggacgagaagaacccgcgcgtggctgttctcgccctcacctcggatcgtggtatggccggcccgtacacctcttcgattatccgtgaaacggagtcgctgctgtcccgcctcgatgcggcaggcaagcagccggagctgttcgtgtacgggcgtcgcggttcgacgtactacaagtaccgtaatcgtgacatcgcggcgacgtgggaaggcgacaccgaccagcccggcgtggaaattgctgaaacgatctccaacaccttgatggacgcctacatgaagccggctgagaagggtggagtttccgaactctacatcgtctacaccgagttcatcaacatggtggtgcagaaggtgcgcgtgctgcgcatgctgccggtcgaaatcgtgaaaaacgagaccaaggtgcccgatcctgatgaagaggcaccggctactgcggatgtcgctccgctgtacactttcgagcccagcctcgaaaaggtactggatgcgattctgccgaagtacattcagtcccgtatccacgagtgcctgctgaccgcggccgcgtcggaaaccgcaagccgccagaacgccatgcacacggcaaccgacaacgcacgaaacctgatcgacgaccttacgcgcaagctcaacgcttcccgccaggcctcgatcacccaggaacttaccgaaatcatcggcagcgctgacgcgctgaccaagaaggaagagtaggaacgcatatggctgacaaccagaccactgcggccgagcctaccaacggtcgcgtcacccgcgtccagggctcggttatcgacgttgaattcccggtgggtcatctgcccgacatctacaacgccctgaaagtaacgatcgtcaacaccagcgccaaggaagaaggcgaggcgaaggagaccgagatcaccctcgaggtcgaacagcacctcggtgattccacggtccgttgcgtcgctctgaagcccaccgacggcctggttcgtggtgcctccgtctccgacaccggcgccccgatctccgtgccggtcggcgacgtgaccaagggccacgtcttcgacgtgtccggtaacatcctcaacaagaagccggatgagaccatcaccgtctccgagcgttggcctatccaccgcaacccgccggccttcgatcagctggagtccaagacccagatgttcgaaacgggcatcaaggtcatcgatctgctgaccccgtacgtgcagggcggcaagatcggtctgttcggtggtgcaggtgtgggcaagaccgtgctgattcaggaaatgattcagcgcgtggcccagaaccacggtggtgtgtccgtgttcgctggcgtcggcgagcgtacccgtgagggtaacgatctgatcggcgaaatggccgaggccggcgtgcttgagaagaccgcactggtcttcggccagatggatgagcagccgggtacccgtctgcgtgtcccgctgaccgcactgaccatggcagagtacttccgtgacgtgcagaaccaggacgtgctgctgttcatcgacaacatcttccgcttcacccaggccggttccgaggtgtccaccctgctgggtcgtatgccttccgccgtgggttaccagccgaacctggccgatgagatgggttccctccaggagcgcatcacctcgacccgtggtcactcgatcacctcgttgcaggccatttacgtgccggccgatgattacaccgacccggccccggccacgaccttcgcccacttggatgcaaccaccgagctttctcgtgacattgcctccaagggtatctacccggctgtggacccgctgagctccacctcgcgaatcctcgatccgcgttacgtgggccaggctcactacgactgcgccaaccgcgtcaaggcgattctgcagcgtaacaaggagctgcaggacatcatcgccctgatcggtatcgacgagctcggcgaagaggacaagaccaccgtgaaccgtgctcgtaagatcgagcagttcctcggccagaacttctatgtggctgagaagttcaccggtcgccccggctcctacgtgccggccgacgagaccatcgaagccttcacccgcatctgcgacggcgtgtacgacgacgtcccggagcaggcgttctccggcatcggcggcatcgacgacctcgaagagaagtggcacaacatgcagaaggaactgggtgcgtgatggctgcggaaaaaaccacgatgaaggtcaacatcgtcgccgctgaccaccctgtgtggcacggcgaggcgacgagcgtgaccattcccgcctctgagggcggcatgggcatcctgcccgaccatgagcctgtgctcacggtgatcaagcagggtacgctcaccgtggttgagcccgatggcgatcgccacatgttcgaggtgaccgacggattcatttccttcgactcgaacaaactcaccgtggcggtcgagcgcggccacgacgtccagtactccggcaccgccgagtgacctgaaccaactccttaaggggctctctggttttccagagagccccttttgctatgtatgccatgtgttgcgctacagtggtggcctatgcgagttattgttgccgactgttcggccgagtattcgggccgcctcaacgcctcactgcccctggccaagcgcgtattgctgatcaaggccgattccagcctgttgattttctccgaattgggctcctacaagccgctgaactggatgaccgcgccctgcacgattcgtgagatcgacccagccgccaaatccgcgcaacattcccgggaaagtgtcgctggtggggctgtggatggtgattctgcgacgcattccccggaaagtgtcgccgctggtgagccggaaaaggtgctacgtgtcagcgccgacaagggttcggacattcttgaagtgacgctgcagcatatctattccgaccaaacctatgatctgggcgaagatccgggtctcatcaaggatggcgtggaagaccatctgcagcgctatctggccgagcaaatcgagcgtatcggcaagggagccaagctggtgcgtcgcgaatacccgaccgccattggcccagtggatattatggccgtgaatgccgagggcgagcatgtggctgtggaaatcaaacgtcacggcggcattgatggcgtcgagcagctgactcgctactgcgaactgctcaatcgagatccgctgctggccccggtgcacggcatcttcgccgcacaaaccatcacgccgcaagcccaggtcttggccaaagaccgcggcttcacctgcctcatcctcgattacgacgatatgaaaggcaccgaggacgacagtctcaggctgttctagatatagcaggggctccctcatcagagggagcccctgctatatcttttagtacgcggcgagaatatcgattacgaagaccaacgtggagttggcgggaatcggaccttgctccttatctccataggcctgatccggcggaatcaccagcagaacctgagagccgacggtctggccgaccagacccttctgccagccctcgataacctgatgctggccgctggaatcgctgaacagatcggcgtcgattgtggaatcgcgatcccaggacgaatcgaactgcttgccattcgtaagccaaccggtgtacttgaccaccacggtgttcttgtcggtcagcttggcgccgttacccttgatcagcgtctgcgagatcagcgaatcaaccgaaccctgaccgttcatgtcgatggacggctcgccgtttttggctcgcgtcaccttcggcagattggccggcacatccttgacttcctcgccagtggccttctccaagtccttggacttggacacaaacgtcatcgccagaatgtaagagtacccggacgaatcctgagcgttgacgccaaagccaatcgtggtgttgatcttggcacccttgatctggttgtagtaggtcgaggagagggtcttggaatccaccttcagcgagcaatccggcgtgttcttggtccaggtgtccatgagctcggttccgtctttaacgttgagcgcgatgccttgggcgcagacgcggtcgccctcctcgatcacgtcgccatcgcccttctgcagcaccacataagagccgtcggacacggtcatcggcgtattaaaggagatggtcggcttctcgccgagcttgcccttggcggtcacgccggcaatttggcccttcttgtcagaagagtcggaagatgaagaggaatcggaagaagaggatttcgagtccgagctcgaactggagcaggcagccagcgacacgcacatcgccagcgagcaggcaagggcaacggccttgccgagggggataacatagacttaacagacttacgcatgacacatcaccctactggtaaaccttgattttctgcgctcctaggtaataaacaggtgaagattgtagaatggttgagttatgagtgctgaagaacagactacaagaccggataagggcgccaagcgtccatcccgtcatgccaaaatcatgcgtggagtggtgacgcctatcttcggactattggccgtggcggctgtggtgttggggtacatgaatgccacgatgtggaagccctccactgaaatcaccgcttccgcaaccatgagcggctcccggtatgtcgtcactgatccgaatgtgctgaccttgttggatcagaatgccacgataaccgtggactcgggatcctctcaggacgaggcgtgcgtggcgttgggttcgtccaaggatgttgccggatgggtcgcgtccgagaagtcctatacccgcatcaccggattggcatcatggagcgagctgagcacccagaagggaagcagcacgagtcagggagcgcctaccagtgccgatgacgcggtgtcgttcaaggattccgatatgtggactgccgtgaaatgcggcactgggtccgtttcgctgaagagcaagaagaccggcgcctcgacggtagccattgtggatttgggcgaaaatgtcaccaacgccaaggtgcagctgcactgggtgcgctccgaagtgccggactttgcgatgccgttctatctgtccggcggattgctggccgtgctggccgtactgtgcgcctccgtgttcgccatgccgccgcataagcgccgcaagcgcatggtggaaggcatggcaagcgccgtaatcgaggaagaggcacccgccagcatcgcagtgtccgggaagccggatggtgcaagtcgacgtaatcgtcgccgtcacgccacacatcggcgttcgggccgtgcgtcctcgcaatcctcgcaatctgaagccaccgaaacaccggttatcatcgacccaagttcgcgtaacctggtcgccgaccagcagaccggtgccgaaagcggcgctgagcccggcctcagcgccggcgataacgaatcgacttcggtaatcacccctgacgaactgcaggcctacttctcccgcttggcccaagaggtcaataccggagacgactcggccgatgacggacaggaggaaagctgatgaacaagcgatggaacaaactgtgtgtgtccgccctcgcctgcatggcgttggtcgtgccgttgaccgcctgtgaaggccaactgccgacgccggctgctgatacctccaccaaggttgcgccggatttgaccgaggcgcaggagaagaagattcgtctgaagattctcaagacgatcgatgaagccgatcaggccaagaatcccgatgggtatgcgaccgttatgggcgggccccagctggacattcgcatcagccagaccacgatcaatcagcgtggcggcggtatgtccgaatatgcgaccattcccaaggacatcgcccagacggtgattcctacggacgacggatggcctcgctcggtgttcaccatcacgaccaccaccgaagatcagcagtccaagcgtttgctggtcttcgatcaggaatccgcccagcagaattacaagctgatggctatggctcgactgtttgagggcgccaagctgccgaagttcgagattccgactattggctcgcagatgggcaccgcaaaggatgagaagctggtggccgctcccgccgatgccttggcccaatacgccgatgtactgcagaacggctccaagagccaatacgcttccaagttcgcagacgatttgctgcgccaggaactggccaataccacggccaaggtgcaggaaggtatgcaacgcaacaacggtacgcaggagcaaaaattcaccgctgtgcctgaacagatgtgggtgatgcgtgctgcagacggtgccggtgatctggtggttggccgtattaacggcgaatggactcgcaaggcaggggatggccgcgaatcgcagccggcttccgacgacgagaaggcgctgttcaatagcgacaagtacaccagcaccatgaaggtcacgtatgtgaacgtggtggccttgtacattccgttggcaagctccggtgagcaaatcaccgccgtgggtgccgaccgtcagccggtaaaggtcgaagcgctgtagttgttgccgccgcccaccgcgcggttaacgccccaccacgatatgattcatccaccacgatgtcggtaagttttacctttcgcacaatggtgccgttttgagtcacatcgtggtgggcgttttgctacgtggtgggaatttcaccgcgtagtggaagaatccctacgtggtgggaatcggcattacaatcaatgtcagcaaatgtgattgttgttgtacgcgaatcgcgtggaatcgggaggcattatggcagagcagcagttcaatccgggagtctcattggcgggcgccgtcgatttggaggcgctgaagcatcaggtcaaggccaagcccggccaggcgggtggcgctcctgccgctggtgggtacgtgatcgacaccaccgaaaacaccttccaggcaatggtgcagacttctgcgaccttcccgatcctgctgctcctgtggataccgaccgatgaccgcctgttcccgatggcccgtgcgttgggcgacgcggtgaacgccctgaacggccagattcagctctcccgtatcgatatctcgtccaatccttcgattgcccaagcgttgcaggtgcagggcgcgcccgcactgttcgcgttgattgccggccgtccgatgccgctgttgcagggccttccgggtgacgacgagctcaagcaacttactgacgaggtgattccgaagattattgaggccgccgcgcagtctggtgtgaacggtaccgcgccgtactcgggtgatcctgattccgatgccgccaagagcgctggtgccaccggtgccgtcgcgggtgctgagcaggtgccgccggagcatgccgaagcccatcgtttggccgaggagggcgattacgccggtgccgccgccgaatacgagcgcgtgctcggatccgacccgtccgatgcactggctgcccgcgaacgtgcgaaggcgctgttgctggcccgctccgggtccgctgatgtacgtgacgtgcgtgccgctgccgccgcagcgccggacgatgtggaagcgcagttggctgtggctgatatcgacatgatcggtggccagattcaagacgctttcgaccgtttgctggactttttggccgccgggcacaaggccgatatcgagcaggttcgcaagcgtctgctcgaatacttcaccatccccgaacccaccgacccgcgtctggcccgcgcccgccgtcgcctagccaccctcatgtactgattggttttggctcccctctttgaggggagctgtcaggcgtagatgactgaggggagcgcgcgagcgtacttgattgcttcccctaaaccatccgattcttcccgaaatattgctggaaccttggcccctccagcgccagttcctcctcgaaatcatccgcccacttacagaacggacggttggcgagaccatcgttattgaatcgcgcctgatcggtgatttcggtgatgcagaatttcggaatcgtcagattggtaaccggcccggatcgttcggcctcggctacgatcagcggcgcgttcggcccgccgaacacgtccacgctccagccgtcttcctcaatccacacggaataccggttcttgatgattaccgagccgccgcgcttgatgagttcggccgcgatacgcgtatcgatttcgcgctcgacttcgtagcgcgtgccgcccacggacggacctttgacggtgacatatgcttccgagaaccggtcgcggtattcgtccagcacggccaccggatttacgtcgggcgtcatgtcgacgtgaaccttgcgcgagaccagccgcacgcgcaaggcgtaattgtcggcatgcacgtagtagctctgaatgatgagggtcggggcgtcgccgtcgtcgtattccgccggcagttcgcggcagaagaagcggcgttcgtattcgaagtcatctgtaggttccgacataaccccattgtagagccgataatggcgattttctcgttattttggcgacgtatgtgccgcatgcaacgtgatgtggtgtacagtaaagaagttgctcgggtttgtagctcagtggatagagcgtctgtctccggaacagaaggtcgtgggttcgatccccatcaagcccaccagcatggctttcggctaaccgccggaagccttttgcatattcggcgcgtgcaaggctggtgctggtgtcggcaatggcaaggccggtgatgccggctcgcttgggtcgtggaaaaaccgtccggtttggcgagaacggtagccgaatcgtctggaatcgtctggaatcgtctggaatcgtctggaatagcaaggaatagtctgttgatggccgtatgccgggcatcatgcgcgctaaacgcgactttgctcagtagactgctacgtaatcggcattgccaatcgttgctgatcgtgcgattggtcgtagccggtggtgatgtgtaccggcgccggccgcagcaggtgggcgcccccaagatgagaaggagcacaatatgagcgaaaagatggaagccgtagccacttccgaggcgccggccgcgctgggcgcatacagccaggcggtgaaggccaatggcttcgtgttcgtatccggccagctgggcattgatccggccaccggcgaactggcgggcgagaccgctggagagcaggctgcacaggcgctgaagaatattaagcacattctcgacactgccggtaccggcattgagcatgtgtgccgtgccaccatctacctgaagaacgtcgaggacttcaaggaagtggacgcacgttacgctgaggcgttcatcggctccgtcaagcccgcccgcgtggcctttggcaacaacatgattcccaagggcgcgctcgtggagattgacgccatcgcggtggagtgattcgaacgtttccccggcggcccgtctgcgcgcatggtgtgtgcagacgggccgccgcgtattgtgcgacgcattccggggaatgtttcgctgggcgggggtgcgaggtgtggttccgcgacacgttcccgggaacgttgcgctggaatcgttgggcggtggtccgtgccacaatagagaccatggcatccaaaggaaaaccgtcgccgcgttcggccgtaagcccgctgagtgatgagcaggtcaagcgtctggccgcccgccacacgcttgtggactcgacacagtattacccgaccggcccccgcacgcccaatcagccggaaatcaacgcccagaatcccaaggccaccaaacgactgctgggaggggtgtccattgtgttccgcgccagctgcaagaccaaggcctggggcttggaacaggtgccggaaaccggaccgttcatcaccgccgccagtcatgtcaccatgtttgatgtgttcgtgccaatgatgagcctgttccacatgggccgccgcccccgttacatggccaaggccgagatggcgaagtggccattgatcggcaagtggttccagttggtcggcatgcagccggtgcagcgtcattcgggcaaggccaagcagatcgaagagacctcgattgatattctgacgtccggccgcccgctgacggtctggccggaaggcaccgtgacccgcgacccgaaaaagtgggtgatgagcattaaggagggcgtgggatatatcgcccttgaatcctcgcgcagactggggcatcaggtgccgctgtacccggcggtgacgtggggtgccgcctccatcaaccactggtggccatggccgcgcaaaaacgtggtgatgtgctatgaccatgcgctcgattactccgatttgcttgccgacatggactcatggggtgaagagccgcctgccgaggccgtgaacgagctgatgtggcgcgtgctcaaacgcatgaacacagtactggaggaaattcgtggcgagcagttccccgctgaaggctactgggactaccgcagtatgagtcgtaagccttggcctgaagccggcggcccgttcccggctgagaagtagccgcaccggttcccgtacggggagcctaggcgagtagcatggcacaagattgtgccgatgaagttgcgcgacaagcgaaggtaggaatttgatatgggtaaaaatataacggttctcggtgcaggagcatggggtactgctttcggccaagtgctggcggacgcaggcaacacggtgaccatgtgggccaaggagcagcagattgtcgagggcattcgcgatcaccaccacaacgccgtgcgcctgccgtccgtcgaaaagttgccggacaacatgaccgccactggggatcgcgccgaagccgtcaagaacgcggacatcgtagtcgtggccatcgccgcgcagttcgcgcgagtggcactcgtcgaattcaagggactgattcccgatcacgccatcgtcgtcagcctgatgaagggcatcgagcgtggcaccaacaagcgtatggacgaagtcgtccgcgaatcccttgacttgccggccgaccggttcgccgccatttccggaccgaacctgtccaaggaaatcgccgatcgtcatcccgccgccaccgtggtggcttgcacgaacctcgataatgccacgaaggtggccgaggcatgcaccacctcctatttcaagccgttcgtgaccaccgacgtcatcggcctggaaatgtgcggcagcctgaagaacgtgaccgcgctggccgtgggcatggcccgtggtgccggctacggtgagaacaccgcagccatgatcgaaactcgtggactggccgaactgaccgcgctgggcgtagccgctggcgccgatcccaagaccttcttcggcttggccggtgtgggcgatctcatcgccacctgtggctcttcgctgtctcgtaactatacgttcggcgcgaatctcggcaagggattgacggtcgaagaggccaccaaggtcagcaacggtgtggccgaaggcgtgcccaccacggatgcggtggtggctcttggcgatcagcttgatgtgccgaccccgttggcgtatcagatgagccgcgtgctgaacgaaggcatttcctgctcggagatgcttgccggactgttcggtcacgaggttaccggcgaataacgagagaagcgacgtatacgtggcgtatacgttgtacgtgcaaagtcgcgtggcgtatacgtcgttgacgtgcacgagtagactggtgtgcgtctcttgtgcgcggcgttccgagcgcggttcggtccggttggcggtgcaaagcataggcttgaaaacggttgtagtttcaacaaaaggatggttatggccaagaagcgtgttgtggtgctctatggtgggcgtgcagacgagcattcgatttcctgcatctccactgccggtgtgctgggggccatggacactgaacggttcgagccgattccggtcggcatcaccaaggacggcaagtggatcatcaatggcgaagatccgcgtggctggaacttggacggcggcgagctgccgaccgtaaagatcaccccggaatcgcgcccggtgatgcttgacccctctcgcggacaggacggtttcttcatcggcgagcccagccacatcaattccgccgattccggcttcggcaccagcttcgtcagcatgtccgacccggaaatgcaccatgtgctgacctcccttggccatgtggacgcggtactgccggtgctgcacggcccctatggcgaggatggtacggttcaaggcctgctggaaatgatgggtgtgccgtacgtggggtgcggagtgtttgcttccgccgcctgcatggataagcattacaccaaggtggtactggatgccgccggcattcccaccgcgcccggtgtgacggtcgatgcgcgcaacttcaccgccgccgatgtgcttgccgagatcgaggacgccggtcttacttatccgctgtttgtcaagccttcgcgcgcaggctccagcttcggtgtgaccaaagtcgagaaagccgatgaccgcgagacccagcaggatcgtctggccgccgccatcgccaccgccggcgagcacgactggaaggtgctcgtcgaacaggggattgatggtcgcgaaatcgaatgtgccgtgctgtgcccgaaggccggtgacgagcccgaggccagctggcccggcgaaatcgtgctcgatcatcagaacgacgaccagttctacgatttcgactccaagtacatggatgcctccgccagccacgtggaagtgcctgccaatctgccggtcagcgtgcttgaggacgtgcgtgacgtggcccgtcgcgcgttcaaggccgtggatggtgccggcttgagccgtgtggacaccttcgtgacgcctgatggcacggtgatggtcaacgaaatcaacaccatgcccggcttcacgccgatttccatgtatcccaaggcttgggatgccaccggagtgagctacaccgaactcatcacgcgattgattgagggcgtgctgaggtaagtgtggtgcggaatcggccgcaggccggttccgctattgacacatcgcccatacctgtcagtaattcatgccaagttttcctaagttcaacaggcgtacagcaaatggcgaacgcaattcacttgcgcgccagtgtcaggacagattaggcgcatagtttcttttcttggattcacgggccgcgcgaatgccgcgcataccaagcccgactccccagactgtcgtctggatgatgttgagaaaaggaacattatgaacaacctgcgtaagatcgcggccggctccctcgccgccgtgctcgcgttctcgatggccgcctgcggctcgagcaacgcctcctccgatggcaccggcgaaagcaccggcaaggccgtcaccgtgaacgaaaagtccgccaaagccacctccctcgccgacttcggcaccatggaagacctcgagaaggccgccaaggaagagggcgcgctgaacgtcatcgcccttccgcacgactggtccaactacggcgaggtcatcgagagcttcaagaagaagtacccggagatcaaggtcaccgagctcaacccgaacgcctcatccaaggaagagctcgacgccgccaagaccaacaagggcaccgacgccgcccccgacgtcttcgatgtcggccaggccatcgccgccacctccaccgactacttcgccccgtacaaggtgcaggcctgggacaagatcccggacaccgccaaggacgccgacggcgcctactacgccgactacaccggcatcatgtccgtgggctggaacgccgacaagtacggcgacatcagctccctggacgacctgctcgacccgaagttcgccggcaccgtggccctcaacggcaagcccgccgaggctggcgccgccttcaacggctacctgatggccaaccagctcgccggtggcgacatcaacaacctgcagcccggccttgactacttcaagaagctcaaggaagccggcaacctgaccaccgtcgacgtgaccaacggcaccatcgactccggccagaccggcgtggtcttcgactggacctacaaccaggcctcctacaagaaggagctcaaggacaagggcgtgaactggaagtacaagaccttcccgaaggcccaggtcgtcagctactacaaccaggccatcaacaaggacgcgccgcacccggccgccgcccgcctgtgggaggagtacctgtacaccgccgacgcccagaacctgtggttcaagggcggcgccaacccggtgctgctcgattccatgaaggaagacggcaccgtcgaccaggccactctgaaggacgccatcaccatcgaaggcgagccggtctcctacaccaacgacgactccacccgcatcaccgagtggctccagaacaactgggacaagacgatcggcaactgaggcacagaccgatgaccgccgcaatcgcacccattgcatcgaacggacctgctgccgccaaggctgcgggtccgtccgctactcccgcttctcctctctcctcggcgatggccaagcaccgccaggagctgggcacgctcgccaccacgctcccgttcttcgcctacaccgcctgcttcctgctcgcacccaccgtcatcgtgattgtcggtgcattccaggatcgcagcggcaacttcacgctcgcgaacttcaataagatgttcgaggccaacaccatcgccgcattcggcacctcgattctggtgtctttagcatcctctctgatcggcgcagtggtgggcgcgctcgcttcctacgcactggtcattggtgccaagccgaacggcctgctgcgtcgtatggtctccgccatctcctccgtgcttgctcagttcggcggcgtgatgctcgcgttcgcgttcatcgccaccatcggcatcaacggtatcggcaccatgcttatcaagacactgaccggctacaccgtgaacccgaactggctcagttcgttgccgggcctggtgaccatctactgctacttccagattccgctgatgatcatcatcttcctgcccgcggtcgattcgatccgtccacagtggcgcgaggcatgcgaatccctcggtggcaacacgttccagtactggacgcgcgtggcctgcccgattctggcaccccgcttcatctccgcgttcctgctgctgttcgcctccgcgttctccgcatacgcgaccgccgcggccctgttctcccagcgttcgattctggtgccgcttatgatccaaggtgccatgcgcaacgaactggaccccaaccagcagggctttgcccaggtgctggcattcgcaatgatcatcgtcgtggccatcgtcatgctgttgagccacgccgtggaaaagagggccggacgttggcaatgaccgaaacttccgcaaccaagccgccgcagctgcgcgccgctcgtgcgcgtaaacagagcatcatcaaattcgtgatcctgttcgtcaccctggcgttcctgttcgtgccgctgctggccatgctcatcttcaccctgcgtcacccgctgtccggccgctggtcggccgcgccgtggatcgcgattttcaccggcaacggcgagtcgctgggtgccgacctgaccgtgctgtggcagggcatcggcacctcgctggccctgagcgcggtcaccgtggtgatcatgctggtgctgctggtgcccaccatggtcatcgtgcatattcgctccaaggttttggagcgcgcgatcgaatgggtggccacgctgccgctgaccatcccggccatcgtgctggtggtgggtttgggcccgatctaccgctggctgtccgccgacgtgctgagcaccaacccaatctggctgtgctttgcctacgtgattctcgtgatgccgttcgccttccgcgcgatcgccgtggggcttaactccatcgacgtcaagacgctggtcgaggcatcccgctcgctcggtgcctcctggcccaaggtgttcttcaaggtgatcatcccgaacctatggcagtcgattctctcggcatcctttatctccatcgccgtggtgctgggcgaatacaccgtcgcctcgctgctcggccgtatgaacctgcaggtcgcgctctaccagctcggccagtccaattctcaaatctccaccgccatgtcgctgctggctctgctcttcggtgcggtgctcctcgttgcgctcgacctgatctccgacgcaatgcgcaagtcaagggaaggtaagtaacctgatgaacagcaattcgattttcacccgtcgccatgccggtgccgatgccgcggcttctgtttcggcacccgccaccacgtccgctgccgccgaggacgccttcaagaacgatcccaccgccaccctcgaaggcgtgcgcggcaaggacgtgaccaaggccgccaaggccctgctcaaagacagcgtcaagcgcggcggcggctccatccagatgcgcgacgtcgtcaagatctaccccggctccaccgttcacgcgctcgacgacttcaacctggacatcaagcccggcgaaatggtcgtgctgctcggcggctccggctgcggcaagtccaccgcgctgcgctcgctcgccggcctcgaagacatccagggcggccgcatcatggtcggcggccaagacgtcaccggcgtgccggtcaacaagcgcgagatggccatggtgttccaggcctactcgcttttcccgcacatgaccgccctggagaacgtggaattcggcctcgaagtgcgcggcatgggcaaggcagaacgccgcaagatcgccatggaacagctggagctcgtgggacttgccgatcaggccaagaagtacacgcagcagatgtccggcggccagcaacagcgcgtggccctggcccgcgcgctggccgtcaagccgcgcgtgctactgctcgacgagccgctctccgccctcgacgccaaggtgcgcgtccagctgcgcgaccagattcgccgcatccaactcaccaccggcaccaccaccgtcttcgtgacccacgatcaggaagaggcgctggccgtggccgaccgcatcggtgtgatgaacaagggcaagatcgagcagatcgccgccccgcagaacctgtaccagcgccccgccaccgagtacgtggccacgttcattggactcaccaaccgcctgcccggcgcatccaatggcgacgaggccgtggtcttcggccagcgcgtgccgctgctcgccggctccgccaagggcgattccgtggccgtgctcgtgcgcccggagaacctgacgctggccttggccggcagcagcgattcgcacgtcggcgaacgcgcccgcgtggaggtcattcacttccttggctccttggtgcgcgtggatacggtcattacctccggcgaataccagcgctggaacaagggcgaacagctcaaggccaccgtgcagctgcccgccagcgagctgccggccggtctggcggtgggcgatgacgtgattgtcaccccgcgtccggtcgccgcgctcgcctgctgaatggcgttgcgatgatcgtgcggttctgttctgtttttgtgactgtacgatcgtcgaatggcttatcggcaatgatgtgtgtgggacggcggcgatttttgggcgattatcgcgtgccgtcccacagcaatcttgcagagtaggggactttctcggcattgggaatgattgacgttgatcattccttgcccattgatgatttcctcccccattcccaatgcaatcgaaacgccgtgccgtattcttgaagagtattgcacgtgtgatcggtccgtttgcggccagtaactatgggggataagtatgagcgaaccaatgccgccggcgcagcagccgcaggcacctcagcaatcgcagcagccgcaacaatctccacgcgattggtggttcacggcccatcgccggttttcgacaatcggctcggcgctcgccattatgatggtgttctggatcggactgaatattctggccactgaagcactacgaacgctgcttggcaccgatgtgcccgcttgggctgtgctgctcgcctcctccggaccgctgtatgtggtggccatgccgctgagtatgttggccttcactcgcgtaccggttattcgcacccggcagtaccccatgaaggcgggggagttcattcagattttcgtcatgtgcattccggtaatgttcttgggcaatatgattggcaatatattgtctgccggagccactgatggtcaggccaccaatcgcatcaacgacgtgattcttggcagcgactggcgggtgaacgcattgttcataggcctgttggcaccggtttgcgaagaatggatttttcgcaaggagattatctcccgcctgcgccggtacggagagaagaccgcaatcatattctccgcattggcattcgcgctattccatatgaacgtgttccagttcttctacgcctttggcctaggactgatgttcggatatgtatacacgcgcacctcccgactgcggtattcggtggctatgcacatgctgatcaacctgaacgggtcagtactcgccccattggtgatacaacagatcgatccccgcatcctcgacggcacggtcagcgaggccgaaatcatgcgtatggctgaagccggcaacatgggcgacatgggcatcatgatgttgtacggcacagtgatgttgggcctctgcattgccggtatcgtactgcttatcaccaagcgcaagagctgggagttctatcttgcgccagaggagttgcctgcggggcttaaaatacgcaccgcctatgccaatcccggcgttatcgcgtacctactgttgactgtgatgcttaccggttggatgctgttcgcatgactgtcatagccggacccagagaggcgagccgggagatatcacagattgcctgacgagccgccatcttcaacaaggtattcggtgcccgaaccggcgatggctcgcgccgccatatctttgatggtggaaggcagcacaccctcgcgcgcgaacacaagcacttggccggtcatgccgtaaggggagaagccggtgaacttgaccaatggcggctgaccctccagcgccacgtcggcggtggctttggttacgcggtcgagaatatcctgactgatcgcagacgggtcgccggaggccttggccgtgaactcaagcgtggccatgccttcgctgaccggcgtgagcttggtcagggcggccgtattgagtaccgaattggggatgaccatcatgtctccggaacgggtgcgcaccacggtctgacgccaggtgatgtcgtgcacggtgcctgtgacgccttgaatggtcaccagatcgccgggttggattacgcggcccagcatcaggccgaagccgccgatgatgttggcgattgtatccttcagacccagcgagatcgccacacctccaacaccaagggcggtgataagtgtggtcggattgatgccgaatacgggctgcagtaccatcgctgcgccggtgacccagatggtcacgcgcgtgaggttcacgaaaatcgaggcgctgggaatctgagaattgtccagaatcttgcgcaacacgcggctgatgacgcggtcggccacaaatacgatggccaatacaatggtcagccagatgagtttgccggcgttcacctgaaaccagcgtgcgatgtcttctgcatattcagtcatacgcctactgtatcggtcgtttctggtgaagtcgtggagacggggtggcagaaagcggaatcggcctacggtcgattccgctactcctggcgttcgcggcaggtctggccgaggccgcgggccagtcgaatcggatcgagaatctcgtccaactgctcggcgggcaggtcggtgcgttcgccggccacctcgcgcacggtacggccggtatgtacggcttcggcggcgatgtcggccgcgtgctcgtagccgatgtagtggttgagcgcggcggaaatcgacggtgaggactgggcgtatgaacgccccaggtcagcattgatttcgatgccttccacgcagttgacgcggaacgtctccatggcgtgcgtcagcaacgccatgccggtcagcagctcatgcaccatcaccgggtcgaaggcgttcagctgcaactgtccctcggccacagcccagttcacagtcacgtccatgccgaaaatcgtgaagcagcactggttgacgcattcggggatcacagggttcactttggccggcatgatcgacgatccggcctggcgagccggcacgttgagatcgttgaaaccgcagcgcggcccggaattgagcagtcgcaaatcgtcggcggccttcttcaggtgcacggcgaggctcttgatggcagccgacgtggccacgtacgcgcccatatccgtcatggcggccaccggatcgggcgcggcggtgaccggcagcccggtgatttgcgccagatgcttgatagcggacttgcggaatcgcagatccgcgcaaatgccggtaccgatggcggtggcaccgaggttgagctgggccagcagcggcaccacgcgatcgaatgcagccaaatcagacttcaacagcgtggcaaacgcatgaaattcctgaccataggtcattggtacggcgtcctgcagctgcgtgcggccaatcgtcacgtcattgatatgtttgtcggccagatcgtggaaggccttggcgagtttcttggtggactcggcgagcggcccgatcgcgtcgataagcgcgagtttgcaggcggccgggtaggtgtcgttcgtggactgcgacttgttgacgtcgtcgttcggatggatgtatgtgtaatcgccgcgctggcggccggcgatttccaacgcacggttggcgatcacctcgttcatgttcatgttcgacgaggtgccggcaccgccctgcatcacatcgaccgggaactgatcggccagtttgccggcctcaatttctaggcaggcggcgcgaatggcctcggccttggctgggtcgatcaggcctaattcctcattggcgatggcgcaggcgcgcttgaccgtggcataggcgcgaatcagctcgggatgttggctatcggtgatgccggagaccgggaagttgccgatagcgcgctgggtgtgaataccccagtagacgttcgccggcacctccatctggccgatgcagtcatgttccagacgggtcttgttcgatgtttcgctcatgcttccatcttcctgtgcgtgggttggaaacgccagcatgagaggctgattgcgccttgtgagaaacctcacgcgaggttcgtgcggcggaaacaatccagactcgctggttttcggtcaagcggtgtacccggggaatcctgcggggccgttcgacgatgagatggtggatggcgcggcatgcgtggcggcgaccggcatgccgggggcggtcgaatcctgcgcattgtgcacgaagatgcgattccagtaattaagcatgtccttttggctcatggccaggtatatgcccatggccagcacggccacatcttctttaagcaggtctttgatttcgatggtgtcgctcaattcgggccaacgttgcagcacggcgagcatgccgcccacggtgaactcgaccatgagatcggttttcaggtcaaggttcttggggtcgcgttgcaatgtgctgagcatttgcagacggcagaagtcgcgcagcgattcggtcagttcaagcgtgctgtgcgggcctgccaacagggccaggtggtcgaggcgctgacgctgctctggatcggagagcgtggcggtgacgcggtctcgccattgttcctcgggattgccgttcggatcgggggtgcggttgatcggaatcgattcgacctgatgcaggatggctgaatcggccaattcgggcaggctggagaagtgatagtagaacgaattacggttcacgccagcctcacgcaccacgtcggtaacggtgatcttgcgatagtcgcggtcggcgagcaattcccagaaagcgttctcgaggcgttctttggcgggcagcacctcggaatcatggcgtggacgtggcatctcttcctcctgatgcaccagcgtgatatggtcacgctgtctaataacttattgggcagtataactattatttgtggacatgtctatgagctaatcggcgatttcagttgcgtcctccgctgatggcgaagctgtggtgccggcatcggcatcagtatcggctctggccggagctgcgctatctgctcctgctgcagtttctgctgggatctcggctgttgctttggaggtcgcagaacttggtgcggaagccggggcgggcgtcggcttgcgtttggccgtggacgccttgaacagtatcgccagggcctcaaccaaatgacgccggtctgcgggggtcagcccaacgtacgcgccaagcatcgccggaatcgaagcggggaagttgctcatcacctcgctgaagctggtggcgccgttggcgtgcagcacggtgaacagcgcatccaccgcacgctcgcgctgttcgggcgtaagcgtggcgatccaatggttcagctcctcgttaaacaactgcgagctggaactcaaatccggctcggtgatgaactggtcaccatccaatagccaggtgaaggcggaatgctgcatgatgccatccgaatcggaagagaccacgcggcaaggctccggggtctcgaaaatcatgcccacaatcgacgaactcggcacgattttcgtcaccttcggctggatggtgcggtaggcggggctggtcacaatctccggcgggaaaccggggccatccagtgaatagacatgctgaatgcgcttgcgcaccttgggatcggcgttcatggccgcgtaaatcgccagattgcctcccttggaatggccgaccagaataatcggaccctcccacagtcgcgccaccatatccagataggcgctggctgaacgttgcgccggcaccggatactggaaagccatattgaaatcttccttccatccgatgagcgaatcatcggtgccgcggaaggaaataaccaacgtgcctttgtaggtcggctttcggcgcttgtggccgtcgggcagttggaaggtggcggcggcgaattgggtttgctcaccctgattgatgtgctcgaccaccgcgcccaggcgaacgttggcgtagcgggggttttcgcctgcggcctggaacaggtcgtgggtcaggtccgggttgaccactgaaaccatttgggcttcgtgcggcttgtcgtcggcatgtgtttccggcgaacgatgcagctcgcggttggcctcgtcaaggcttaccgattcaagctcgggatgccagatacccttcagccagatcagtggatgcttgggttcgaaagcgcgaatgcgtgcggcgaacgagcctgaccgcgtctcatccagcatcaacgtcggacagacactggccacatcctcatagatgagcgtggagatgatcaaggcgtcgatttcgttgaacggcaagtcggcgaaggagcgcgtttcggtgtgcgcgtaatcgataatgccggtcatgcgcacctcctgcttccgttgatattgcatatccccttgggctgcgtggtcttgcgatcgcgtgcggccgtgcggctgcgcgcagcaattaaccatatgcattccattgtagggattgtacggttttggccggcgcgatcgagcaagactgcaccgacggcgaacaattcgtggaaggattcccgtcggcttgtcgaaaattgtcgggtagcagggttgcgatgccagccagccgaccaccctccggcgctacgcgccatctcccgccggcgggagggttaaccactcaatcctttttgacgaggcggaccgctgggcccgtcaaaggttcggcagatcgaagcgcgccagatccacgccctcgagttcaagcaactcggccttgatgtcgagtcggccgccgtagccgccaaacgcgcggcccgagccgactacgcggtggcagggcacgatgatggtaaccggattgcgcttcactgcgcctccgaccgcctgcgcggccatgcggccgccgccgcgtcgttcggccaattcggcggcgagttcgccgtaacttaccgtcatgccataggggatttcggccaccagattccacacttcatgttggaatggcgtgccggcgggatgcaaaggcggcacctgatccgagccggggcgttcgccggcgaaataggcggtcagccattcgcgggttatacggaatacgtcgggttcactatcggattcgcgattcgaatcgagaacggcttggtgatcggtggcccaccaccagtcttcaagacagagttcggtaagtccctcgccgtcggaggccatcatcatccggccgatgggcgtttcgactgtggcccgcatcagttgtcgttgcgtcataccgccattatcgcgcgttgagggatgaagcccataccgtgcctgattccatgaaggacggcacgtcggcgtagttcgggaacttcacttcggcgctcgataatcgttggaaaaccggtgggacacgcgggggcttggctttttcctgagattggcgtatctttgtcacctgttgcctgtgaaggtaacacatgcggacatagcttagttggtaaagcgcaaccttgccaaggttgagaccgcgggttcgagtcccgttgtccgctctcggatggttgattcatgctgattgattcgaccggatgatgacccgggcggttggcgcagtggtagcgcacttccctgacacggaaggggtcacaagttcgaatcttgtatcgcccactcgatgaatcgccggcagaatgttgccggttttttcatcacaggctcgggcgattggcgcagcggctagcgcacttcgttcacaccgaaggggtcgtaggttcgattcctacatcgcccacccgagattcacgctcgttggccatgtggccgcgagcgttttttcataatcgatgtattccgattatgccggtccaatcggggtgcgggctagaatgccgcggagccggcagaatggcgggattccgccgatgcaacctgtggttgcgcgcgaatatgcaacctgaagatggtggcgcggaactggtttgccgtggcatagtgagggcatcggccgaatatgtcatgatgagcattacctatgaagggacactccgatgagcttccgcgccaacctgcaatacctgcgcgcacaacgcaacatgccccaggaacagctggccatgttgctcggcgtctcgcgccaggccatctccaaatgggaatccgagaaggcctatcccgagatggacaagctgcttatgatctgcgacctgttcggttgcacgcttgatgacctggtacttggcgatgtgagtgcgagcgtgaacgtgggtgcggccgcgcgcggcgcagcggagggcgaccatggctcggctgccagaaccgtaaccggggagggagccggggaacccgcgtatatgaaggatgctgatgggaacatcggtgaatcagcgcggtccggcggtgacggcatcaatggcccgagctccgcaaatgcattgcccggcgaaatgttgcacggaaccagttcatcacgtcccggcacgctggctaatgtggctgccttaccgcaggatctgaccggctacgatgaacaccgctgccgattcgcgctactgattgccggcggtgtcgcggcgattatcgcgggagccggcatcggcaacctgttcgattccgataattccattctcggcgtgacgccactcaacgattttctgacattcctgggcatctgcgtgggcgtgattatcgggctggcgatgctgattccgggcggcatgtcacataccgacttcaaacggcggcatccctatgtcgaggatttctatgctgcgagatgtcgccctcggcacagagttgccgagggccggcaaatcactcccgcgtcgggtccttttgcaggagcaggaagacgagtgccgcgacgagcaggacggcgatggagagcacgccgagcgaggcgttgccggtcagggacgtggtggtggccaccaggaaggtgccgatgatcgaggcggtcttgccgaagatatcgtagaagccgtagtactcgttggcgtgatccttggggatgatcttgccgtagtacgagcgggagagcgcctggatgccgccctggaacatgccgaccagaatcgccagaatccagaactccacggccgacttcaggaagaacgcggcgaagaacacgatgcacatgtatgccacgaccgccgccgtgatcatcgccttgcaaccgaatcgcgccgccaggcggccgtagagaatcgcgcaggggaaggccacgaactgcgtgacgagcagtgccaccaccagctgggtggagtcgatgccaagctcggcaccgtaggaggtactcatcgaaatcaccgtgttcacggcatcgatgtagaagaagaacgcgatcatgaacatccacaacggcttgttcttcacgattttgccgaacgtgcccgccagttcgctgaacgtgccgcgcacggccgagcccagctggtcacgggtggcgcgatagtgcacttggcggtagctggtaagcagcgggatggtgaatgccacccaccagatggcggtgatgatgaacgaggcgcgcgtgcaagccaccgtggaccagtcgaagagcgacgggccgccgaagatcagcgcgatgcagaagatgaacggcacggtggagccgatgtagccccagccgtagccatgcgaggagaccttgtccatgcgctcgttcgaggtggcgtcgatgagcatcgaatcgtagaacgttagcgagccgttgaggccgatggtcgccagaatgtagacgactaggaacggtagccaggtcaggggcagggccattgcgcagcaggtgaccacgccagtgccgaagaagccaaggaagaacttgattttcatgccttgcacgtcggcgatggagccgagcaacggcatgagcagcgcgatgaccaaggaagcaatggtttgcgcgtagccccaggcggacacgatgttgccgtccgccggcatcagcgatttggcgtaaatggggatgacggcggtggacagcagcacgaatgccgagttgccgacgtcgtagatgatccacttcttctcgcggtcggtcagtttggcgctttgcggcaccggttcgtggacattcgtgggatcagtcatatacactcctcgacagtattcaactcaatctatcgtagaagcgcggactagggtaggggagccattccggttgaacggcggatgaataatgccgggcctctttctaaggggagccagagcaaaaatagctcccctcgctgaggggagctggccgcgaagcggactgggggagctacctatagtcgactattcgccgatcagcgcgatggcctcgtcgtaatcggggcattgcggcacgccgttgaggctgtgctggatggcgatggatgccgccgcgttggcgatctttaccgattcggccagactatggccctttgccagcatcgcgcacatcacgccggtgtggcaaccgcccgccgaacgggtgtgtacggccttggtcgggtatccctcgatatgaatcgtctcgccacctggctcacgaatccaagcgccgcgggcgccgacacgcaccaccagcggcgcgcgcagtgtagcgcccaagccgtcgcacaactggtgcatgaagtcgtcaagtccgccgccaatggtgactttgctgtcgtcgattggcgcaccaagtcgctcggccagcgtcatggcctcctgacggttgcaggaccagaccgggcgtgcgagcaccaggtcctcaagcatatggtcgttgaccaaacgcaacgtattggtggggttgatcaccagcgtgtagtcgcgtgcagccgggtcggtaccggccttgagcaggaatccgtccacgccggtggccgtgtggtccatcagtgtgttgccgctgatgtgcaccacgtctttgggctgcggctccagcgtgtcgaacgtgtccgagtcgccatgagcctcggcgccataggaagcgatgaatgtcttcttcggcgcgccggagctcagcaccacgcggaagccggaatcctcatcaagacgatcctggccgatatgcgtaatgccgttgtcttggaatgactggcggatgaaatgcgcccacaggccgttgcccagaatgccggcgtgctcggtcggcacgcccatgcggctggccgcctgcagcacgcgatagctgccgccaatggagggcttcggatgatcggccacggcgaatccgccctgtgccggcaccttgtccacattgagcataatgtccacccagacttgccccagtgaaatcacgctgggctcgtgagtgccgatacctcgcttgagattcaacatgacagcctccttcgtcgtaagttgcacgtcgcaagttgcacgaggaccccttcgtcccttgccgtctcttataccgagattatatgagagtttgctggatgcggaaaaggaaggccggcgtgttttatcgggtaaacgctatgatttgcagcgtaattcgccgctggcgaactgctgacgaactacttgcggaccgctggcgaaccaatgccgagccgctcgtgaaccgctgatggcccactcgcaagttacgctcgaaccgcgcgtgaaccgccgaggttcgcccatgatacacgcaagagttgcggttgtcggtattgggctatatatttgtgaagttgtgtgttcggcatgtcgggtgaaaccggcggtcgaatgcgtgaaagacttgacacatcaaggttaagggagtccatcatggcagctcgttgcgcagtgtgcggcaagggaccgcagaccggtttcaccgtttcccattcgcaccgtcgtaccaagcgtagcttccgcccgaacctgcagtctgtgcgcaccacgattgatggcgagaacactcgcctgcgcgtgtgcgtcaagtgcctcaaggctggcaaggttcagcgcgtggccgcgtgaatcgcgtactaacgtggagcaaaacccgtttgagcttcggcttggcgggttttgttgtttctgcggcctaaagaggccgtgcgaatagaataggccaatatgagcatcactatgggcaccactctcgcttcgctggtcaccaacaagcgtcgcgtgtccgcgctcaaatcgctgggaatcgtcactgtcggcgacgccttgacctactatcctttccgcgtcaccgaaccggtgccgcttcgcgccatccgcgaggccgcacccggccagcagatggcatttgccgccgtgatacgagatatgcgcgtggtgccgatgaacgctcgccgcggctaccgactcgaagcgacggtcgatgacgccgacttcgcccggtctcgtcgcgtacccggcagtacggcccggctcacgttcttctcgtatcgtaaatcgtatgtggattgggtcagcgtgcgactgcgcgccggcacgtctgtggtggtctccggtatgcccggcgaatacatgggtcagctgcagttcacccatcccgaaatcctcactgtcgcgcccgtgccggccggagcaggagcggggcttgagggttacgctcggggcgcggcatccggcaatggtgcgtttgcgggaagtgccgatccgtatgccagtgcgcagtccgcgtatccgccggccgcgactgccccttccggggccgcgttgaaatacgacgccgataccgtgcaagaggcgcttacccgcgtctgccggccccgcccggtatatcacgccagttcgcgtatctcgtccgaacatattcatgagacgattctgggattgctgtggatgatgggggcccgcacgtcatccacgcctgacgggcaactcgctggcgctggggcagccggcattgtggctcccgcgactgacaccatcgccgtccaaaacggggaagagaagtccggcacgaccgccgaatccggtgctgaggcgctctcccaatccatcccagatgtgctgcccgaatcggtgcgcaaggccaagaacctcatgcatcgggctgaggcgttcctggccattcatgatccggcctccacggcccggttcaaggaggccatcgaaaccctgcgctatgaggaggctttcgtttcgcagacctcgctgctgaagtctcgacagcacgcgcacaagtcatcggcgcatccttgcccgctgaacgaggcgctggaaacagctcgagcgtcggtgggcgaagcggttgcggagccaagtacgcaaccagaagcatcggagcgcggttctgcgaccgatctgcctgatctgcccaatttgcccaatttgcgcgaccgcttcatcgcatcgttgccgttcacactgacagccgggcagagtcaggtggtggacgacatcgcgtccgatcttgaacgtgactggcccatgcagcgtctgttgcagggcgaagtcggctccggcaaaaccgtagtggcgctcgcggccatgctgcaggcggtcggcgccggctatcaggcggtgctggtggctcccactcaggtgcttgccgaacagcattacgagaccatcagcaagatggtgtcggggttgacccttgcacagccgggtgccaaggagaccgatgccgcggccgacgttgagggcgcgatgggcgcgtccggtgcttcgacggtctcttcttccaaggtgactgcggaaattcccgtcaccctgctgaccggtggtatgaagcttgccgcccggcgtaaggcgctcgctgcggccgccagtggtgagccgggcattatcgtggccacgcacgcggcgttttccaagaccttccaagccccgcacttggccttggtggtgatcgacgagcaacaccggttcggtgtggaacagcgcgaaagcctcaacgccaaaaccgatgacggcaccacgccgcatctactggtgatgaccgccacgcccatcccgcgcaccgccgccatgacttggtttggcgatctcgatatttcctggctcaccgaattgcctggcggccgcaaaccgattcgtaccgtggtggtcaatgaggccgacgccgccaccatggggcgtatgttcgcgcacattcgcgcgcgagtcgacgcgggggagcgggcctatatcgtgtgcccgcgcattgatgcggatgatgaggagaacgaaggcggttccggcgtttcggcagcagccggttctgcccgcggacgcgccgcagcatctggttccagtgcccgcacagctgcgggcggccgtgcgacgcgcgcggcggccgatgccatcggcatcgacgacccctacgaaaccttcgacgaaaatggcgaaaccgtggctcgcccgccattgcatgcggtggccgaaatcgccgaccggttgcagaaacttccacagttccaaggcattcggtttgcgactctgaccggccgcgacaaggatgacgtcaaaacccaggtcatggccgattttgccggcggcgagactccgatcctggtgtccaccacggtgatcgaagtcggcgtggacgtcaagcaggccagctgcatcgtcatctttgatgccgaccgatacggcctctctcagctgcatcagctgcgcggccgcgtggggcgtggcggcaccaactcgtgggcgttccttatttcccgtgcggaacccggctccccggccgagcaacggctcgaagtgattcaccactcgctcgacggtgccgaaatcgcccaagccgacttggaattccgcggtgccggcgatgtgctcggcgacgcccaatccggcggcaagtccagcctgaagctcctgcgcgtggtcaaggacgccgacatgatcgccgacgcccgcacccgtgccgggcagcttctggccgccgaccccgaactggcaggtgaggtccaactcgccggtgccgtcctcgacttcacccgaggcaacgaaaccttcctgacctccagctgaggcacctccagctgaggctagggctgcgcccccgtaatcgcacgatatagtttttccgtatgccgatcgtgaggaaatcacggtcgggaagccctcgaatgtgcttcagtggaggcaagaccattcgtacatgaggtactcgaagtgcatatatcattggtgcgcttcgagcaccccattgttgttcatgattggtatgcgcagatgaacctgtacagtgaaagctatgcgtgtaatttctggacgattcaagggtgtggtgcttgctacgccgaaaacgggtacccggcctaccacggatcgcaccaaagaggcgattttctcgcacctcgactcatggggagtgctggatgatgcccgtgtactggacctgttcgccggtactggtgcgttgggcatcgaagcgctgagccgtggcgcgcgagaactcgtggccgtggaaagttcccggcctgcggcggcgctgattaccaagaccttggcgcagctacagaagaatcgttcgtgggatgcttcgctcaaggcccgtgtgctggtcaaaaaagccgagcaagtggctggcggcttcggcgaaccattcgacgtgatattcatcgacccgccctatgcctatgagaccgctgaatgcaatcagctactgtccgatctggcggcgggcagcgccaccaacgagaacacggtgatcatgctcgaacgctcggtacgctcggatgatcccactgccccggaggctggcaaatcaccgaaagccgcaactacggcgaaaccgccgtcttctacatcgaatccgcggatgacgactcggatatagagcgttccgacgattccgccgcgtagtgaatctcccaccgtgtggtgaattaatcggcgagccggcgcggatgggcggcggagacctcccagcccaaggccatcagggtcttgcgatcggccttatccagcgccttgcaatccagtgccgcgataaggtctggccgaatctcggcggtgcgggccagcgcttcgtcgcggcgaaaacggtccaccttgccgtggtcgccggacaacagcacatccggcaccgcaataccgcgccacacggccggcttggtgtactggcgatgttcaagcagtgcgccctcgccggtgtaggattcctcaacaatcgaatctgggttgcccatgaatccgggcatcaggcgggtgatggcctcaagcatcaccgataccgctacttcgccgccgttcagcacatagtcgccgatcgaatattcgcgtacgtcgacgccttgggcgcggtagtagtccgggatgcgcgcatcgtagccctcataccggccgcagccgaacagcagatggtcggcatggctgagctcggtggcgtcgcgctgggtgaacaacggggccgatgggttcgggaagatgagcaccggtgcgccggatggggcgggggagccggacggctgcgagaatcccagcagttcgtccagacattcgctccacacttcgggcttcatcaccatgccggccccgccgccgactggcgtatcatccaccgaatgatgcacatcgtgggtccagtcgcgcaggttgtgcgccttgatctccaacaatcccttggcctgggctttgcccatcaggctgaggttcatcacctcaaagtattcggggaacacgctcacgatatcgatcttcatgtcatccagcctaacggtagcccctcccgcattacacggccaccactacactattgcggtgatgaatacgacgatgaacctccccacccgcaaaaagcccgaagtgttgtccccggccggcaacctgaggggcctgaaaaccgcggtcgattatggtgccgacgccgtctactgcggcggcaaagccttcggcatgcgatcggcccccaaaaaccttagccttgaggatttcgaggaaggatcgcgctacgcccatgaacgcggcgctcgcgtgtacgtgacctgcaacgtgctgccgcgcaacaacgagatcgaagccatgcgcgagtacgtcggccagctcaaagacaccggcgtggacgcgctgatcgtctccgatattggcgtgatgatgatggcccgtcaggtggctccgaatctggaactgcacgtctccacccaggccggcgtgactaattatcaggctgcgaacgccttctacgagcttggtgttcgccgtgtggtgttggcccgcgagatggacttgcaggccgtgcgtgatattcgcgccaacattcccgatgacctcgacatcgaatgcttcgtccacggtgctatgtgcatggccttctccggccgctgcctgttctccaactatctgaccggccgcgatggcaatcacggcgaatgcgcccagccatgccgctggaagtattcgatcgtggaagagaagcgccccggccagtacttcccgatcgagcagaccgagaacggcgcctatctgttcaattcgcaggacatgaatatgctgggacacttggatgatttgattgactccggtgccaccagcctcaaaatcgaaggccgcgcgaaaagcgcctactatatcgccgccatgaccaacgcctacaaaaccgcggttaatgaatacatgattcaacgcggttttgaagacgctgatggcaatgttttgaagcctttccatgaccgtgtgattcgcccgggcgaccccgattttggccaaggaaccgaagatcaagtgatgcgcaatgctgatgccgcgttcgccggtgtggccgatgagggatatgaccgtggctctgatactgcggttgccgattcggtcaccggctcggttgccgcagaacgtgaccgcgtgacggttgctgatgccgtcgactcaactgcctctggtacgccggccggcaccgccgtcgaacccgacggcatgagctctcacgcccgttccacgcgccgcaagtccaacaccgcggtcgaacagattgagaccgattggaaacatgcggccgttcgcccggccccacacgtcgaactgcccgaatggctgctcgaggaaaccgacaaggtggcccaccgcgactactccaccggcttctattacccggagcacaaggtcacacagaacaccgaccgctccgcctacttccgctcatggctggtagtgggcgaagtgctgagctggagcgcggacgaagacggacgtgtcacgctgatgagccgtaacaagattgagcccggtcaacaggtcgaattcctgctgcctggcgagagaccattggtctttaccgtgccggaaaccggcctgcgcgatgccgatggcgcgccagtacccgccatcaataatccggcgcacgtgttctcgatgccctgcccgcaccaggtgcccatcaacgccgccatccgctcgcgcaccaaaaagcccaccctcaaagccgaataacctaccactccgcccccgctgactgggggtggtcatgaaaatcatgaacaccgcccgcacccaagaaagaatgccttatgcctgaatacagcgaagaaatcctcgattccaacagcatcagctctaccgataaagccggtcgccctattccggtgaccatccccatcgcactggcccccggcatcaaggtggtgtacaccacgcgactgggcggcctgagcaccggcgattacggcaacctgaacctcggcggcaagtccggcgacgaacctgaggccgtgctgtcgaaccgcatcgcactcgccgaagcggtgcaagcccgcctatcgctggtctcccaagtacattccggcgtggctgtggacgtggacgactcgttcgtcatcaacacccccttcggcttcgacgtgtccggcacacatggtgagactgacactccgcacgtcatcgaggcggacggccaggtcaccgcacaatccggcatcgccctaggcatgttcgcggccgactgtctgccggtgctgctgggcgacccggtcaccggtatcatcggtgcggcccactgcggccgtcgtggtctggaacgcggcgtgatcggcgccacggtggacctgatgaagagcaagggtgccgacccggcgaacatcgtggccacactcggcccgcgcatctgcggcgactgctatgaagtgggcgacgagatcgccgaccagttcatcaagcgcttcccgctgaccaagacgaagacccgtttcggcggtgccggcatcgacatcgccgaagccgcgatgatcgacctcgccttcgccggtgtacatcaggtggtcgattcgatgccgcgcgtgcacgccgccacccagtaccttgaggaagacccggaactcgccgaactgtgccgtacggacggcgaaggcccggccgagctcgcggagcgcatcgacaacatcagccacagcatgtgcacgctcgaaaacccactgtggtactcgcaccgccgcgccgcgctcgccaacaaaacacacgaaggccgcctcctcgccctcatcgtgcgtgactaaacggagaatgcgagcacattccgtggagaagatgtgatgcagttcacggacggccagccctcaccttacggtggtgcctatgactgagagagatttcgatacccccgtcgagacgcctaccgtccaaccggcccccgctcagggtgccaaaccggcgcaaaccgtgccggtggtggccgtggtgctggccgccggcttcggtacgcgcttcgaccccgataatcccaagcagcttgtctccgtgggcggcaagcccatcgtgtgctggagcattgatgcctttgaacattgcgatcgcgtcagcgacatcgtggtggtggtcaatcccaaggtgcgcggtgaagtggaaacgttggttggcgagatgggctacaccaaagtccgcgtcatcattgacggcggtgacgaacgtgtggacagtaccgccgccgcgctcgacatgctggctacggctggcattccggacgatgccaagattctgatccatgacgccgtccgtccgttcgtggaacagtccgccatcgacggttcgattgatgcgctcgaccagttcacggccgcgaccgtggcctacgcctcaaccgacaccgtgctgttgaccgaggatctgggcgatttgaaagtggtcaagtcggtgccggaccgcccgaacaccttccgcgcgcagaccccgcaatccttccgcttcgcgacgattcgtcacgcttacgatttggctgccgccgacccggacttccatcccaccgacgacacgcgcgtagtggtcgattatctgcctgatgaacccgtcgccattgtctccggtgcggaaaccaacctgaagatcaccacgctggaagatattcccacagctgagcgtatcgccgaggagattctcggtcgtgatcccaaggaagaggcccgcgcccgcatgcacgccctgctggcccaagcggccggccagatgcatcgctagactggcattatgcgtgaactcaatgttgtgatctccggcttcgaccactatgacggcgtggaggtcaatcccgccgtcgaagtgcccaaggccatcgccgagcagggactgggcgtctcctctgctccggacgatccgttggagcaggtcgccgtcaccgttcatgctgtcagcatcccggtgagcttcgccaaagcctggcccacgctgaaagagacgattgaggccaccaagcccaatatcgtcatcgccaccgggctcaagcacgcagcccgaggcgtgatgcttgaacgatgcgccaccaacctgatggacgcgatcaagccagacgcggacaacgtgatcccacgccgcgaacccatcgatcccaatggcccggccgcctattggacccgcctgccgttgcgctcgatcctgaatgatttcacggacgattcgattccggccaccttgagttcggacgcaggtacgttcgtatgtaattcgctgttctacaacttgctcaactggaccgccacccaggagcaggtgctgggcggattcgtcagcttccctccggtcgttccggcgcattccagccagcatggtctaccactcgaccagcagatcgccgctggccgtgatgtggtgcgcgaagccgtgcgctactatctcaagccctccagctccgacatcctcatcgcctagcacgctgtgcgccacgccggaatagaacatggttcgcacgcattgtaacgattgcgcgtcgctcaacgctcagcgctagtgcgatgcgctacagtgcttcaaggatgtgccaagagctttatgcgtgtgcgaaaggaataaacagcgatggtggatcgtttcccggtggtgctgcgaggatatgacaaggagaaggttgatgctgccttcgacgctactcaggagagtatgaagcgtgcgcagcagacgttggccagcatgcgtgagcagattgcggcggatgacgaccgtattctgcaactgcaggcccaacttcaggaagagaagaacaagaagccggaaggcaacagcttcgcttccttgggagcgaacgcccagcagatgcttgcctccgccgaacagacgagtaccgaactgctggaacgcgccaagcaggacgcgtcctccatccgtaccacggctcaggctcaggccgaaacactgatcaacaacgccaagctggatgcccagcatattgttgacgacgccaatgccaaggccgcctcgattctgacgaacgccagcaatcaagccgaatcagtgaccacctccgccaacgaggatgccgcacaactgcgctccgaaactgccaagaccatcaccgaacagcgtcagaccgtcgagcttgagctcagcaacgcgcgcgaagagcacactaagaagatggcttccgaacgctccactcaagagcgcgaaatcgccgacatgaaggcggaggcgacccagcaggttgccgcaatgcgcaaaagcgccaatgaggagatcaccaagcttaagtctgattccaacgatcagattgaggcggcgctcgccgaggccaacaagaagctcgccgacgtgcgcgagcaagtgtccaagatgatgaccgaagcccagcgcaaggccagcgaaatcattgatgcggccaaaaccaagggtcaggaaatcactgatgaggccgaggtcaagcgcaccagcacgatgagccaggtcaacgccgaggtcgagcagatccgtcacgacatcgccgctcagcaggatgaggccacgaagaaggtcaacgaactgctgcagcacctcgaagagcgtcgtgtggcggccaagcgggaagccgatgagttggtcggtcaggccaagaacactcgcgaccaagccgattcgtatgccgcgtccaagcgcgaggaggcggacatccaggccgccgcaatcgtacataaggcgggcgaggaagccgatgcgcagatcgaggagcgtcgcgccgccgcccaaagcgagcttgacggtctgtccaagcgcatcgccgatctgcaggaacgcgagtccgtcatcacccagcgtgtttcggaactgcgttctatgttctcgcaggcgttctccggattcgctttcggcggtaatgcggcggcctctggtcaggatcaggaagccgctgccgcggcggcattgccggtggttgcgcccgtcccggaagtcaagcctgtacacaacgaggccgatgaccagccgggtgagttgagcggaaacgagtcggctgccgacgattacaatgagacagatgcggcaccggctgattcggctgattcggctgattcggctgcgcagaatgagcagtccgaatcgtctgagccgtccgagcaccagacacagggcgaaccggaggccccgactcaggagaatccggccgtatctgagcagaacggcgaatgacaggccttcgattagactactagcggtaagaattacggcacctgcgctttcgagccaggtgccgtattcgtttgaatctgcgccacaagcgcaccatcacagaaggagtatgacatgagtgaattgacgcctctgaccgacgaagcgttgaataccctgcgcggcgatttcgcacagagcggcaccaaccgtctggccatgaacgcggtgaccgccgccggcatcgacaaggtggctcgcaattatgaccgcgctcgtctgatgcagcgtcgtttctccaccatcgttgacaatggcgaagccacccatcaggatcgctccggccgctgctggctgttcagctccctgaacgtggcccgtttcgtggccaagaagaacatgaacttgaaggagttcgagttctcccagaactacgcgatgtactacgacaagctggagcgcgtcaactacttccttaaggatgtggccgctctggtggctgccggagagccttccgactcccgcctgatgcagcacctgctcgccgacgtgatgggcgatggcggccagtggaccatggccatgaacgtgtacaagaagtacggcgctgtgcccaaggacctgttcccggagaccgaatcctccaagaacaccggtgaaatgaacatccagctgcgccacatgctgcacaccgccgtggcgcacatgtacgccgctgacggcgatgcctccaaggtcgaggcgattattgccgacgccactgctgccggccaccgtattctgaccatccacctgggcgagccgccggtttcctttgactgggaatggaccgacaaggatggcgaattccaccgcgacggcgagattacgccggttgagttctggaagaagtacgtgggtccggctgatcttgaggactacgtgtgcctggtggacgatccgcgcaccgagcacgccaagggcaagaagatcggcatcgagcacctcggcaatgtggctggcggcgacgccaccgagtacctcaacgtgccaaaccagttcatgaaggactgcgtcaagcagattctcgttgagcagggcattccggtatggttcggtgccgactgccacccgttcatggaccgtgagaacggcgcttgggccaccgacctgttcgagtacggccgcgtgtacgacgtggacttcgatttggacaaggaagcccgcgtgcgcttcggcgactccgccatgaaccacgccatggctttcgccggcgttgacgtggccgacgacggcaccacccgccgctggcgcgtggagaactcttggggcgccaagatcgccgacaagggctacttcaccatgtccgacgactggttcaccgaatacgtctacgaggtagccgtcccgaaggccctgttgcccgaggaataccagaaggccctcgaagagccagccaccatgctccccgcatgggatccgatgggcgctttggcctgacttcgtcagcctcccggaatcggcctgacggccaatgctgtgttttctcgcagcctgtcggctgctagggtctctccctctgtcagcgcgaagccgctgacagagggagagaccgcggtcgcaggccgcacaacaacacagcatcgccgcaggcgagtccacccaaagtccataactgccggcccaacaagcagtccccgtaacaaactgctatagttgggcttttgcgtctatggcgacataccgacagtacgtatacaaggaaaggagtcgagcaatggcagcactacgtggtccggatagttccgaggatgaacgtcgtttggggagcaggccgtctttcctgagaccgtcgatgtcaacattcgtcagcttgaccccattcccgcgccgcgtgctttcctcagggagcagccgctcaccgatgagatgagcgagctcgtgctccactcgcggcaggaaatccgcgatgtgctcaacggccgcgacgaccgactgctcgtcatcgtgggcccctgctcaatccacgacccgaaggccgcgcacgagtacgcagaaaagctggctgccgtcaagcgcgagttggaagaccgactcgtgatcgtgatgcgcgtgtacttcgagaagccgcgcaccaccatcggctggaaaggcctcatcaacgaccccgatctggacggtcgcttcaatattcgtaagggcatgtggctggcccgcaaggtgctcaccgacgtgctgagcctcggcctgcccgccgccaccgaatggcttgaccccatcaccccgcagtacatctgcgacgcgatcagctggggtgccatcggcgcgcgtaacaccgaatcccaagtccaccgcgaactggccagtggcctgtccatgccggtgggcttcaagaactccaccgacggctccatcaaggccgccgccgattcctgtttcgcggccggcttcgagcatcacttcctgtccattaacttggacggtcgcgtgatttccgccgaaaccaaaggcaacccggattgccatctggttctgcgcggctccagccacggcccgaactacgatgccgaatccgtgcgtcaagctctggaagacctcaaggtttccaaagcgtccggcccgagccagcatggcctcgtcatcgatgccgcccacggcaactgcggcaaagacgaaaaccgcgaagccgaagtcatcgaagagatcgctgagcgcctggcgcacggcgaacaaggcatcaccggcgtaatgatggaaagcttcttggtcggcggtcaccaaaagccggccccgctcgaccagttggtctacggtcagtccgtcaccgactcttgcgtgccgtgggaacgcaccaacgaactgctgcacaccctagccgacgccgtcaccgctcgccgctcggctaaatagctttgtctttgtaaaaatgctcactgagacccactcagtgagcattttttgccaataacggtggtcatgtcagtttgttcccgtgacaccttatccttgggaaggatactgacccaaggagagatgttatgcagcagcaggaggaagcagcacattcgctgcatccgttgcaagtcggtccgcagccgttgcaagtcggtccgcagccgttgaacaccccagaagagcttcgcgccattcgtcaggcgatgggggaggggaagaacccgctcgttgccactgatgtgccgcgttgggaagatcaggtgggtgtcagtcgcatcatcaaccgccgcgtattggagttggagccgctgcccacgcccgcgcaagtgctcgctgaactcccgctgactgatcaggctcaggaaatcgtcgcctactcgcgtgatgagattcgcgcgtgcctgtacggccaagacgacaggctgttggtcatcgtcggcccctgttcggttcatgacccgaaggccgcgctggactacgcgcgccgattggccaagctgaaagatgagctcggtgaacagctgctcatcgtcatgcgcgtgtacttcgagaagccgcgcactaccattggctggaagggcctgatcaacgacccggatattgatggcagccacaatattcgcaagggcctgttgcttgctcgcaaaaccttgcttggtgtgctgaaggaaggattggcggccgccacggaatttctggagcccaccagcccgcagttcatctcggacgcggtgagttggggcgccattggtgcgcgcaacacggaaagccagatccaccgccaattggccagcgggctttccatgccggtcggctttaagaatgccactgacggctcggtgaaggcagcggtcaacggttgcttcgccgctgctcagcagcacacgttcttcggcattgaccatctggggcgtgcctgcgcagtcgagacccttggcaacccggactgccatgtggtgttgcgcggctcgattcacggcccgaactacgatgccgaatccgtggccaaagccatggaagacgtacgcgccgaaatgcccgccgaatccgcagcctcgcatggtctgattgttgattgctcgcacggtaactccggcaaggacgaacatcgtcaggccgaagtcgtgcgcaatattgccagcagaattgcagctggcgaacagggtattaccggcatcatgatggaaagctttattgaaggaggcaatcagaaggccgcgccgcttgatcagctggtctatggcaagtcgattactgacaagtgcatcagctgggaagaaaccgaggccttgctgcgcgagcttgcggaagccgtagccacacggcgttggcactgagttgcgtcatcggctctctcgcgggagcaatgcaacgaaacgtctctacccctcagcctgccattcggcggccatctcccctgacaaggggagccgaaagtgttgtgaaaggaacttacgtatgggtatgaaaactgtagctattattggcgcattggatgaggaagtggcgctgatcgccaaatcgctcacgcatgtgacgcacaccgccaagggcagccttgacatcgtgtccggcacggtcgactccttcggttctgacgtcatcaaggttgccgcaacggtaggcggcatgggactggtcaatgcggccgccaccacgcagctgctgattgacgagattgccccggacgccgtgattttcagcggcatcgccggcaacctcaacacccacctgtacatcaacgacgtggtgctcggcggcaccctgcgctacctcgacactgacatgcggctcgtaggccagtggaagcccggcactgcggacgctccggtggaggaattccactctgatgaccgtctgctggaagtcgccgacgaggcgcttgccaatgcgggcattacccacatcaccggcatcatcgcctccggcaactacttcgtggacacgccccaaaaggtcgaggaggtcatccgactcaccggggctgacgccgtggagatggaaggcgccgccgtggcacaggtcgccgcccgcaataacgtgccggcactggtgattcgtgccctttccgacaacgccgacaccgattacgaggtattcaaggagttcgacatctccgaatacgccgataccgccgcccgtctggctgtcgacatcgtcaagcgcctgtaactggtcacctccaagttcggcgttgccggtgtgggctggtacatggccatcatgactgccctcgctctgctcgctctgttcctgatcaaggaaagcaaggacaaggactacgagctgtaaatagagctccccatattatgctcccgccagcgggagcattttgttatgtcgtcccgccaaaaatgaacaatagacgaacttacgtagtttaggcatctcactacgcctcgcacgttttactctggaaatcatggatatctggcagatcgtcgtgattgtggtgctcgccgcgctgatactggtgtgggttgccgtcatcgcctacaacaaaggccgcgtttcaggccggctcgccgccgaacaggacctgtccggcgacgaggatacgcattctctattcggtgatgatgcgcccgtgcgccccaccgagcgtcgcctgattgaagtcctgcccgaagccctgatcgtcaccgaccgcaacggtctggtccaatattcaagccccggctcagtgccattcggcctagtctccggcgaccgactcaactcgcgtgaagtcgaggacatcctcactcaggccgccgccgacggtggcatgcgtgagcgtgaggttcagctgccggtcaatcgcaattcctatccgtcctctaatggccgaggactggaggccggccagtcacgcccgtccaacacgctgtatttgcgtgtgcgcattggcgatatcggcgatgacctgtacgccatcttcatcaacgacatgtccgagcagcgccgtttcgaggccgtccgccgtgactttgtgaccaacgtttcgcacgaactcaagactccggccggtgccatcgcgctactggccgaaaccgtgaccgacgccgccgatgatccggacgccgtacggtatttttccggccgtatctccaaggaatccgcgcgcctgaccgaactggtgcatcatcttatcgacttgcagaaagcccaaagcccgcaaagcgtgatcgatgcgcggcgcatttccgcgctggatgtggcacgcgccgccatcgccgccaatcagacccaagccgactcccgccatgtggatatccgactgagtgtcaacggacagtcagtacccacgaaggtcgaggagccggccgatggcgaaggttccttggaagaatcaggcagcccagccacgaacggtccgatgatcaaggccgacaaagaggccatgcaaaccgccgtcaagaacctcgtagagaacgccatccattactcgcccgaacacaccactgtggcggtcggcgtgggggagcgcgatggcaaagtcaccattcgcgtggtcgatcagggcatcggcatccccgccaaatcgctggaccgcattttcgagcgattctaccgggtcgacccggcccgttcgcgcgagaccggcggttcgggactcggcttggccatcaccaagcactgcgtgcaggagaacggcggtcggatttcggtctggtcgcgtacgggggaggggtcgacgttcaccatcgagctgccggccgccccggatgaggatgacgacgaggcccggtcggacgagtcgacacaagcgtagggccttggttggtgcccgacatggtgccattccattgccacacaatcacacagtgggcgaggtgcgcacaccgcgcgtagcccaattacgcaattacgtactttcgggaaacagcaggctaacggagaacaaatggttacgataatgtcggaaaactttgcgcctatgcgcacgggaacatacccaagaaaggctactatgacacgcattcttatcgtcgaagacgaggaatcctatcgcgagccgctggtataccagctcacacgcgaggggtacgacgtgtccgccgccgccactggcgaggaaggtctggaactgttcaccaagggcggcatcgatttggtgctgcttgatttgatgctgccgggcattgacggcactgcactgtgccgccgcattcgtgagcagagccgtgtgccgattattatgctcaccgccaagagcgccgaaatcgataaggtcgttggccttgagattggtgcggacgattatgtgaccaagccgtactctttccgtgagctgctggcacgtattcgtgccgtgatgcgtcgcaatcaggccactgcccaggcttccggcactgtggatgacgatattccgctggtgtgtggcgatatcgccatgcaggttggccagcatcaggtcaccgtacgcggcgaaaccgtgttcttcccgctcaaggaattcgaactgctcgaatacctcatgcagaacaagggccgtgtgatgacgcgtcaccagctgatcgaccgcatctggggttcggattatgtgggcgacaccaagacgctcgacgtgcatgtcaagcgcgtgcgctccaagatcgaggaagatccggcgcaccccaagtatctgactaccgtgcgcggtctcggatacaagatcgatactcccgcggagtaaatggaaggcggccttcgggtcgcctttttttgttgtggattgtgggctcgctgtggactcgccgcaggcgagcccgctccaaaaactacgtagcctcaacgtagcccacaaacatccaagtgttcatcttctgtttactgatttcggttttgggcccttgaaaccaccaatacgcttgtagttgtcatgaattgaccgggcagcgctgagccgcccgcgaatagttgatagagggattaagtaataatcatgcagaagaacatcctcgttcgctccattgccgctctgtccggcattgtgatgctcgcttccgtggccgcctgcggcgataacaccgccaccacgaccgacaacagctcctcctccgattccacttccaagtccaccccgatctccggcaacttctcgggcgccggcgcctcctctcagcaggccgctgttgaagcttggatcgccggcttccagggcaccaaccctgaggccaagatcgcctacaacccgtccggttccggcgctggcgtgcagaccttcctgaccggtgccaccgcttgggccggctccgacaaggcccttgccgatgacgaagttgagcagtccaagtccgtgtgcactgaaggcaccgccttcgatgtcccggtctacatctccccgatcgccgtggtcttcaacctcaagggcgtttccgatgccggcaagcacatcaacatggacgctgccaccatcgccaagatcttcgacggcaagatcaccaagtggaacgatccggccatcgccgatcagaacaaggacctgaagctgcccgacaccgccatcaccgtggtgcaccgctccgataagtccggcaccacccagaacttcgtctcctacttcaaggacgtcacccctgacaactggacctacgacctctccgagaactggccgaacgaggttggccagggtgccaagggcacttccggcgtgatctccaccgtcaagcaggccgacggcaccatcggctacgctgacttctcccaggtcggcgacctgggcaccgtggccgtcaaggtcggcgacaagtacaacgagatttccgccgaggccggctccaaggtcattggggattccaagcaggacgacaccgttaagggtgacaaccgcatcgtcatcaagatcaaccacgccaccgaggccgagggcgcctacccgatcgtcctggtctcctacgacatcgtctgcccggcctacaaggacaccaagcagactgagttcgccaaggcttggctgacctacgtgacctccgacgagggccagaaggccgctcaggatgccgccggcaccgctccgctgccctcctccctgaagtccgagatcaccaagtccatcgaggccatcaagaccaagtgatgacgtcggcccgcaagggtcgtgtggactggacctgacaactgaacgatagactgtagtagtaagagcagtcgccgccaactttaagccgcagtcgtaaaccatacggctgcggcttaaagcgggtcaggacccgaacggtttggcaacgtcacagacgaaaaccgcaccacttgaatacttgataaccaccctatataaggagaatccgtgagttcgcaagacaaaacggctgtgcagccagttggtggcaagaccgccgacaaggtgtttcgcggtgtggcatacgcctgcggcatcctgatcctggttgtacttgccgctgtgttcctgttcctgttcttccgcgcctggccactcatcggtggcgatcaggccgccaacagccagaccgtgtccagctttaccggcggcaaggccagcagcttctggggctacgtgctcccgctgttgttcggtactgtgctcgtgtctttgctggcactgctgattgccttcttcgtgtccatcggcattgcgctgttcatttcgcattatgcacctaagaagctcgccaccgcgctgagctatgtggtcgatttgctggctgccatcccgtccgttatctacggtttgtggggcggcctgattctggtgccggccatctacccgttctggaactgggttgccaaccacctgggcttcattccactgttcgagggcccggccgccaacccgccgcgcaccgtcgccaccgtggctgtggtgctcgccgttatgattttgccgattatcacctccatgtcccgcgatatcttcatgcagaccccacgcctgcacgaagaggccgcgctggcgctcggcgccaccaagtgggagatgattcgtctggccgtgctgcccttcggcaagtccggtatcgtgtccgcctccatgctggctctcggccgcgcgcttggtgagacgatggccgtgttgatgatcctgtccccgggcctcaactactccatcaagctgctgcaggcctcgcagaaccagaccatcgccgcgaatattgccgcacagtaccctgaagccaacgatctgggcgtctccacgctgatcggaactggtctgattctgttcctgatcacgttcgtggtcaacttcatcgcccgtaagcttaccgagaaagcgactgcgtgatgactgctgctgagaacactgaaaagactccgatggacggcgcgcccgaaatcgacttcgatcgtttccgcccgacccgttccgccatccagcgccgtaatatcatggaccacttcatgtgggtcctgatcgcggtggcgtttgtgatcgcctgcatcccgctgatctccctgctgtggaccactatcgtcaacggcatcaagcgcctgaacctgaacttcctgagctacaacatgaccggtgtggtcggtggtaaccagaccccgtccggtggttacggcggtgtgctgcacgccatcatcggtactctcgaaatcaccgctggcgctatggttatctccattccgatcggtttgatgtgcgccgtgtacctggtcgaatactcgaaccgcggcaagctcgccaccacggtctccctgctcgtcgacgtgatgagcggcatcccgtccatcgtggccggcctgttcgccttctcgatgttcacgattctgctgggccccggtaccatcaacggtttcgaaggctccgtggctctctccctgctgatgttgcccaccgtggtcaagtccagcgaggaaatgctcaagatcgtgccgaacgatttgcgtgaggcttccttggctctgggcgttaccaagcagcgcacgattaccaagatcgtgctgcgcaccgctctgccgggcatcgtctccggtgccattctggccatcgcccgcgtgattggtgagaccgcaccgttgctgatgaccgccggctatatctccagcaccaacgtgaacctgttctccggccagatgaccaccctgccggtgttcgtctaccaggagtactcgaagctcagcgcgaactgcccgcccaacgccgacgccacctgcgtgaccacgattccgatggaacgtgcgtgggctgcggctctcgtgctgatcgtcatcgtgctgctgctgaacctcattggccgaatcgtggcgaaggtcttcgccgtcaagaccgagcgctaagccagtcgctaagcctaagccttaagaacacaaggaaatataaggaaacatcatgggacaacgtattgacgtcaaccacgagaacatctattacggcgactttctggccgtggaagatgtgaacatcaacatcgagccgaacaaggtcaccgccttcatcggcccgtccggctgcggcaagtccaccgtgctgcgcaccttggaccgtatgcacgagatcatccccggcgctcacgtcgagggcgaggtgctgctcgaaggcaagaacctgtacgacaaggacgtggatccggtggccgtgcgccgcgacgtcggcatggtcttccagcgcccgaacccgttcccgactatgtccatccgtgagaacgtgctggccggtgtgcgcctgaacaaccaccacctggccaagtccgacgccgacgatctggtcgagtgggctctgcgcggtgccaacctctgggaagaggtcaaggatcgtcttgacaaccctggcatcggcttgtccggtggccagcagcagcgtctgtgcatcgcccgcgccgtggccgtccacccgcaggtgctgctcatggatgagccctgctccgccttggacccgatttcgaccctggctatcgaggatctgatcaacgagctcaagagcgactacaccatcgtgatcgtgacccacaacatgcagcaggccgcccgtatcgccgactacaccgccttcttcaacctgaaggcagtgggtcagcccggtcacctcgagtacttcgcggacaccatcacgatgttcaacaacccgcaaaacgaagaagccgagcgctacatctctggaaggttcggctgatcgtttcctgcgcgcagcgtaatgatttgtgcgtaggagaaacggcaaagcccgccgcgaggcgggctttcgcatattcaacgcgagtattgccgagtattatcgttctcgcaacggagcgagctggaatactttgtcggactgggcggcgacttcccgcttcggtcgatcgacgggagaacggcgggtaaagcggtacaagacaagtccgcacgatgaatactctgtgatgaatcttctgtttacggtgcgagtgtggaagaatggtcgcagcaaggtccagcaaaggagcataggtgagtactggtctgatcgtcagcatcgtcgttgtcgttattatcgttgtcttgattggttggggcgtcagcgcctataacaacctggtgacgctgaagaaccgtgtgaagaacggttgggcgcaaatcgacgtgcagttgaagcagcgcgccgacctcatcccgaacctggtgaataccgtcaaggggtacgcatcccacgagtctgaagtcttcactcaggtgaccgccgcccgcgccggcgtagtggctgcggccagcaacccgagcacgaccactgctcagcgcgccgccgccgaaaaccagctgtcccgcgccctgttcaacctgcaagccacggctgaggcatatccgcagctgcaagccaaccagaacttcatggatctgcagaaccagctcaaggaactggagaacaagatcgcctacgcccgtcagttctacaacgacgtggtcctgaagctcaacaccgccatcgaaaccgtgccgacgaacatcatcgccggtctgttccactttgagcaggcgcaatacttcgaggccgatgacgcttcccgtcaggtgccacaggtccagttctgacccgcttcaggcccgtccggtaagccgccggccgggcctgtattgtcttaagagagggaagatatgcggatacgattcattcgcgccggaatcatcagcattgttgccacggtggtgttggcagttatcaccttggcgataatcgggacttccgcgttcggcgattcggccgacctcagctaccgcacgctggactatgacgtgaccgccaccgcgaacggtgatttgaaggtcacgcagcatatcgacgtcaagatgcgtgagcgtaccgacagtgacgacaacaccaagccgtggaagcagctgttccagcaatacacgctgaactccggcaccctgactgatatcagcgatatcagcgtgcgcaacgtcacagacggcatcgactatgcccaacagagcgagcccaagctgcccagtgacgtcttttccgacaaggaatggaacagtgactacgccaaccattggtatatcgccgatgtgagcgatggcagcgaccatccaaaggcatacacgcccggtaccgatggcctcaagcccagcgcctccgccaccgaagataacacgaccgtggagatcggctggaatattccggtcaccaccgaggccgacagtatgaagttcgacgtgagcttcaccatgcacgatgtggccaccaaatggaaagacgtggcctccttccaatgggagccgttcggcaagaagaaccaagtgcctatcggcacggtcaccggcaccgtccacttccccaacggcatcaccggcaaaacctcatgggcatggctgcacaccgagcgcacttcggaaaccaagcgcaacagcgacggcagctacacgttcacggcctacaacatccacaatggcgactacctcgatgtggtcgcggcgttcgatgccgccaaagccaagggcatcgcccgcaagggaaccggcaatcatctcaaggacctgaaacaggacgaatataagcaacagcagcgctggctcgacaagcaacgattcgctgccagagctcgtctcgtgttctggattgtcagcatcgtgctcggcatcgcgttgtgcgcgtggggtatctgggctgtgatctccagcaaccggcgtgcgcaataccgtggcagcgtcgaatactggcgcgaccagcccggcatcagtccggcttccgcagcccgtctgattcgcgtggtcgatccgtcgacgcgccaatccgatgaagaccgccagctgaccgccaccatgctgtcgctcgccgtcaagaaggccattgccgtctatccggggccgtcggacatgtatcgcggcatcgacatgagccaggccacgccggtgggcttgagccaaatgattgccgccgaccaaggcaagcagtatgcggcaggcatcaccagcaccatcgtgattctgccgctcgccattgatgaggcacccaacgcgcaacagttgggattgagcgaatcggaagatgcgctgctgaacctgctcatcgtcatttcgcagcgcgtgggcagcccggtattcgacctgaaccagatgaaggcgacctgccagaactggcaagacggctatattgagctcggcaaattcaccggtgcatgcagcatggaataccagcggctgggtgccacgcgctctgtgggctggcaatggattctccccggcgtactggccgtcgtgctgggatttggttcgctgctggccaacagctttatcggatacccggtggctggtcttatcgagctgccgatattcctggtcggcctgttctgctcgatggccggcgcggtgaccgtgctcaccgaccaaggccaggatatcgccggccggactctgggccttaagcgttatatggaagacttctccaacttcaccgaccgtggtaccgccgatttggccttgtgggattggtatatggtctacgccgccgcgtttggcatttccgatcgcgtgatgcgtgagctggccaaggcctatcctcaggtcaacgatccggcttggctggatgccaacgcctccaactcgttgttctactggaactaccgcccgtatggctggtacagccaccgccacaatgacgatgctgccgggcagatggacccgggcattagcggcccagctccggcttacggaggcacgtcgtttgccggcggattctccgacctcggctcgcagctgaactccggactcgctgacatcagctcgaccatcagcgcggcagcaccatccgctgattccggtggcgatttctccagcttcggctcgggcggcggctccggtttcggtggctcgttcgatggctcgggtggcggctcgttcggcgggcggtaaatccagcgttctgcttacgctggaatcggacacagaccgtctcattactgttgaagggaatcaccatggcattgttccgtaacctcggaccgttctccaccaccgccatcggccacggcgaaatgccgctgaccatcgaaaacaatcgtggccacgaggtcggcatcgaaaccctgcatgcctcgctggacgccggctgccgtcacatcgacaccgcttgggcctactactgctccggcggcgaagaacagaccggtgaaaagctggtgcgcgaggcccttgagacctggaaggggccgaaggacgaggtgctggtggccaccaaggtgggccacttccgcaacttcaccgacggccgccccacgtgggatgtggacggtcgcccggagaacctgattcggcgcggcaaggagagcgcactggcgctcggcgtggacaccattgacctgctgtacttccaccgccctgatccgaaggtgccgtacaacgagtccgtcgaagccatcaagcagctggtggacgagggcgtggcgcaggaggccggtatctccaacgcctccatcgagcaaatcgacattgcgcgcggtattctgggcgacaagctcgtggccgtgcaaaaccagtactcgccgattcacctggagacccaggacacgctcgactactgcgccaaggttggcttggccttcgtgtgctggagtccgctcggcggctaccgtcacccctatgatgagaccaagttcgacccgttccgcgaggtcgcggcggcccacggcgtgagctaccagcaggtcgtgctggcatgggagctcgccaagggcgaccacatgttcgtgattcccggcgcgcaccgtcccgaaaccatcctcgactccctgaaggccgaccagctcgaactcaccccgaagaactcgccaagctcggctgaactttctcagctccccttgtcaggggagctgtcttgcgtagcgagactgaggggtagtcgccggagtagtcccgggtagttccacaaggagataattgtgcgcaaaaaactcatcctcgacctcgataccggcatcgatgacgcgctcgccatcgcatatgccctaggcagtgccgacgagatcgatttgatcggtatcacggccacctacggcaatgtcgcggtgccgctggccgcgcgcaacgcgctggcggtactgcacttgttcggccgtgacgacgttccggtctatcccggagtcgaccatcccatcgccccggcaacattgccgaaaatgcgtggcaccacaccagacgagcgggcccaggcctacgcgcgctggcagaacggcggtgcggacggctggcaaacggacgcttcgtggtcaccaactcccggctcggtggcggtccaccatcccaacggcatcggcggcgcaatcatccccgactccccgcgcgctccggaagcaccaggctcggcggtcgatttcatcatcaccgccgcgcgcgaatacggcccggacctgaccatcgtgcctacgggcgcgatgaccaccatggccaccgtattccgcaacgctccggacctgaaggattccggtgtgaacgtgacgttgatgggcggtgcccttacattgcccggcaatgtaagcccggccgccgaagcgaacatctcccaagacccagaggcagcagactatctgttcaagtgtggcgcactcaccaccatgatcggcctcgacgtgacccaccagaccgcgctcactcgtgagaaagcccatgaatgggcgtctctggggacgccagccggcgacttcctcgtcaccatgaccgactactacatcgacttctacctgaagaaccagccggagattcgcggatgtggactgcacgacccgctggccgtggccgccgcgctcgacccatcgctggtcacgaccttcgggttcaacttgcaagtcgatctcgagggcccgttccgaggccgtaccatcggcgatcgttcacggcttcaggaccccgacaaacacacgcaggtcgccttgggcgtcgatgtgccggaattcctggatcgtttcatggggcgcgtcaccgcggcggcccggtgacgcggacggcggccgtccggtccgctccacgccgtggatggatatgacccatggcgtggagcgcccttttgggaaccgacagaacatagggggcgctgcatgcgcagcgccccctatgtgtcagatcatgccgcagcccggaatcaggccgccgggcggatcgagcgtgagatattgctcctccagatcgatgtcggggaccaaggcctccacgaacgggaccaacgcggtcttttcgaccacatcctcgcccttggaattctggccggttaccaccggctcggtcaaacgaatcttgagcagggattgggcgggggagtcgatcacatccaccactttgccgaccacttggccggcgggcagtcccagaccgttgccctcgactagacgggcctcaaggccaataagatccttgggataccattcgtcggcctcgagcatgtcctccgcatcgtcgacctcgccgtagagttcgacaccgtttagggcctcggcggcattgcggtcgtcgacgccctcaagcttgagaatccaacgatccttgaacgtgcgcgagccctcgacgatgtactcggtctcgccatcctggctgtagagcacggagtccggctcgaagcgccactcgggatcatcggtgtacaggcgcacggtgacttcgcccttcaggccctgtgcgcggccaatacgagcgaccctcagcaactcgagctgctgagggtcgtcgtgcatgtcttgctgtgccatgctgtgaatcgttccttatcagttatcgacggacgtccatgatgtcaacgcggaccttgtggtcagacagtgcctgaatcacggtgcgaatcgcgttggcggtgcggccgccacggccgatcacacggccgatgtcttccgggttcacgcgtacgcgaagcagttcgccgcgcgcgttctcatgagacttgacggaaacatcgtcgggaaaatcaacgatgttcttgatgaggtgttccacagcttgtgcaagcatagctagcctttcgtttccgctcaggcctcagccggagcttcttcggcggcctcttcagccggggcttcctcagcggcggcagcggcttcggcttcagccttggccttggcagcagcttcggacttggcggccttcagcttctgagcctggtcctcaacggccgcgatgcgggcctcggcgtccgggccagcctcaacggtcttcagggtgccttcggcaccttcaaggcccttgtacttctgccagtcgccggtgatgttcagcagcttgaagacgggctcggacggctgagcgccgacgccgagccagtactgagcgcgatcagacttgatctggatggtcgagggctgggtgttggggttgtaggtaccgatctcctcgatgaccttgccgtcacgcttcttgcgggaatcgacgaccaccacacggtagaaggcgtagaacttcttgccctgtcgcttcagacgaatcttggttgccaaaatggctctccttgtaatgctaggtgtgcgggttctcggtttgccatgtggggcatggccgtccggaatccacgtgtcctcgcggctcggggtgtagagggcgccacgcgcgcgcgaataactggcctattatagcgcacagggccggactgggcgtggcgcactgtggttgtggtgtggtgcgcgttccccgttgcgcaacattccggggaatgtatcgcgaaaatgccggctatcgcagtgcaagcgttgcggtcagggccagatgatcagtgccctcgacctcaaacgacttcacgccggacggtttgagcccgggagtgaacagcacgtgatccagctcgatgcgcggccacttgagccagctcgggaaggtgagattcgggccggcggcttgaatcagacttgcgtccttgaatccggacttgagcaacgcgcggaagctcggatggtcggtgctcgagttgagatcgcccataacgacgacgatattgcgattgctgacggattttgcacgggcgagttctcgcagacccagaatgccggccgaccaatccgcgcagccgcgcatcggcgatttcgggtgagccgaacaaagcgtcaccgtgcgattaccggaggttttgagggtgatggcgggaacgtcggcggcggggatggagaccacgttgggcaccgctgcgctcggctcgtagcgggaatagatcacgttgaatccgccattatcggtctctttggcgtctccgaactgatggtaggggagaagttcgttgatgtcggcttcggtaagacgtgtgatgaggtcgtcggtgacttcctgcaaggccaatacgctgatattgcgttcgcgaatattgcgaatgatttcagcggcgtcggcgcgtccgtatcgacaattcatcgtcataaccgagaactggggcgagagtgtttcacgcgttgtttcacagtgtccatcggagatggtttcgggcccttccttcggagtgtttgaggtacccgatgtattgctgttatggctttttgacagcgtcggcgaagttgtttcacgggctgtttcacggtgggattctttgcgtttcccggccgggtcgattgacgtaccccagtagttgatgcgctgtgagctggcaatcagcgcgaccacaataagcaacgacatcgcagtccattcatgttgccatgcggcgaccgcggccagaatcatcaaaggaacccacaacagcggcgtcagagcaatcatgtacggaagcggcatacgggcctcgagaccggcgggcagcgcgcttaaggtcgtccataacagtgcgatgattgccaccgcgctgaggattgtcgtcatggaagttcctttcgaaatataaattgaaccgagatataatttggctcccctctgcgaggggagccaagttgtgagatcagcgaccgaacagtccgccaaggcctccgccgaggttcggcggcagttcagtgccaccgtcgacgttgcccatcatctgctcaaggccagcgggcagggccgggttctgtggcttcttggcgaaggcggaaccgccggtcgaaccggaggacttgccggccagcttatcgcgcaatgccttctcctcggcctcgcgcttcatcggattgccggacttgccgcccttcttcttgttcttgcccttcttcttgccgccgcccatagccgggccgccgaagccggggatgccgccgcccatgccgccacgattggacatgcgcttcatcatctttgcggcctgctcgaaacgctgcagcaaagcgttcacctgagaaaccgtcacgccggaaccataggcgatacgggcgcggcgggaaccattgataatcgacggatcgcggcgctcggccggggtcatcgagcgaataatcgcctcggtgcggtcgatttccctctcatcgaactgctcgagttccttgcggtgctgggccatgcccggaatcatgccgagcagcgacttcattgagcccagcttgcgcacctgctgcagctgatcgaggaagtcgtccaggccgaaggaaccttcggagattttctcggcggccttgcgggcctcttcctcatcgaactgcttctgcgcctgctcgatgagcgtcatgatgtcgcccatgtcgaggatacgcgaggccatgcggtccgggtggaagacctcgaagtccttcaggccctcaccgttggaggcgaacaggatcggcttgccggtcacggacgccacggacagcgcggcaccaccgcgggcgtcgccatcgagcttggagagcaccacgccggtgaagtccacgccttcgtcaaaggccttggcggtcttgacggcgtcctggccgatcatcgcgtcgatgacgaacaggatttcgttgggacgcacggcatcgcgaatgtcgcgagcctgcttcatcagctcctcgtccacgcccagacgaccggcggtatcgatgatcaccgtgtcgtagagcttctgcttggcgagttcgatggaatcgcgggccaccttcaccgggtcgccggaggtctggcccggagctgcgacggcctcgccgccatcggattggacgcccttttcgggagcatagacgggcacgccggcgcgttcgccgaccacctgcagctgcgtcaccgcgttcggacgctgcaaatcggccgccaccagcagcggcgtgtggccggaatccttgagccagtagccgagcttgccggccagcgtggttttaccggcaccctgaaggccggcgagcatgatgatcgtcggcgggttcttcgcgaagttcagcggacggtcgacgccttggccgagcacgtcggtgagctcctcgttgacgattttcaccacctgctgggcggggttgagtgcgtcggacacctcggtgcccagtgcacgctcacgcaccttgccggtgaaggaacgcaccacgtcgagcgccacgtcggcgtcgagcagcgcgcggcggatttcacggatcgtgccgtcgatatccgcctcggaaagcttgcccttgctcttcagatgcttgaacgcattcgagagtctgtctgtcaaagatgaaaaagctgccataatgggcaacagtctagccgccacgcgggaaattgcggtgttggggacgacgcttttcggggaatgtgccgcgtagtagtcagggatgttgggcattcagacggcaaatgccgtgccgtccgctcgtggcgaagccaatcgagtgcttccgataccatggaaaccgtaaagaatcctgtgttttttggaatacttacgctgttttgaaaatcgctggacaccgcttatacgcagactgccgtgcgctccgaaccatgacgttcgggccaacgcagacatgccgtgcaataaggaaggcccactgatgcccacccaaaaactactcgaacgcaaagccctgatcgttggtatcgtcatcaacgtgctgcaggtcttagccggcatggccgtgttcttcatgaccggtctcaaggccatgttcctcgacttctccttcaccgcgatttccgtcctgtccggaatggtggcggtgtacctctcgtcgcgcacggtgcgaaccaccgagcgcttccccaatggcatgttcgcactggaacctatctacgcgatctgcaaggccattttcaccatgtcgttgttggtgtattcgctgattgacgtgtgccgagtagcgtacgactacttcgtgttcgggtccggcgaacgcattgaaaccggcccggtggtcatctacgagatcctgaccgtaatcgtgtgcttcagcctatacacgtattaccggcgctccaaccgatccatcggcgattccagcaccatgctcaccgccgagtgcaagagcacgttggtcgacggatcgatgtcgttcggcatcggcgtagttgccatcttcctgatgctgctaccggccggcggtccgcttgacttcctgcactacaccggcgatttcttcatcaccgtggctttggtggcattgaccatcaaggagccgttcagcgtgctcaaagaggcgttcgtggaattggtcggcggcgtgcatgacgacgatgaaaccaacgcctacgtggaggccgaggcacagcgccatctgcctgccaacaccgactacgagcagacgctgatcttcaagaccggtatgaactacaccgttgacgtgtatctgagcggcatcggcgaaaccattgatgtagctgacctcatcgaatgcaagcgctcgctggaaaaggagctcagcaagcgcctgcacatcgtggacgtggacttcgtgtttgactgattgatgggtttgaagcgactacttcagactccaagtggaaccctgcgggccgtcttcgatggcgatgccggcctcggtcagggcgtcgcgaatctgatcggccttggcgaaatccttggccttgcgagcttcggcacgggcgttgagctgttcggcgatcagtgcctccagcgctgcatgctcgggcgactcggccgtgccatcagcggcaccgccggcagcgccggcggacacccacggttcggccagcgggtccaggcccaaggtgtcgagcatggcacgcacggcgagcagcgcctcacgcacctcggccttggcggtttcggaatcggcgcggtcagccagctgtgaaagcaacgtattgccggaacggatggcggtgaagatcgcggcggttgcaccagacacattgacatcgtcattcatggcggccacgaaatcggcgggcaaatcgtcggcggagacggcagtgacttcctcgcgagaaggctgtccacccagcgccacaccggcacgctcgatgaagttcgagacgcggtcgtatgcggcctgcgcctcgaccagcgcctgatcggaccattcgagcatcgaccggtactgcacggagcccagggcgtaacgcaccacccaagcggaatgctcagccaacacgctcggcacggacaggccggtgcccagcgacttcgacatcttctcgcccttggcggtcacccatgccgaatgcatccagcgcgcagcggaggggtagccggccgcacgggtctgagccatttcgttttcgtggtgggggaagcgcagatccaagccgccgccgtgaatgtcgaagccatcgcccaggtaacggtgggacatggcggagcattcgatgtgccagccagggcggcccacgccaaacggcgtcgaccaacgggcgtcctcgggatcggtgtccttcggagccttccacagggcgaaatcacgcggatcatgcttgtcgggggaggcatcggccgggtcgaccggattgtacttgtcggcaccggtggcgtccacggacgggcccatgcggtcggccacggcggcggcctcatcgacttcggaggtctgcttctggtgagtgagttcgccgtaatgcggccaggatgccacatcgaagtacacgttgccggtgggcttgccgtccgcatccgtgaccacatagccgtgaccgttgtcgagaatgcgctgaatcaggtcgatcatgtccgacatgtggccggtggcgcgaggttccacagtgggcggcagtacgccgagcgtgttgtatgcctcggtgaattcgcgctcgtagtaataggcgcgggcccaccaacgctggcctgcggccgcggccttaacgagaatcttgtcgtcgatatcggtcacattacgcacaaaagtgactttgtagccgagcttcaaaaaccagcggcgcacgatgtcgaacgccacggcggcacggatatggccaatatgcggtgacgattgcacagtcgcgccacacacataaatgccgacttcgcccggcttgagcggcacgaaatggctgacctggtgcgaggcggtgtcatacagattcaggccttctgcggccttggcaacatgcaccggcgtcaggcttgaaggcatgacggaaatgttgaaatcctgcggttcttggctgtttcccataacactcaagcgtagggtccgaaccagacatgctgaatcgttactcgaagagtttgatgaacgcttcacaggtggggcccgaacgaggtgacagacggatgagaagcgggacaacagtctcgcgagaacacgtctttgaccgctgcggaaactgcgagattcatggatttgccctgctcgttacgcaaacggggaacgctcgtgccacaatagaagtcatggccacaccacaagtgctcattttgcaacatgtcccatgggaacgcccgggacgcatattgtcgaacctcgaggacatcggtcttgagacggtgacgatgaatatcgtcgacaaaaagaaaccggacttgcctgatttcggcgaactggctggcgtggtaatcatgggtgggcctatgggcgcgcttgattacgacaagtatccggggctgaaggcagaagccaagttggcgcgtgccgccgtggcttcaggcaagccgattctcggtgtatgcctggggcatcagattatcgccactgcgcttggtgcgcagctgcgcaagggcgatgcgccggagattgggttcgcgccgatcaagcgtgtggacaagcatgacttcttctccatgtgggataagcagctgacagtgctgcactggcataacgacgtggtgggcctgcccgcggaaggccagctgctgtcgcgttcgtcttccaccaaggtgcaggcattccgactgggatccgcgctgggcatgcagttccacctggaagtgtgcggctcgctgctggacgaatggctggatgagccgagcatggtcaaggatctcaaggccgcgggtggttccaagtcccaattgcgcgagcagttcgcccaatacgaccagctactgcaaccgctcgccgagcaagtgttctccggttttgcggcccgctgcaactcctacgctcagacgctgaacaaataacgtttgcgggccgccgctgggcaagcgtggcgctacattggtgagtcatgccgacttatgacattggactggaacacgtttcgctcgctttcgctaccaaaaccatcttcactgatgtaacgcagggtgtttttgaaggcgaccgcatcggcatcgtcggcaagaacggcgacggcaaatccacgttgctgcacctgttccgcggtgctcaggagccggattccggccgcgtgacaaagcgtggcggactcacgttcggcatgcttgaccagcgtgatccccttgatgacaacgccaccattcgcgaagccgcacttgaggggcgcgccgactacgaatgggcgtccgataacacttcccgtgaaatcgtcgaggcattgctcggcggcatgagcctggatgccaaggtcggctccttgtccggcggccagcgtcgccgcgccgatttggcccgactgctgctcaaggattgggatattcttgcacttgacgagcccaccaaccatctcgacgtggtcactatccactggcttgccgaacatttgaagaaccgctggtccaaaggccagggcgctctgttgctcgtgacccacgatcgctggttcttggacgaggtctgcgaatcgatgtgggaagtccacgatggcgtgatcgagccgttcgagggcggctattccgcatatatgctgcagcgcgtggaacgcgatcgccaagccgatgtgcgcgaaaccaagcgccgcaatctggctcgcaaggagctcgcatggctttcccgcggtgctcgtgcccgctccaccaagcagaagttccacgtcaaggccgcacgcgaattgattgccgatgtgccgccgatgcgtaacacacttgaactgaagcaaatggccacctcccgtctcggcaaacaggtggtcgatttggtcgacgtgacgcagattttcgaaaaaccgcagggcatggccgatatcgacccggatgtggcggcgctctccgcgtccgcttcccgcgtggatgtggtcaacgccatgtacgccgagccgcagctgcatggttccgttgaggtggcggtcaccgacatgactgacccgcgcctggtggacgccggcgtgccggaagccgtcgagtccgctgaggaagcgcgtaagaaggccgaggctgagagcggcaatccgcagcttgctgacgatcgcgaggttcgtcgcatgaacacgggtggtgaaaccatcggcggtggcactgctgcaacggattcggatgatgacactgctgcagccggtgtcacctcggctgcacgcaaggtgacggtttccggccgcgagattcttgacgatgtgacttggctgattggcccgggtgaccgcttcggcatcgtcggtgcgaatggtgccggcaagtccacgctgcttaagttgattgatggcacactcaccccgaccgcaggccatgtgaacattggcaagacggtgaagttcgcggtgctctcgcagcgcctcgatgagctggagaagctcggcaagtacaagatcaaggaagtgctttcccgctataagccgagctacattgtggatggcaaggaagtgacgccgggacagttgatggagcgtctcggcttcgaatccgcccagctgatgacgccgatccgcgatctctccggtggtcagaagcgccgcatgcaactgctgctgattctgcttgacgagccgaacgtgctcatcatggacgagcccggcaacgatctggacaccgatatgctcgccgtgatggaagacctgctcgatacttggccgggcacgttgattgtggtctcccacgaccggtacctgctggagcgcgtcaccgatcagcagttcgcgctgattggcggcaaagtacgtcacttgcccggcggcgtgcaggactacctcgatatggttgaggctattaagaacggcaagggattgccggctgacacgcctggcttcgcgggcaccggtagcagctcggcgaagtctggtaagggtaaggcggccgccgtcaacgctgccgcatctctccctcagtccgcttcgcggatagctccctcgtcagagggagccaataacggtgaggactccacctcgaagctcaccggcaaggccttccacgaggcatccaagcgcgtgaatgccatcgaacgtaagctcgctaagcttgaagagcagaaggccgatctcgaggcgcagatggccgcccatgacccgagcgactacgagggtctcaacaagctcaatgaacaactcaccgccgtcaatactgaaagcgatgatctcgaagccgaatggctcgaactctccgaacaattggagtagcgggagaaaccgtaacgttcacaaggcctcggcagtttgccggggcctcccgctatgcaaactcccacggattaatcaattccacgtcggtaccttcgaagtccttgatattgcgcgtggctatggccgcatcccaggaacaggcaattgccgcaatcatggcgtcttgaatactggtaggtgtgcccctgtgttcgcgttcgacaaggatatgggcataatccgcagctgcctgagtgtcaaatgcgaacgttctgtcctctaatgtcataagcgccagcttgacggtcgtatctgtgtactttcgtcgtttgccttcaggcatgcgacatattccggccaacaactcggcgacggtgatggcggtggttgccaaattgcttgtatcttggttcctcagccaattggcaacgtgttcgtctggctgtttcttgatgatttcgctgatgacgttggtgtccagaataatcatggccgattcctattcaaaagatactggcggtcgggaatcggcggaatttcgctcggatagtgggagttcccccttgtcgagtccctcaaaatccatgttcttcatgaattcgcggatctcgtcatagaaattggtctttcgcgtgatttcatgcgccaccgtgccagccagccattcttcaagaatggatcgcacctgagattccatggagcggttgtttttctcagccacttctttgagctgctgaatctgctcatcgggtatttttcggatggtcaatgttgccatgatgcacctccttgttgctgtcataatgctagcatgaggtgctgtcgttttgcttgcagtacgggtgatgaggtatgcacgcatgaaaaaaggcggatatgcatcatgcgcatccgccttttgagcttggactgggtcttcccgcagtcgccgaatcagcgcccggtaacctcggaaccgacgaccttttcgctcagggcgcgcgggccgcgggtcacggctacggcaccggagcgcaccagctcaatcacaccgtaatgctccaaaagccccagcagggcgtcgatcttgccttcggcaccggtggcctcaatggtcagcgattccggattcacgtccaccacgcgcacgcggaacagacgcacgatctccagcacgtcggaacggttggattcgttggcggccaccttgatgagcaccagttcgcgttccacggtggagttcgggtcgagttccacgattttgagcacatgcagcagcttgttgagctgcttgatgatctgctccagcggcacggcctccacgtcggcggtcaccgtgacgcgagagatgtccggacgctcggtgggggagacggacagcgagttgatgttgaacgcacggcgggcgaacaggccggcgatacgcgccagcacgcctgggcggttctccaccagcacggacagcgtatgacgctgggaaccaggctgggatgcaggatagttagccatgagtgttctcctctcctcagtgctcgctcgcagtggcagcggcggtctcgtgctcgaacacgccggtcgcatgctcgtccggaccggttcccggagccggggtgccgccagccagcggcttgatgccgggcttgtacgtcacctcgtcgttgggggcgccggcggctaccatcggccacaccatcgcatccttccacacgcggaagtcgatcagcaccgggcggtcgttgatctggttcgccttttcgatggcggcaatcgcctcttcctcggtgaacgcgcggatacccacgcagccgtatgcctcggccaacttgatgaaatcaggcacttcgagcggcgcatcgccgtcggccagtgccgccgcaccatcggcaccgtgcgcttcaccatcgagcaggttggtctgcgagtagtggtgctcgtagaacagcgtctgccactgacggaccatgccgtatacggagttgttcagaatcgcgatcttcaccggagcgcggtccaggaacgcggcggccagctcctcagaggtcatctggaaggaaccgtcaccatcgatcagccacaccggcttcttgccctcgaattcacgggccgagcccacggatgcgccgatggcagccggcagaccgtagcccatcgtgccgaggcctccggaggagatccaagcgtgctggttctcaaaatcgatgaactgcgaggcccacatctggtgctggcccacaccggtcacccagatggtggacggatcggccatctcagagagcttcttgatgacccactgcggggccagcgatccgtcggtcggctcatcccacgtcatcgggtattcctcgcgccagccgtcgatcgccttccaccagggggccagattcggcttgccctgaatggcctgcgcacgctgaatctcgggaatcaagtcgtcgagcacggtagccacatcgcccacgatcggcacgtcgggctgacggttcttgccgatttcagccgggtcgatgtcaatgtgaatcacgcgggcggtcggtgcgaaggcgtcgagcttgccggtcacgcggtcgtcgaaacgtgcaccgatggccacaagcaggtcagcgcgctgcacggcgccggttgcggcaatcgtaccgtgcatgcctagcatgccgaggttcttcgggtcggagtcgggaatgatgccgcgtgcgggcagggtcgtgaccacgggagcgccggtcaggtcggccagagccttgacctgtgcgccggcgttggagcgggcggcgccgccacccacatacagcaccgggcggtacgactgagagaacagcttcgccgcgtcggacagcacacggccgtgcgccttggtggtggggttgtagccgggcagaatcatgcgctgcggccatgagtagtacatgtcgccggtctgtgcggtcttggtcagatccacgaccaccgggccggggcggccggtgttggcgatgtagtacgcctcggaaagcacgcgaggaatgtcctgcgcgcgggtcacgaggaaggagtgcttggacaccgggtaggtgatgcccacgatatccgcctcctggaaggcatcagtgccgatggcttgcacgcccacctgaccggtaatcacgaccatgggcacggagtccatgttcgcgtccgcaatggccgtgaccacgtttgtggcacccgggccggaagtcacgatgcacacgcccaccttgccagtggccagtgcgtagccttcggcggcgtggccggcggcctgctcgtggcgcataagcacgaagcggaacttcgtgttgtctttgatctcgtggtagacgggcagaatcgcgccgccaggaatgccgaagacgtcctcgacgccgaggtcctccagcgaacgaatcagcgcctgggcgccagtcatcttctcgccatcgacgatggtctgcttatcgggggccgtgttgattttcggtacaccgctgaatgcctgcaaaggcgtgggtaaagccatgattcctctcacctcataggttttgtcgcgaacctgcccgaccttgggatggggccgggtgcccgcgtgtctgattccagtcgcttccccgagacttgtggccccggcgcgactcgtcgctcatgttggtattagtctattcgcaaatccgacagcgggcttacttagtccgcgtcttgaacgagtccagtgacttccagcccgcttcggctgccgccagctgcgccttacgcttgctggagcccttaccgatgccgatgatgtcgccgttctcgcccaatgagacgcgcgcggtgaagatctgcgcgtattccgggccggagacctccatatggtagacaggctcctccttgccgaggccgtgcgccttgacggtcagcgaggtcttccagtcaagtgccgggccctcggtggccacttcggcgagcgtgtcgtcaataagccggtgaatcaccttgcgtgcctcgtcgatgccgtgttccaggaaggtcgcgccgatgagcgattccacgatgtcgcataggatggagttcttctccgcgccgccctgctcggcttctccgtgacccagcagaatgtaggggcccaccttgagcttggttttggcgatggcgctcagcgcgtcttcggagacggccttggcgcgcatcttggccagttgcccctcggtcatatccgggtgaatggtgaacagcgtttcagtggagaccagttcgagcaccgcgtctcccaggaattcgaggcgttcgtaattggccacgccggggtgctcatgcgagaaggaacggtgggtgagtgcctgcacgagcagatccgggctgagagtggtgcccaacgcttcaagaagctcgttggccggcgtcggctgctgtggggtttcattactcatgattgttgtatggtccttcacgcgatggtgatgtgttgtgttgtgttgtgttgtttgcgatgcgatggtgtacgcaatggtgcacttatgcgaagaccccgccacccgtcgatggcagggccttcattcaagccgttatcgcaggactcacttggtgtgagccggctggatggcggagcggtaggtgcggccgcggtagttaccgcagctcgggcaagccatgtgcggcagggccggagcgccacagttcgggcagttcacggtcgcagcagcggtggccttccagttcgcgcgacgcgaatgcgtgttggcgcgcgaggtcttgtacttaggcagtgccatttgagtatcctctatttcgttcgaacaattgagcttaagcgtccgttatcttaacgcacggctcgtacaaacttcgttcaggcgcgcgtcactcggcctgctcgccgttctgctcggcctcgagctgggctttgagccccgccaatccggcaaaacggatatccgtcacatcgtgatgatggtcgggatcctcgttcagatcggcaccgcactgcgagcacagacccctgcaatccggtcggcacagtggttgcaacggcagcgattcgaccagcgtgtcgcggatcatcgcctcgatgtccgcgaatgcgccgttctccagcagcggatacgtgtcttccgactcgtcctcgccggcgatgatgtcgatttcgtcgtccttcttgctcttgccgcccttgccgttggccttgtcctggcccgactcgtacgggaagaacaccgtcacatcaaccggccagtcctcgtcaatcggcttcaggcagcgcgtgcactcgctgacgaatggcgcgaccaggcggccggtgaagatcaggccgtccacaatcgaatcgaactgcccgctcacgtgtacgggctcaccttccttgatgccgacaatgctgtcgccaatgccggaaggtgccgggaaatcggcgtcaatcggcttggattgaccggcgcgcgaagcaatctgcgctaccggaatggcccacggggaatcttcaactcgtgccatggtatgttcttggtgcctttcgtatgttggctggagttattcgttactggcgttattcgcgttactgatgttgccggcgttgctggcgttactgggcttcgggatagtcgttcagcgtcaggtgcggcatctgttcgcgggccgcgcgctggcgctcttccagcacgttaagaccggcctgcacatcctgactgagtttgccgagctgctgggacagcccttccatcaccgtagtgcagtactggtccgcgccttgggtcagatggtcggctttggtctgtgcctggtcaagaatcgcgcgcgctttctgccgtgcaagctcggtgacgttctcttggccggccaggaactgtgcctgttcgttggcgtccctgatcatgttggctgcgcggctttgtgcggaggcgacgatggcgttggactgggtctgtgccgattccagacggcgctcggcctcgcgcatgagggcggaggcgcgctccaactgcaccggcagcattttcttcaactcggaaagctggtcggtgaattcgtcgcggtcaaccttcaccatgccgggggcgaatatgctggacttcgcttcgcccagtgccgcctcgagctggtcgatgatgtcatacaccgtggtgaattcctcgtggctcttgaccgtggccgggtcgtcgtccgtggtttctcgcaggtcgggcatttcgttcatgaacgaggggcgaatgccggcggcctgagcggtctgagcctgtgcccgggtctgctgagctgcttgggcctgcgctttggcctgcatttgtgccggagtaggggtaggcgcggcgggcggcgatccggcgagaacatcggcctcttcggtgggtgccggcgcggcttgcgtagacgcgggcggttccggggcggacggctccggagtggacgatgcggcgtccgcattcggtttggtcagatcgacgtatccagtagggtggtcatcgctcatagtcattagtgcatcagtccttccgctgacgttcctcggccagggcatcggccagcatcggcacgacgcaatcgggcaccatgccggtcacgtcgcctccatggcgggccacgtccttgacgatggaactggagatgtgttcaagaatcggatcggccggcaaaaacagggtttcgatgccagcgagcttgcgattgaccagcgccatgccgagctcggcttcatagtcgccgttctggcgcagacccttgatgataacggtggcgccgaccttcttgcagtagtcggtgatcaggccgtcggtggaagaaacggtgacgttcttgcaaccggctttgtcaagggcgcggcggatcacgtcgactctggtggcttcggaaaacatcggtgttttcgcggcgttgacggccaccaccacatgcacctcgtcgaaaaaccgcgccgagcgctcgattacatccaagtgtccggcggtaacggggtcatacgagccggggcatactgcgatagtcatgctttatagcctaccgctagtggtgtgcttcgtgctgccgagcgtgcattgttgtcgcgtcggcgtatgaggcagtgtgtgcggtgccgtatgtggcgtcggtgtggcgtcgtgtgcggcattgtatgtggcattgtatgtggcggggtggcgtgatgcgcgacatgggtgtgtggaggtgtgcggattacgcgccaatgggtttcgcgggtaacgacgggaatctatgatggagtgcagtcgaatcgttgaatacgaggaaagaagtgcaccatgacttttgccgagatgttcgttgatgatgccgaaccgctgcgcaacccggaccaaggtgccggcacgtcggtgctggagcgtccggagaccaaggagtcgccggttcgtgacgatggtggcgacgccgatcgttttgcgcactacgtatccaaggaccgtatcgctgaatcgcgtgcgaccggccgcccggtggtggccctgtgcggtaaggtttgggtgcccaagcacgatccgtccaagtacccggtttgccccgactgcaagcggatttacgaggaaatgacgcgctaaaggtggtacttggctcccctcagcgaggggagccaaaatggtcaccgagccgaaatctcgtcgatcagcttgagctcctcgtcgctgaagtgggtgttcttcagtgcgccgatgttgtcgagaatctgctgcggcttggaggctccggtcagcacggaggtcaccttgccgtcgtgcagcagccatgccaggctcatctcggccagcgtctggccgcgttcggcggccagattgttcaggtccacaacctgcttgtgcagtttctcggtcagggcggaatcgttgaggaatcgcggatcgtgagccatgcggctgtcggccggaatgccgttgagatagcggttggtcagcaggccctgagccagcgggcagaaggtgataaggcctttgcccagcttgaaggcggtctctttcaggccgttcttttcaacggtgcggtcgaggatgttgtacttgttctggttgatgatgaacggcacgtgcagttctgccagaattgcggcggccttttccatcgtcggaccatcgtagttggacagacccacgtacagggccttgccggagttcacggcctgagccagcgcgcccatcgtctcctcaagcggggtttccggatccgggtggtggtggtagaagatgtccacataatccaagcccaagcgttccagcgactggtcgaggctggcgagcaggtacttgcggctgccgaggtcgccataggggcctgtccacatttcgtagccggccttggtggagatgacgagttcgtcgcggtgatgcttgaagtacttggcgagcagcagtccgcagttcttctctgcctggccgggctcggggccgtagttgttggctaggtcgaagtgggtgatgccgttgtcgaaggcggtgaagaccagggacttcatctggtcgaatggcgtgatgtcgccgaagttgtgccagaagccaagtgagacggccggcaacttgaggccggaggtgccggcacggttgtaggtcatcgtgtcgtaacggtgcgggttgggggcatagatggcggttggctcgaacattgagtctccttacaatgtcattcttgttcttacgaatgcttacctgcgatgggcaaaccgacgccgattgagcggtattcgtaagtgttcttggatactatggttccagttcaagtgaacttgaatgcaaacggctgcgacgcttcggcgtgttgccgcagtaaggagtcatgatgtcctacaccattcgtcaggtggccacgcagttccatatgcagccctctacgctgcgctattacgaggatcagggattgctgaccaacgtggagcgcaccgaaaccggccagcgcatatacgaagactgccatatcgaccgtctgcgcgcgatttgctgcttcaagaacgccggcatgaccattgacgatcttaaaaagttcttcgtgtatgagtccaatgagcccgagcatatcgatgaaatccttgatctgctggaatctcgccgcgaatccttggacgagcagcgccgagccctcaacgaggcggccatgcacgtgcagcgcaagctccattactatggcgacatcaagcgtgccatcgacgccggtgaagactggccggattggcgcgagtacaaaaaccgcgcctattccattgaatgttgagaccatcgaatgttgagaccatcgaatgttgaggccatcgagtgctgagctggatgccggctgggcactaagaccaatgcgcgtcgatcgtgggcgcgtctatccgagtaaggccttgctcggcagtgcgcggtcgagcagccagacaacgagcgatatcacgaagaacgctatggccagcttgccgcagctaatgccgaacccttgccagtcgagtgcgtcgaggttgatgaagtcgtacggatacggactgccgccggccgccggtccggaccccggccaaatcgccgcacgggccagcacgaagaccaagtatgcagggaagtacgccagccacgagaacatgtaatgccagcggaaacgccggtgcgggtcgaatagcacgaaatcgataaccgccataatcggggcgattttgtgcagcatcgtattggtcatgatgccaataacctgtggcacgtatgccgggtcgtccggaggcgtcaggaagaacgccaccagtgcggtgactatggcgtacacagtcaggcaccccttaagccatgcaggcggctgaatacctttgagcagtgtggccgcgccggaccacagcatcacgatgcccagcacgaaaccggtctggaacgtgaaatacacccagaactgcggtttggaccatgcctcatatgtgcccacgaagcagaaaccggcgatcgcaaagcgccacaacgccacgatgaatctcatgcatcgagtctaccgcttcgccagtgggccgtatggtgcggctggcgtattggctggtcgtgatgattatggtcggtgtgaccgaccgccatagtgccgatgaatatgacgatactgaacccggcaatatcgaatctggcgatacgagaataagacgagcccttcccgcacggctttgcccggactacacttaggtgcaacttcaccacttatgtaggaaaggccttgcaatggtcgattattcgccggctctgatgaccgacatgtatgaatacacgatgctcgacgccgctctgaaagacggtaccgccgaccgcaagtgcgtgttcgaggtgttcacgcgtcacttgcccgaaggccgtcgctatggcgtggtggccggcaccggccgcattctggatgcgctggaacatttccacttggatgaagcggatctgaagttcctggccgaccgtcacgtggtaagccccgagaccattaagtggctggagaacttccacttttccggtacgattcgcggttaccgcgaaggtgagatgttcttcccgaactccccgattttgcaggtcgaaggcacgttcggcgaatgcacgctactggagacgttgattctatccgtgctgaactacgattccgcagtggcctccgccgcctcacgtatggcgtcggcagccaaggatcgtccttgcatggatatgggcggacgccgcactaacgagtgggccgccgtggccgccgctcgagctgccgtagtgggcggattcaagggtaccgccaatctgctggccgcccagctgtatggtctgaaggccattggcaccgccgcgcattgcttcacgttggtgcatgattccgagcgtgacgcctttgaatcacagatcgaggcattgggcaagaacaccacgctgctggtggacacctacaacatcgaggaagccgtgaaaaccgccgtcgaagtggccggtcccgaactgggtggcgtgcgcatcgactccggcgacttggccgccatggcccagcgtgtgcgcaaccagctggacgccctgggtgccacgaacaccaccattaccgtgaccaacgatttggatgagtacgcgctcgccgcattgcagaccgcgccggtcgactcctatggcgtgggcaccatgctggtcaccggctccggcgctcccacttgtgcgatggtgtacaagctcaccgagcgtgaaggcgctgacggcacgatggttccggtcatgaagaagtccaaggataaggccacagtgcccggtcgcaagttggcattccgctcctacgaatacgcgctagccgaagccgaacacgtgatttccggctcggaagagaagctggccggtttcacgcccgaaccgacgtggaagaacctgctggtcgatttcgtggaccacggccatatcgatgcgcagtggcagggccatgacgccatcatggccgcccacgactaccacgccaaggcgttgtccgaactgcccatcaccgcgcagagcctcatgaagggcgagccagtgattcctacggagactcaggttctctgacgagaactttcgtctccataggaatccgtcgcagcatagctgctccccttacctacggacagcccactgggctgtccgcttaacggttcgaccacagagaccaaagtcctctgaccgtatctcactggccgcatccctctggttacattggctactcttccctctggatgagtgaaactctcaatggtgataacgcggcgggcaacgatgacgtatcagagcggcgcgatgtagttcgatgatggttgacgagttgctatccaggcatagagcggatggcgtatgctggggcgcatggttgaaatcaaagacatgcttggcaatcaccaaataattcgtgccgacggccgcaaggtcgacgaactgcgccctgtgcgcatcacccgccacttcaccgacgcccccgaaggctccgtgctcatcgaatgcggtaacacgcgcgtgatgtgcaccgccacttttactcccggtgtgccgcgttggcgcaaggactccggcctcggctgggtcaccgccgaatactcgatgctgccgcgtgccaccgccgaacgcaccgaccgtgaatccgtacgtggcaaaatcggtggccgtacccacgaaatcagccgactgattggccgctgcctgcgtggcgtcatcgatatgaaggcgctcggcgagaatcagattcagcttgactgcgatgtgcttcaggccgatggtggtactcgcacggcttccgtaaccggtgcgtacgtggctttggtcgacgcagtcaattgggcggagaagcaccgccatatcaagtccgccagccgcgtgcttaaggactatgtgtccgccgtatcggtgggcgtgatcaacggcactccgatgcttgacctgccatacattgaagacagtcaggccatgaccgacatgaacgtggccatgaccggttccggcaccttcatcgagattcagggcaccgcagaacaccgtccgttcaaccgtgccgaactcggcaccctgcttgacttggccgaaaagggcaacaaggaactgcaagccgcccagcgtgccgctctgtccctagactaagccagctcccctgacaaggggagccttcttaaaggagaacctcatgcaaatcgtcgtcgcaacccataacgaaggcaagcttgtggaaatccgccgcattctcgaagaggatcttggcgcggatgccgaaaacatcgaactggtgtccgctggcagccttcacctgccggatccggtggaaactggcgtcaccttccaggagaacgcgctactcaaggcccgcgctgtggccatccgtaccggtctgcccgctgtcgcggatgattcaggtctcatcgtcgatgtgatgggtaacgctccgggcattctgtctgctcgctgggcgggtgctcacggccacgacaaggccaataatgcgctgctgctcgcccaaatcgaagatattccggatgacaagcgtaccgcgcgcttccgttgcgccgccgcgctggtggtcccggacaccgagaccggtgccgacgtgaccggtggagtggctgccgacggcatcaccgttcacaccacggctgccgatgggagccctgccccggtgcatgctcgatacgccatcaagtcggagacagtggagctcggcgacatgccgggtcgcatcatccgcgaggctcgtggcgtacacggtttcggttacgatccgctgtttgtcccggacgatcagcctgccggtcgcgtcagcactgagcctgaccatgaaggcgagccgctgaccagcgccgagatgactccggccgagaagaatgcgatttcccaccgaggcaaggcgctgaaagccttggtccccgccatcgaggccctgctgcactaagtcgtctaggctgtctagctgcactgagccgcgactaagccacagttgagtcgcggctcagcactcagcccccgaatcgggcgagtgtctagcaagcgcctatgacctagcaagggcgatacgaaagaaggccggcgcttagtgcgtcggccttcttgatgaacaagagccacccgatagaatcgaactaccgaccttcccacgaacgagggggatgctctaccactgagctaaggtggcgtggcttcaagagccaagtagagaatatagcactgcgtttgattcactgcaagccggacattcatcatctttgggccattgttctttggaccatcgtggcggcaatagtgcgaacgatgtgcacacctcatctgctcggccgccattcgtcgtgtgcgcgctatgctagcatggtgagcctgattgactcggaggcaaagggaagcatgcgtgattttgtgctggtgaagttgacagacgaggagttcgatgatttctccgccaggcatccacaaggcaatttccaacaaacctcggcgatgggacgccttcgcgccgcgcaggggatcgacgtcgaatatttggccctcaaggagggcgagaagatcgtcgcggcggcactgttcgaaactcaccgctctcgattctctacatttgcggtcatccatgatggcccgatgtgcgactatcacgacaccgaagcattgaccttcttcatggatgcgctgaaacgccatgccaaggcaaagggtgcttcacagctggaaatcacccctgaatccccgtatcggcttcgcgacaccaatggagcttctttgccggatgaccagaatggcgctcccgacaataagctgatagaacagctcgaggcgatcggcttcactcatggcggtttcaccgtgggctacacggcggttccgcgttggcgctacctcaaggatctgaccggcattaccgatgagaaaagtctgctgaagtcctatgacaagcgcacccagtggagcgtgaagcgtgcccaatcgatgggtgtgcacgtgcgtgagctgtcggacgacgagctgggggtattcgcacgaatcgagcagcaaaccgctgaacgccgtagcttcgaataccgtggcgaagcatatttccaccgtttcaaggaagcgttcggcagcaaagcgcattttatggttgccgagatccacatcgacgaatacgtagcggacatgacgtccaagcgtgaagcgctttcggccaaggtggcggcattgaccgccaaaaacgccgaacaccccaccaccaaaaccgaacgtcagctgggggaggagacccgcaatctggcggcagccgaaaagcgcctgaacgaggcggccgagttcgccaaagacggggatgtactgccggctgcggcatcactattcgtggagcatccgcgcgaggtcatctacctgttctccggtagcgtcgagcagtacaagcccttctacgcctccgcgctgattcagcatgacgcgatgctgcatttctgcgtggaacacgggctgtctcgctacaacttctacggcatcgacggcgtctttgatgatcccgatgacgaggggcgtggtgtactggagttcaagcagggcttcaacggatatgtcgaggaacttccgggcgagttcgtgctgccggtcaaaccggtcgcctatgccatgaagcaatttgcgcacaagctgctgtcgcggtaaacggacgcagcacacaggccattccagagcccagagtaacgatcagagtaacgacaagtaagaaggttcgattatgacgcaatccgatgcaggcgtcgcctcgctcacccctaccaagatcactcctgccgagctggatgcgttctccgcagctcaagtgcaaggtagtttccagcagacctcgcagatggccgccatgggtgcgttcaacggtccggtggactatgtgggtgtcaagcgcggtgacaagctgattgccgcctgctacgtggtgtacacgcggtcccgtttcggtttggaaggctcggtctggtgcggaccgctgtgcgattatgacaatccacaggtggttgaggcgatgaccgaagccctgcgtcgttcggccaaggcccatcacgccatcagcgtatcctgctggccggccgcagtctaccgtctgcatgatctggacggcaagccgaccagcgacccggacaccacgatgatggacaacatggcccgcttcggttggaaacatggcggtttcaccgtgggctacgaatccgtggtgaaccgctggaacttcgtcaaggggcttgacggcattcataatgagaaggaactgctggcctcgttctccaagtaccgccgtaagaacatccgcattgcccaggattccggtctgcgcgtgcgccgactggaacgcggcgaactgagcactttcgtcaagctgtgcgatatgagcgccgcacgtcaaggcttcaagagccgcgatctggcctactatgagcgtctgttcgataccttcggcgacctgatcgagttcaaggtggtcgaaacccatttcgacgaatatctggacaccctgcaatccaagctgaatgcggcctccaaagacaagcgcaacctcgaacgcctgctccagcgcacgcaacagcagccggaaggcacggccaagaagggtgcttccgacccggcaacgctggaaaagcgcatcgccaccgcagacaagaagattgcggcgctggaaaagaccatcggcgaagtcaatggcatcatcgcttcggacggcccggtcattccggtggaagccggcgtctacttctggcatccgaacgaggtcgtctgcctgtccagcggcgaggacgatcgtttcatggattactacccgtcttccctaatccacttcgaggcgatgcttgactgcatcgcccgtggcgtggagcgcttcaacttctacggcatttccggtattttcgacgccaacgatccttcctacggcgtctggcagttcaagactcgcttcggcggattcgtggaagagcttccgggcaagttcacgctgccggtggacggactgcgcttcggtgtatccgaagcagcgcacaagctgctgcatcgctgacaaacagtggcgagcacggacacagaaataaggcacaggtgacgacgagatgagcgcgactgcgaatcgaacagatacgacgtatacgtttggcgtgattacgcccgaagagctcgaccggctttccgaagccacaagccagggcagcttccagcaatggtccgggcaggtccgtcttgccaagattcgtgggcatgaagccgaatgcgttggcgtgtgcgacgcatccggcaatctggtaaccggctgcgtaattctgtacctcaatggtcgtttcggtgcagatggctccgtatatttcggccccatcggcattagcgatgatccggctctgctgcgggccataaccgaggcgatttgcgaatcagcccgtcgccaccatgctgtttccgtagcatgctggcctaacgtcgcctaccgtctgtattcctcggacgggcagcccgacggcgagccgaacgatgcactactggccggattcgccgatgccggctggacgcatggcggattccataccggttatgacgtggtctgtcagtggatgtacgtcaaggatctcaccggcatcaccaacggcaaggaactgctggcgtcattcggcaaacgtgctcagtggagtgtcaagcgggcgcagtcgatgggtgtgcacgttcgtgagatcggccccgacgagttcgacgtgttcgccgatatcgaacggcggaccggtgaacgccgtgggttcgcgacgcgtggcgcggactatttccgccagttcaagcaggcgtatggcgcagatgcgcatttcatgctcgcggaaatccacatcgccgaatatgtggcggatatgaccgccaagcgcgaggcgttgcaggccaaggtagctcgattgcaggcgaaatacgatgaacgtccgaccacgcgtatcgaacgtcagctgggggaggaatcacgcaatctcgcggccgccgacaagcgtctggctgaggtggagggatatgccaggaagggcgatgtgctgccggcagcggcttcaatgttcgtcagtcaccccaatgaggtggtctatcagtattccggttcgttggaggagtacaagccgttctacgcctcggcgctgattcagtacgaagcaatgctgcatctatgtgtggagaagggcgtgagccgctacaacttctacggcatttccggcgtgttcgacgatccgaacgacgagggccgcggcgtgctggaattcaagcagggctttaacggctacgtcgagcagatggtaggaaaattcacgttgccggtggataagttccgcttcggcgtgagcaatctggcgcacaagctgctgcgccggtagcaactggcggtcggggacgagcctatgtgggctgcgtctcgtctgaccgtgcacccgccgtgtgcctacttgcgcatttgctcacacgcccatcagcgcgtgagccacagccatcatcaccagtgaaatcatcgcggtgattgccagcgagaagccggccagtttggcgttgccgagtactttgtcggtgaacagcgtggagaaaatggcgatcggagccaacgcgcagatcaccatcacggcgcgaatcgaagccgagaacggcagcaggagccacgcgatcaacgcgaaggcgacgctgaacggtatacgccaagcgatgacggccatgacttccttcacgtcatgcttggattggggcaggtccatgagcatgcccaccatcagcatcgacaccagcgcgttggcgccgctcaatggctgggttatagaggcgatccaatcgggaatcttcacgttggcgacggtcaacacgatcatgagcagatacgtgtcgaacggcaccgagccgaagaagctcttgccgatggtgcgcagcaatgcgcggcgggcaagccgtttggcgtcgcgatccttgggcttttcgtacggtagggtgggagccgaaccggcgtgttgttcggcaagtgttttgccgggctgaatatgcagcagttgctgggtgagcacattggtgccggcggccaccatcacgcagttgccgatatcgaacatcgcagccggcaccaccgcgcccgcaccccagaatgactggacgaccgggaaagaaaaacagccgagattgaagccggcaccgttgagcatcaggaaggcgcggtcggtcacattgcgcttgcgggtggccagaaagatgaacacgaccgggataaaagcaaacaggaatgcgaataccgaaataagcagcagcgagatgtcatgcggattggtggcgaacgagtatacgatggcaccgggcagcacgatgttgaattccgcggtttgcaacacgcgataatccttctgcccgaacaggccgaaccgcttgaacagatagccggcgagaatgatcagcaacagaccaaccggcgtaagaatggcggacatacacttctctccttgactcacacaggctcatggcgcacaggctcagacccacaatgctgtgaccattatatttgccgccttggcattgccatatgtagaggcgtccgcaagggcttgcaattgcctcacgcatatacgaaaagcctcccggaatcgttggcaatccaatgcttccaagaggctcaagccggtgcgcgagatgggacttgaacccacacgtcaaagacacaggaacctaaatcctgcgcgtctaccaattccgccactcgcgcgtgcatatccgcgtttccacaggtgtggaagatatacaaaaccctaggccggacagccattacagaccagccagcctagggcatccgagccacttgtcagaatcgaactgacgacctgctcattacgagtgagccgctctaccgactgagctaaagtggcttggttcgcggaaggcatttcgccagccgcgcacaagaaattaagtataagacatccccgcgaaaagtccaatcggcggcttggcagttgtgtcgcgaccgctcagtcgaagatgacggttgcgccgcgccatgaactgttcgataatgcaaacgatggcaatccgacatcgctgactcattttgttctgttcatgtccgaatttgtgagtattctgtttggtgatacggagcgcatccgagccgtgagcgaaggcgctccagtcactgatgaaaggaatggaatcctatggccatcaatccgcccgttgacgccacccagacccctgagtgggctgccctgcagaagcactatgacgagctccaggccgaaggcgtgagcctcaagaagtggttcgccgaggacgccgagcgtgtcgacaagctgtccttcgacgccggcgacctgcacttcgatctgtccaagaacctgatcaagccggaaaccctccagctgttcgccaaccttgccaaggccgtcaagctcgatgagcgcaccaaggctatgtacaccggcgtgcacatcaacaacaccgaagaccgcgccgtgctgcacaccgcgctgcgccgcccggtcgaagacgagggcaagtacatcgttgacggccaggacaccgtcaaggacgtgcgcgagacactcgacaagatctacgctttcgctgacgacgtgcgttccggcaagtggaccggtgtgaccggccgcaagatcgagaccgtggtcaacatcggcatcggcggctccgacctgggccccgtcatggtgtacgaagctctgaagccgtacgctgacgctggcatctccgcccgctacatctccaacatcgacccgaacgacctggccgagaagaccaagggcctcgacccggagaccaccctgttcatcatcgtctccaagaccttcaccaccctggagaccctgaccaacgctcgcgaagcccgcacctggctgctcgaagagctcaccgccaacggcgccatcgccgagggcgacgaggctcagaaggccgaggccatcaagaagcacttcgtcgccgtctccaccaacctagagaaggtcgaggagttcggcatcgacccgaacaacgcgttcggcttctggaactgggttggcggccgttactccgtcgattccgccgtcggcacctccctggccgtgatcttcggcccggcccgtttcgaggagttcctgcacggcttccacgagatcgacgagtacttcgccaacaccccgttcgagaagaacgtcgtggtgctgctcggcatgctgaacgtctggtaccgcaacttcttcaaggttgcttcccacgccgtgctgccgtacgaccagtacctgcaccgcttcccggcttacctgcagcagctgaccatggagtccaacggcaagtccgtgcgttgggacggcacccccgtcacctccgagaccggcgagatcttctggggcgagcctggcaccaacggccagcacgccttctaccagctgattcaccagggcacccagctcattccggccgacttcatcgcgttcgtcaacaccccgaacccgaccaaggacggcgaccaggacgtgcacgagctgttcctgggcaactacttcgctcagaccaaggctctggcattcggcaagaccgctgacgaggttcgcgccgagggtactccggaagagatcgttccggcccgcgtgttctccggcaaccgtccgaccacctccatcttcggtgtggctctgaccccgttcgcactcggcgagctcatcgccctgtacgagcacatcaccttcgtggaaggcaccgtctggggcctcgactcctacgaccagtggggcgtcgagctcggcaagcagcttgccaagcagatcaccccggccatctcccaggacgacgacgccctcgccgcccaggacgcctccacccagagcctgatcaagttctaccgcgcaaatcgcgaattctgattcgctttgctcggtcagaattcgtgattcgcgcgaccgcggctgtgctgtctggtgggcagtctggcgactgcccacgtcgcgaattctgattcgcttttctagctcccctcaatactgaggggagctgtcagcgaagctgactgagagggagttatggaacgctccgtatgctccccctcaactatgactgttgccggcggcgaaactactggaataatcaccgtccatcggactctcaccttcttcaagccgtgcgctgaaacgccaaatcaataccatcgtcggtatccatgcgaccagcaggagggacggaaagtattcgaatccgccatccgtgctgcctcggccaaactgatgcgttaataacggagagagacgacgacacgccgatactgtccgcaataatccgtaaaatggtcgattgctgtgtcgagaagtgggccgccgcataagcccacgtctccatgggtccagcccgaacggccgcaaggcctgactttcggcggatcggcaggcttcccaagggcaaactcgagggataacgagaacaggccaacgcgcgcgatgcgtaatcgcgtggatggccccagatctgtggctgatatgcggcagcactgaaggaaaacaatggttaacgctgttgaggcttttgacgccaagcacatgaagccggccgaggaaatcccggccttccgtcccggcgacaccgtcgacgtgaacgtgaagatccaggaaggcaacaactcccgtatccagaccttcaccggcgtggtgatcgctcgtaagggcgctggcgtgcgtgagaccttcgtggtccgcaagatcagcttcggcactggtgtggagcgtcgcttcccggtgcactccccgtccatcgactccatcaagctcgtgcgtaagggccgtgtgcgccgcgccaagctgtactacctgcgcgctctgcgcggtaaggccgctcgtattgccgagcgccgcgacaactctgctaagtgagtcgattcgcgggtgcaatcgtgagcctgatgatgcaggcgcgcgaataaaccgtgaaattcagcccggaaccgtttcggtttcgggctgttttcgtattttccacgtatgatggacgggcgccggcacccctcatatccggcagcatgaatcgcgaggagatggtatgcaggacgatcaggataacggcgaattcccgatttccgacaatccggagagcaaccagacctcgtatgatgacgaggccgatgcccgcgattcccgtacgttccaagtcgccgaccacggcatcgccctgtccccggttcccccggcaccggcgcgcccggcgcacgccgcttcttccgctggcgcgggtgcagccgctggcgcgaatgccgcggcagcatcatcgtcagatgatgaccacttcaccctacgcgactttttcctgtggtgcggcgttcccgtgcttatcgtgctgctgattcgcattttcgccgtcggcttttacgagattccttcgcgctcgatgatggacaccatggtgcccggcgatcgcgtggtgaccagcaagctcacccccaagatcttcgatttgcagcgcggcgacgtcgtggtattcaaagatcccaacaactggttgaacgaggagcagagcagcgctcccggtggcgggtacctcatcaagcgactgatcggcctgcccggtgacgtggtcgaatgcaagggcgcgggccagccggtgaccatcaacggcgtggccatcaatgagacctcctacattcgccccggcgtggacccgagcgccttcccgttctcggtaaccgtgaccgagggccgcgtgttcgtcatgggcgacaatcgcgccaattccgccgactcccgctatcatcaggatgacggcgatcgcggcttggttcccatctccgatgtggtcggagtcggaatcgcgaaatactggccgcttgaccggcttggtgcgattgatgaccaccacgaagtcttcaaggacgtgcctgacgcttccggctcgaattcctgagtctttttttgaaccgtgtgagtctttgaactgattgagttccgggccgtctgaaccctgaaccatatgaatcctggaccgtctgaatcctaaccattgtgagacgatgggagccgcgcatgattaccccgacacttgacttggaacgcagccttgcggcccagggctatgaccttatcgctggattcgatgaagtcggccgcggcgcgctcgccggcccggtgatggtcgggtgcgccgccatttgggcccgtgatttggagccgttggatggcgatgatgccgtcgaactgtccgggcggacctacctcggcgtgccggacggcgtggccgactccaaaatgctcaccgaacataggcgcgaggcgattttcgacgaactgcgcgactggtgcgcggcctacgccgtaggccaggccagcaacaccgagatcgacgaatggggcatcacctacgcgctcggcgtggccgccctgcgcgcgctcagccaagtcgaacgcgaacttggcttacgacttagaggggaatcgacgataaaaaaggcttcgggggagtctgcggggaagattgtggaaggtcgtccgggaggctccgtaggggaatccattggaaattgcgagggaagcgttcgcgctctgcccaaagtcgccggaattctcgacgggccgagcgattacatcaccaaggcgctcaacacgttcgacgcgccggacgtgccgattccagccgacataacgaccaaagtcaaaggcgaccagcattgcgccaccgtcgccaccgcggcggtcatcgccaaagtgacccgagaccggctgatggtcgacctcgcgcaaagcaacccacgttacgccgcctacgaatgggctcataacaagggctatggttccgccgcacaccgtaccgccatcgccgagcacgggccgactccgctccatcgtgtctcatggcacctgacctgagccgcgtgcgacacgacagtgtgagcgctaacgcaaaactgttgtggacgcgctaaagtcagtattgattaaggtacaagcctggccgtgcacggatgccggccgccagcggggaggttaggcaatatggtgaccagccgcaagccaagcaaacgtccgtccatgttcgaagtggccaagctcgccggagtcagccaccaaaccgtctcccgtgtgatcaatgactcgccggacgtttccgacgccacccgtgcgcgagtccagaccgccattgaccaactcggctaccgcccctccaactccgcgcgcgcactggcttcccgccgttcgcgcaccatagggctgatcgccggaggcctcaaattcttcggcccgatttcctccatctcctccatcgaatccatggcccgcgagcacggtctgttcatgagcgtgatgatggtccacgaggccttgtgcgcgcaggccgacttcgacaacctgtgcgacaccttcaacgagcagaacgtcgacgccttcatcttcctgaccccgaccgacgtgatgttcgccgccgcctgccgtgcacgagtcactcagccgcgcgtcatcgtcaccgccacccacggccaaatgaccgtgcgtgagggattgggccttatctccaccgaaaacaagcgtcgcactgcgctggtcggtatcgaccagtggggtgcaatggccaaagtggtggccttgctgggcgaatacgggcacaaatcggctctgtattttgccggtcccaacgaatggcgcgacgcccacacccgactggatgcgtggcgcaagctcgccgcctcccgatccatcgattcacagatcgtgcgctgccatacgtgggatgcctctgaggcatatgcgcacatgaatcatctcattgatgagtatgggcgtcgaggcgcggcgttgcccaccgcggtcgtcgccgcgaacgacaatcaggccgtcggcatcatgcgcgcgttgcatgagcatgggcttcggattccgcaagacatcagcgtggtcggattcgacgacatgtctggcgtggataacatgtacccaccgctgaccaccgtgcatcccgatttcgaggggctcggcgtggccgccatgcgagagacgctgcgcttgctgggggagggcggcgagccgaccttcctgaccacccagcacggcatggggctgattcccgccgaggtgcgtgctcggcggtccttggggccggctcctcggcggtaaattggccctgttatcaaaccgttatgatgcgtgacacggtataagttgtgtcgaatgcaggttatcggtacaatgttttttgggaaattgtgagcgctaacaccctccccaaggaaggggataacaacgccggcgctccaaggcaaaggaaagatatggcagcaaccgacaacgcggccgagcaggtcgcccacatcgccgagaagattcgcgctggcaagaccacgctgggcatcgaattcggctccacccgcatcaaggccgtcctcatcgacgacaacttccagaccatcgcctccggcgactacagctgggcctctcacttggaggatggtctgtggagctacaccaccgaggagatctggggcggtttgcagtccgcttacgcctccatggccaacgacgtcgagaccgtctatggcgagaagctcacgcacgtcggccacatcggcttctccgccatgatgcacggttacctcgcattcgacgaggccggcgaactgctggtgccgttccgcacctggcagaacaccaacacctccgaagctcacaagaagctctccgagctgttccagtacaacatccccgagcgttggtccatcgctcacctgtaccaggccgtgctcaacaaggaagagcacgtctccaaggtggcttacttcaccacactcgccggttacgtgcactggaagctcaccggtaagaaggtcctcggcgtgggcgatgcctccggcatgttcccgattgacccgaccactcacacttacgaaaccgcattcattgagaagttcgacgctctacctgaggtcgcagcccagccgtggaagctggagaacctgcttcctgagccgcttgtggccggcactccggctggcgagctgaccgaggaaggcgccaagctgctcgatccgtccggcgccctgaagcccggcatcgtgctcgccccgcctgagggcgacgccggtactggcatggtggccaccaactccgtgcgcgtacgcactggtaacgtctccgccggcacctccatcttcgccatggtggttctggagcacaagctcaaggccctccaccctgaggttgacttggtcaccaccccggccggcgatctggccggtatgagccacgccaacaacttcacctccgacctcaacgcttgggtcggcctgttcggccagttcgccaaggctatcggccagccggttgacgcaggtatgctgtacggcaccctgttccgcgcggccatcgccgacgacgtggacgccaactgcggcggcctgctgaactacccgttccgttccggcgaattcctggccggtctgcctgaaggtcgcccgctgttcgcccgcagccccgaagccaacatgaccctcggcaacttcatgcgcgcccagctgttctccgcgttctccccggtcaagatcggcatggacgtgatgaccaagcaggagcgcgtgcaggtcgactctctcgtgggccacggcggcatcttcgccactccgaaggtggctcagaagattctcgctgctgccttcaacaccccgatcaaggtcatgtccaccgccgccgaaggtggcgcctggggcatggccgtgctcgccaactacctgtggaacaccaacgaggatcacagcaacctcgctgacttccttgacggttgcgtgttcaaggacgcccagtccaccactgagaagccggtggcttccgatgtggttggtttcgaggacttcttcgcccgcttcaccaagggcctgcccatcgagcacgccgccatcgaaaccatcaacctcgaagataagtaagcctttctgacctccctctattgagggaggtccttgagattttgaaaaaacgtccatccatcacagtggaaaggaaaaccaataatggcaactttggctgattacggccccgaggttcgcgccgaggtcaagcaggttcgtgaggtcgtctccaacctgcaccagcagctgatcaagtggaacctggtcgtgtggaccgcgggcaacgtttcccagcgtctgcacaccgccgacctgttcgtcatcaagccctccggcctgcgctacgagtacctgaccccgtcctccatggtcgtgtgcgaccttgacggcaacgtggtcgacggcaccgaagccccgtcctcggacaccgcttcccacgcctacatctaccgcaacatgcccgacgtctacggtgtcgtgcacacccactccacctacgccaccgcttgggctgccactggtcagaacatcccgtgcggcctgacgatgatgggtgacgagttcggcggcccggtgccggtcggcccgttccgtctgatcggctccgaggcgatcggcaagggtgtcgtcgagaccctcaagaagtacccgaagtccccggccgtcctcatgcagaaccatggccccttcaccatcggcaaggatgctgaaggcgccgtcaaggccgctgccatgaccgaggaagtcgctcacaccatgtgggccgcccgtcagctcggtgacatcatcgagatcgaccaggccgacatcgataagctcaacgaccgctaccagaacgtctacggtcagcactgatttgatggagtgtccgccgcgttacggaaggcccgacgtaccttcgtacgccttcgccttccgcgccttgcggacacacacatcaaatcagcgctgactccgccagcacggtggtgtcttggctcccctctctgaggggagctgtcagcgatagctgactgaggggagcctcggtcggcgaatgaaacttaaacaaacccccataaacaaagaagtaaaggaagtaaccctatggttatggaaaatcccttcgagggcaaggaaatctggttcggcgttggttcgcaggacctgtacggcgaagaagccctgcgccaggtcgccattcactccgctgaaatggtcgactacctgaacaacaccggcaagattccggccaagatcgtcctcaagcccaccctgaagtcctccgacggtgtcaaggagttcatggtcgaggcttccgccaacccgaacgtcatcggcgtcatcacctggtgccacaccttctccccggccaagatgtggattcgcggcctcgaagtgctgaccaagccgctgctgcagctggccacccagcaccacaaggaaatcccgtgggagaccatcgacatggacttcatgaacctgaaccaggccgcccacggcgaccgtgagttcggttacatcgtctcccgcctcggcatcaagcgcaaggttgtcgtcggccactacaccgatcccgaggtcgccgagaagctcggcacctgggcccgcgcctgcgccggctgggatgcctccaacaacatgaaggtcatgcgctggggcgacaacatgcgtaacgtcgccgtcaccgagggcgacaagaccgaggctgagcgcgtgttcggcgcctccatcaacacttgggccgtcaacgagctcgtcgctgcgtacgacgccgtcaaggacgaccaggtcaaggagatcatcgaggactacaaggccaagtacgacgtcgacccggctctgctggacgccaagtacgactccctgttcatcgccgccaaggaagaggccgcgatggtcaacatgatgcgcgccaacggctgcaccgccggcgtcgacaacttcgaggacctcggcgctctgccgcagctgccgggcgttggcccgcagcgcttcccgtccgagtacggctggggcttctccgctgaaggcgactggaagaccgccgtcctcgtgcgcatcggtgccgtcatgggctacggccttgagggtggcgcctccctcatggaggactactcctacaacttcaccgagggtgacgagctcgacatgggctcccacatgctcgaggtttccccgtccatcggcaccatcgccaagccgaagctggagatccacccgctgggcatcggcggcaaggccgacccggtccgcctggtcttctccggcaagcccgccaaggacgccgtcgtggtctccatgtccgacgttcgcgaacgcttccgcctgctcatggacgtcgtcgacgtcgttgagccgcagggctccctcaaggagcttccgtgcgcccgcgccgtctgggagccgaagccgagcctgaagaccgctgttgagtgctggatcaccgccggtggttctcaccacacctgcatgaccacctccgttggtcgtgaggcttgggaagacttcgcccgcatcgccggtgttgagctcgccgtcatcgacgagaacaccaccgctcgccagttcgagaaggaactggagctgtccgagatgtaccaccgtctcaacaaccagcactgattggcggagcgtataccgcctttcctcaggttcgacgtaccttcgtacgccttcgccttcggacggcggtctccgcacgcgccaatcagcgctggcaagccagcactgatgactaaatcagtctgctgactgctaccgctgaaaaggggctgttccgggaaaccggagcagccccttttgctgttatcggcaactccccacaaacgcatcaaaaatcgcctgcgagcgtggatctaccttgtagagaaactcgggatgccactgcacggcccacaggaagtggcttgccggccggtacagggcctcgatcacgccgtcgggcgcgacggccatgacctcgagtccagcagcaggctcacgaaccgcctgatggtgatagctattcaccgcaatctcagtctgccctgcgaacaatgaagccaggggagtgccgggcaccaaggaaacgttatgtccgaacgcatcgtacggcggattcatatggtgttcgatatcgctcggatgctggcttggcagatcctgccacaacgtgccgcgcagcgctgcgttgatgaactgaatgccacggcagatgcccagaatcggcttgtcccaagccattacagctggcagcagaatcgattccattcggtcgcgctcaggagagagcacctcgctacggccggtggcggaggccgctgcaccaaccatcggtcccacatccggcccgcccgtaaacagaaacgcgtcaaaccgttcggcgcattgcgcaagaatgtcggtgtcatcggtcagcggcaacatgacgggcgtaccgccggcccgcattatcgcctccatatatccgggcagcatccacagactatcgcgcccgtaatccatcagcggagtcaccgcaatgagcggtcgattcgtagtcatgcctgcctcttttcgcccaagtgttgttttcgtcgttctgccgcaaatcgcttgattcagtggccaataatgccgccactgtaccgaaccaatgtaaccggtcggccaacattatttcgtcagccagccgcgacgagatcgcacaatgtgccaatgatgggggcattcggtgcgaccttgtcaatgttcgggccattgcactttcagcggggaaagcatgccccgtccgcgcatcatgatgaacgagtaaggttgacggggagggagaatcacatgaaccaggcatgcgtacgcaacgacaccatcgacgcgggcaaccatcatggccgaccgcaataccggtcgttcctgcgatttctgacatcgcaggaacgcaacgtcatttggctgttgctggccattgcttttcttccggtggacggcaccacgcttggcctgtacgcgccgttctggtctccaatcagtccggcgctgttcgccgtgtactgcctatgcaattggcggcaactgcgcatcgcagccaaccggtacctgccaatgttcctcctaccggtggcctgcataatcctgtccatcccgggatggctgaagttcggcatccacctcaacgccgcgttcatgagcatcaccggattgctgggcgtgctcgccactttgggtgcgatcgcccttgcgttcgacatcaaacgcattccgtggcgtacgccattgcggattctcatcgcatcatactgggtttccttcggagtgggcgtcgtgcaatggctgtccatccgtctgcacgccaaaccgttgaccgactatttctcgcacctcatgtaccggcaatacatcagcgacaactcggtgtggggcggcggccgtccgcagttcctgttcgccgagcccagctatatcggcatgcacctgttcggcatactgcttccgctcatgtggctcatgcgcgggcgcgaccgcatctacgccaaacggctgcgtgacctcatcgtcacgtatgccgtcggcgcggtgctcatgcaagccggcaccagaatcgtcatcgattccgtcgtggcgttgctgatcgcccttgtggcgcgcaccgattggcatgacggcgcacgccgcgtccggggcatgctgcagattctcggcgcatgcgcactgggcctgctgggtgtgctggcggattccagactctccgccatcgcggaaaacggggccgagggagacggctcgttcttcgcgcggatctaccaaagcctcgatccgatatgcggattgctcacccatccgtggacgctgctcaccggttatggcgcgggcaacatcatcaatgcggtgtgggccggcgcggccaaagccggacggctgctggacggtcttggcatgaacggcggcgcggccacgggattcgcggccggcgtgaacgcggacacggtgtggacgatgtgcgcgtataccagcgtcatcgccgaatacgggctgatcgggctggccatgctggtcggagcctcgatggtctgcatgacgcgcgggaggacggtatgccgtggcggtgcggatggcgcatcgtccgacgagctggcgcacggtgtttgtgtcgccgacgttgccgacgttgctgatgttgccgggggtaatagtggtggcggcgttgccggcgcgggttcgggcgaatccggcgtctggcacaagaccgtcatctgctggctcgtcctggtcgcatacctgtacatccaatgcgagaactatgcgttcgccgctctgccgcttcttgtgttcgccgcctcgaaggtgaggcgcgagcctgatttctcgcgggccgacgcatcgacgcggcccgagatggaccaaaatccagaataaccgacattcgccgctgttccgtttttcgctcaaggcgtatatctcccgtatcttgaggtgcatcatgtatcgtcgcggctaactaatcggcgaaacgcggcatgtttcgcattttgggcgaaaagcccaagtcccacaggaggtattgatgacgttcgttgcacggtcggtgcgctatgtgctcagaaaacgagtgcgaaccatagtgctccttataatactgaccatcataacggcgagcatgctatccacgatcgcggtttctcgggcagctcaacaggccgccggacgaatcgagaaggaagcggtcggtggattcgtgctgtccagcaacatgcagggcagcatgctcacgcctcgcggaggcggcatggtgcgccccgccgacgtgcgcaggatcgcccaactgcccggggtcgattcgtatatggtccgtcagaacgccaccgccgatctcgtgggggcgaatgtggcgaaggtccccggcggcgatgattacgatgcgacccaggagcagcagtttggcaacgccgccaacgtcatgggcacgaatgattcgtcgaaactcaacgtgttcacgtcgcgcacgctcggcatggccgaaggacgacatctgaaggcctccgacaagtacacgtcgatgatccatgaggatctcgccaaagccaacgggctcaaagtcggagacacgctcacgctcaaggccaacgcctatgacgccgacaacgaatcacattcgacggcgaccgtcaagaccaccatcgtgggcatattcaagggcgacagcgccagaaaggtatccagccgagcggaactcaccgccaacaccatctacaccgatctggataccacacgcgacctgtaccagtacaaggacggcaaggaaatataccaggacgccaccttcgtgctgtccaagggcgttgacgtggagaagaccatggatgccgcgaagaaactcccggtggattggaacaactatcagatcacgcgcaacgaccagtattcatcgagcatgctgcatgccgcccgcggcgtgcgctccatgatgcgcggcgccctgatcggcgtgaccgtctcggccgtgctcgtgctcagtctcatgctgctgctgtggatgaacgaccgccgtcaagagatgggcatactggtgtcccttggcgtcggcaagccctccctggtcgcccaatacctcaccgagatggtgctgatcggtctgccgtccctcgccctcggctggctgtgcgcgcagggaatggcccaatggctcggcgccacggcgctccattccgtgaacgcctccgcggcgaaggagctgagcagcatggggcaggtcggcggcgatcttgaatccagcatgtcggtgcgcaccctggattcgctcacggtgtcggtcgacgggaccgccatgctgtacgtggcgctcggattgttggcggtgatgctggtgtgcgtcgcggtggcgtgcatgccgatgctgcgcaaatcgccgcgagacctgtcggagattcgatgatgagcatgaatgtgtggaagcgtgccacgttggcgatcgtacgcaagccggtacgtagcggcatcatcggtctgctgatgctgatggtcttcacgagcctggtggcgcaggtcggagtctcgacggccctgcgtaccatgtccgacggcatcggcgcgggcatgggcatagggtttaccgtcagcgccggcgagaatcccattagcgccgaggaggcgagccggttctcgcgtatccccggtgtgacgaagaccgcctatgcgacgaagaccttggcgcaggtggatggcgcgcgcccggtcatgccccggcagggcccccgattggactccgatctggccatgcaggtcagcgtgctgggcaccaccgattcctcattgtccgaggaattccagagcggcctgtaccgcctggagcagggccgccatatctcgggcgacggcgacaatgtgctggtccaccgcgacttcgcgatgcagaacggcctatcggtcggctcgacattccgtctccggcaggaggggcgcaacgccacggtgcgtgtggccgggatcttctccggcaacgtgcaggcccaaagccccctgccctcggacacttccgagaacctcatctattcgggtaggcgagtagcttccgctctgaccggaaacgaccggatcgacatgatccgatgcctgtcggataatccgcaggacctgtccgcggctattggacgggccaagaccatggccggcggcaagtacgacgtcaccgacgattcggcccggctctccggcgtcctgcaatccgtgcagacggtgcgtaatctggtgcgcatggtgctgctgtccgtctgcctcgcggacgtactggtgctggcgatggcgctggtcttctggattcgctcacgcatccatgagataggcacgcttctggccctcggcatcgacaagatgcggatcgtcgcacaactcgccatcgaaaccggactcatggcggcggtcgccgccctgtgttcgctgggcaccggcgccatgctgtcgggatacgtgtcttcccgactgttgcgcgattcgggcgtcgcgccgttggaatcgttgcacgtggaggccttgccgcctgagcagacgatgctcatcctgctgctcggatgcgcggtcatcgccgtggctcttgccgtgtcatgcgccgccgtgctgtccaaatccccgaaatccattctttcctctatgcgttaggagtcaccaatcatgtctaactgtctgcaactggaccatgtcgattacgcctacggcgcggcgaagatccgtgttctttcggatgtcagcgcggatttcgaatccgggaagatgtatgcgatcaccggcccgtccggcgccggcaagagcacgctgctgtcgctgctggccggcctggacgccccctcccggggagtggtccgcttcgaaggggaggacatcgccgcatcgggctatgcgaagcaccgccgggagcacgtgtccctggtgttccaggaccataacctgatcgactacctcacccccgaagagaacctgcggctggtcagcgccaaggccgatatgaagatcctcgaggaactgggtttgagccgtgaggaatccaagcgcaacatcatgcacctgtcgggcggccagcgtcaacgggtggcggtcggccgcgcgctggtcgccccgggccgcgcgatcctcgcggacgagccgacgggcagcctcgacccggagatgaccgacgaggtgattcatctgctgcagcacgccgcccatcagctcggcaaatgcgtgatcgtggtgacgcattccaagcgcgtcgccaactccgccgatgtcgtgctgcgtctcaggagcaagaaactgacccgggcatgacccacctgggccgggcggcaccccggcgacgacccgcatggaatcatcgtcataatgacgcctgcgatccctggacatgagaaaccgcacctccgatcatcgaatctggattactccagtccaacaatcggggtgcggttcaaaaggccctttttttgtgtcggattacgaaccgcgcgtctcaccgcttgccgttgtagatctcgttgtcgatcacatcggcgaacacgcgattgacggccgggcgcaccactttcagcgacggtgtcaggcacttgttctcctgcgtgaactgcgtgtccagcacggcgaacttgcgtacggattcggcgcgcgagaccgtcgcattcgccttgtccacgtactgctgaatctcctcgcgcaccgcggcgttcgtggcgagccggtcgaccggcgtctccgtggacaggccgtgcgcgggcagccacaatgccagcgactccggatcgagcgtcaccaacgcgccgatgaacgggcgctggtcgcccaccaccacgcagtgctccacgatcgggcacttggcgatctcttcctccagcggaatgggggagacgttcttgccgccggcagtaataataatgtccttgatgcggccggtgatgacgatgtggccctcatcatcgatctcggccaagtcgccggtcctgagccagccgtcggcggtgaacgcctcagccgtcttctccggcagattgtggtagccgcggaacacgttcgggcccttgacctgcagttcgccttcgtcggaaatgcgaatcgaggagccgggcgcgggctggcctacggtgccgatcacattgtcggtcacgcgcgtggcggcgaacggggcggcggtttcggtcatgccataaccctgaatcatcggcagtccgatgccgttgtagaaatgcgccagatcgagcgacagtggtgcgccgccgcaggccacgtacttgatcttcgggcccagagcaccgcgcaccgtgcggtagacgagcgtttcgtacttggcgcgctcggcgatttcggcaaacgtgtgctgctcgccggcctgctccttgcggctccagacgcgcgcggcctcggcggccttgacaaacaggcggcccttccagccggcaccggccttgtgcgaggcggcgttgtataccttctcgaacacgcgcggcacgcccagcaggtaggtcggttcaaacgaacgcaggtccggcagcagggttttggtgtccggcagataaccgaccacgccgtcatcggaggcgatggaggcgtactggatgaatcgcgcgaagcagtgggccagcggcaggaagagcagcaggcgcggatggtcgtcaagcaccacttcatgcaacgcctgcgaggcggagatggtgatggacacgaagttcttgtgggtcagttcggcacccttcgggttgccggtggagcccgaagtgtagacgatggtggccagatcgtcggcgcgcacggtggccacgcgctcgttcagttcctcgtccgaaacagccacgcccagaccttcgagcgcgcccagcgcgttgccctcgatcatgagaatctgcttcaaggcaggacagtggtccttgaccgagtcaagccggtcgaagcgctcgcggttgtcggcaaaggccagcttgaccgccgaatcgttcatgatgcgctgggcttgcggggcggagtcggtgtcgtagatcggcacgcttaccgcgcccactgcggccagtgcgaaatcgagaatgccccattcgagacgggtggaggaaaagatggtcaccgcgtcgcccttggcgatgccgagcgcgatcaggcccttggcggctgagaccacgcgctcgtggaattcgccggtggtgacgttctgccagcggccggggccgattttcttggcggcgattaccgtgtccgcgccggtgcgggccagtcgttcggtgagcagtgaatagatagtttggtcatcgcggatctcgatggattcgccgggcgtggtgtattcggtaagcatacggccgtttattccttacaaacatgatggcaagttgacaacccgagccattctgacgagttagattacgctggcgtaaggttgcgcgcgttgtgggcaatggagaagttgtctgtctggttttgtggattgtatacaacgccgtgtctaaccgatttgctctacggttatgaccgtgtccatttcgggagccatcgacttcctgcaggacaagtacgtgctgagcccggccctgcagggtccggtcatcagctccagcatcatcggcggcgtcggcattggggagtctgtggcttcttatttgggaacgaagctcagcgtgacagtcgtctcagctgaaggtctggcgtgtatgtgcgctttcgcctaaggtaaataggattgcgcagtgcacgccatcggtatgtgcaggtatgcgattggtggcacccgcgactgatgcatgacgagacctactgcagtaccacggcaaccaacaccgcaacaacacggcaaggggaagcgaaccatgttcgacaaacgactgttccaattggcaccaggtctcggcaagctcatagccggcaaagtggctctgatgtgggttgggctgcttgccaatatcggcttcatgctttcgctggtcatgctgctgcaaggactgctcgccgcagccgacccacacactttctcctgtaacgccgcctcggcctccgagtgccccgccaatctgttcggcgttccgggcaccaccgtcgccccgatggccggcgacctcatggtttacgtggccttggcgatcgtctgcatgctggttcgctacctggccaccacacacgccacacgcctcggcaccgaagccgccgaacgggtcaagctcgctttgcgttccaagctgtaccgcaaaatggtggccctcggcccgtcctacaggtcgcgcgtcaagacctcggatgtggtccagtccgccggcgaaggcgtcgagcagattcaaagcttcttcgaactgttcctgccgcagctcttctatgcgattcttgcgccgatcaccctgttcgccgtgattgcgccgatcaacatgccggccgccgtgaccatgctcgtctgcgcgccgctcattattattgtcaccggcatcgtatccatgaccgccgcccgcgccttcaaaaaatactggggccgatacaccgacatgggtgccgcattcctcgacaacctgcaaggcctcgaaaccctgaagaacttcgacgccgacgaccgtgccgccgccgaaatggacaagaaggccgaaggcttccgcgtcatgaccatgcgcgtgctgcagatccagctgcgctcgctgaccgccatggatatcgtggcctacggcggtgcggcggccggcattggtgtggctctatggcagtatgcgcataccgccgcggccgccgcaggagccagcgccgccggctggtctccgattatgctcgccgcccacctgcccggtgcgttcgcctacctggcctacggcctgcaatacctgatgccgttcggtgcgggcttcccgctcaccctcgccggactgttgctgatcgtgctgctgtccgctgaattcttcatccccatgcgccagctcggctcctacttccacgtggcgatgaacggcatgacctccaccaagcgcatcttcgccctgctggacacccccgagcccgcccacggcactgccacgctgccggccaccgctggtaccgatgccgggactgatgccggtaccaaggccggtaccaaggccgatggcggaatcaccgtcagcttcgaccacgtcggctattcctatgacagcgccgattccggtgccgccgttcaacaaacgaattccgcgccggcacctgcgctcaccgacctcaccttcactgcctaccccggtcaactcaccgccatcgtcggcatctccggttccggcaaatccacggctgccgcgctgcttgccggtacgctgaccggataccaaggctcgcttacgctgaacggcgtcaaggtatccgacctgtccggagagacgctcgcccgaaccatcaccctgatcggtgccagtagccatctgtttgccggtactctgcgtgagaaccttctgatggctttgcccgatgacggccagaacggtgaagccgcgtccgacgccgtggattcccgtctctgggacgcgctcgaacaggcccgtatcgccgacttcgtgcgttcgcagccggacggccttgacatgacgattgagcccgacgccgccaacctgtccggtggccagcgccagcgtatcgccatcgcccgtgcgcttctgcatgattcgccggtattcgtattcgacgaggccaccagcagtgtggatgtggaatccgaggaactgattctcgcgaccatccgcgaactggtgcaatcccgcagcaagacggtgatcatgatcacccatcgcatggccaacgccgagcacgccgaccaagtggtggtgctcgaacacggcaagtcggtggaaaccggcacgcatgccgaactcatggcggccggcggcgtgtacgccaagttgttcactactcaggcggatatcgagaactttggggctgaccaccctcagccagcttcgctgacagcttccgccagcgggagcggggcggctgtgggcgcagctccggctgcagctccggccgagatgagcacgttccaggtcatcaagcgactactcggggaggccaagccactggccgggcttatggtcgcggcttccacggccggcaccatcggtcaccttgccgcaaccttcctaccggtgttcggcatcatcgccggattcgcgctcgccggcaaccccgtgtggggcatgagtgcggccggtgcaatcaccgccatgattgtttgcgcggtgttgcgcggcctgacgcgctacgttgagcaatatctgaaccacaacgtggccttccacctgctcgcgctcttccgctccaaggctttcgccgcccttcgccgcctcgctccggccaagctcgccggcaagggcaagggcgacctcatcgccatgctcaccaccgacgtggaactgctcgaaatcttcttcgcgcataccatcagccccgtggccatagccgtgaccaccaccatcgtctacgccatcgtggcggccacgctgagcccctggatggcgttggcgctgatcgtctcccatctgatcatcggcatcattgtgccgcgcttcttcgccaccggcgtgcgcaatctgggccccgccatccgtggcgcggccggcgaactcgacaacgtgatgctcgacgacatgcgcggtctcgacgagatcatccgattcggtcggggtgaagatcgtgcgcaggccatcgaagaccgcacgcgcgcgctatggcgtgaccatgccaaactcagccgtgtcaacggccggttcgccggtgtcggcggattgctggttgcattgcttacctcggcggctgccggcatcgccatcaatcttgccggcgtgaacctctacgatatcccggcgctggtcgccgccttcgcgctgctcgccagctcgttcgggccgacgctggcgctcgccgccctgcccgcgaacctcacccagaccttcgcctccgcccgtcgtctgttcggtctgatggacgaagcgccggccgtggtggaaactggcactgcgaactcggattatgagggcatgcgccttgaccgcgtcatcttcgcgtacccgggggaggagagcgaggcgattctcgccgacttctcgctcgatgtgccgcagcacggcatcctcggtatccaaggcccgtccggccggggcaagtccactatgctgaagctgctgatgcgctattgggatccgcagcgcggccaagtgacgctgtccggcacgccgctaccgcaaatcgatgtgcatgcccgccgccgtattcaggccatgatgagtcaggagacccacctgttcgacggcatgattcgcgataacctgcttatcgccttgcccgaggcagagattcgcgatgggggagcggccggtgttcttgacgcccgactccgcgaagccctcgccaaggcatccgtgctcgacctgatcgattccctgccggatgggctcgacacccaggtgggcgagctgggcgaccgactgtctgaaggcgaacgccagcgcatcggcttggcccgtgtattcctgcgcaatgccgacttggtgctcttcgacgagccgaccagtcgtctggatgccttgaatgaagccatcattctgcgttccattcatgagctgtccaagagcgagcagaatgcggataaggggcaagacgtggctgtggtgctggtctctcaccgtgaatccgccatgcgcgttgccgatgcggtgctgaatctgtaaagtcgcacagtcacaggccgcaatactctgcaatacaggatttccttatatatcagcctctgataagggcatccagagagtcgagggccgcgtcgatggcctgagcctcgcggtcgtcatccgtctcggcgaaggaatgctcgctgtaggaatcctcgtcggcactgggcaacaacactccgcgaggcgtatcggcactgtgcgcgtgctcaatagaggccatatgtgccggctgcacggcatttgtctgcttgcggtttcgattcgcgtcattcgcggaatcaacggcatctgcggcatcaacgctatctgtatcatccgcaccactgcgcgtagtcggccgattcgccagcgtgaatggatcgtcgggcagtgaatcggccaaggccgcgactgctgcgctggccgctgcctcggccgccgcgccgtccagcatcgcaccatccgcagagtcagtcacggagccatccacagagccatccgcagggccgttcgcagagccgtccgtatactcaccgtcgtgccgtctactggatgacttaccaaccagaacagcgcccctcgtacgccgcataagcgacggcacgttctcatccgtcgtaacttccgagacggtcgctgccgtgtcttcttctgcagccatattcgccgctgccttggcggcttcctcggcagcgcgctgcgcctccagccgttctgcctcgacccttttggcggtctctatggcgaaaatcttctgctgtgccgcagcgcgagcccgctcagccgcatccataatgcccaatgcctgctgacgttcgttttcaatacgacgcagcgtggcttccgcgtggcggatattcgcatcagccgtgctcagcgcgtattttgcgtaggccaaatcggttttcggctgccatagatgctcgatttcctccagcgtgcgtcccattgtctccggcaccaacgccacgatgccgaacaggcaaatcagatccagaaccgcgaaaatcgcgaacgatatgccgccgcccaatccatcgatcatcatcggcgtgaattgtgcgatgatccagttggcgaacagcagacacatcacacacaatccggtggcgcgaccgcgcagatacgtggggaagagctcgggaatcacaatccagggaatcggtcccatcgaaaaggcgaacgatatggtgaacgccatgacgaatataagcgtcagcagcgaattgcccatgaaatacgagcccgaaatgcatagcgcgaacacgcacatcatgccggtgcctatttccataagacgtttacggccgaacgtgtcgatcaggtacatgcctaccacggtggccaccagctccatgccgcctacgctggcggccgcgaggaactgagtgtccccggcgaacccgagatccgagaacatcaccggcccatagtaggaaatggcgttcatgccgatgaactggttgaacacggcgagaaagatgccgatgacgagtgcccgtcgcaggcctggacggaacaaatcatggaattcgtgcgacatctcggtttccagtttgaccgaggcttggatgtcatcggtgcgcaggcgtgcgcgttcggtgccgaggatgtgctcgagcaccgcgaaaccttcatcggttctgcctatctgaatgaggaatcgtgggctttccggtgccctccgcatagccagcaggaaggtggcggccggaatcgcgcctaatcccagcatccagcgccatccagtggcgatatcccagtcgtttgatccgtgggaggcgatgatgtagttgatgacgttggtcaggaagataccgcaaaccgcaagcagctgataagagaaggcgagcagaccacggatgttggccggagccgattcggtgatgtatgtgacggccagcgcggcggtcaggccgatgccgtagccgccggccacgcgcgccacgataagcgctatgggacctatcgtcagcgcactccatacagccgcaacgaggaagaacgcgccgccgataataaggatacgtttcctgccgaatcggtcggaaaggaatccggcggtggccgctccgatgacggcaccgagcatgatggaggaaacgacgaggccctccatgagagtactgagcccgtatctggcgcgcaggaattcgatggcaccggagatggagacggtgtcgtagccgtacagtaatccggcaagacccgcactcaaagccagtccgaatgtatattttcctgatccgcgggtgcgtatggctgttcctaaaggattgggctgcttggaagcagtccgaaacagtcccgccatgtgctcttcctctcaatacagctatggtggtgcctattcatactagccgaactggctccgtctggcgctggacatccacgaatgtgaacgctctcggaattgtggatgtcggaggctgaagattcttctgtgtgcccgaggtggcgagttttggcgggaaatcaggcgtgtcgcttgattttgacaaattggtacacgggtgtatcatcatagatattggtacacgggtgtaccaaagaaaacaccccaaaaaagaccgtcagcggagcatatcgcaggcgaggaacccaggcccaaggtaagtccaaagtcccgaagccacgaccaatcccaacggctcaggaggagataacatgcgcaacaccaagaaggtcatcgcagcaacggccgccgccagcaacatagcatcggccatgagccggtacaataaaggacttgattgatatgactactcgtagaacgttcaggtggccgtccctgctgactgaatccggtcgtggcatcgcgttcggcggcgactacaatccggaccagtggcccgaggagacactggacgaggacattcgcctgatggtccaagccggcgtcaacaccgtggccctcgccatcttcagctgggacaagatcgaaccgcgcgagggcgagttcacgttcgagtggcttgaccacgtgatcgacaagctcggcgcggcgagcatcgccgtggacctggcatcggccactgccacggccccgttgtggctgtacgagcgtcatcctgaggtgctgccaatcgatcggtacggccatgtggtcaatgcgggctcacgccagtcgtggcagcccacaagcccggtgctcaaggaatacgcgctgcgcctgtgccgcaaacttgccgaacactacaaggacaatccatacgtgacggcctggcacatgggcaacgaatacggctggaacaaccgctacgactactccgacaacgccttggccgcgttccgcacgtggtgcgaggccaaatacgggaccgtcgacgcgttgaacgaagcgtggggcacggccttctggtcccagcacgtgaacagcttcgacgaggtgttgctgcctcgccacatgggcggcgacagcatggtcaacccgccccagcagttggattacgagcggttcggcaacgacatgctgctcgacttctacaaggccgaacgcgacgccatcgaagaaatctgccccggcaagccgttcaccacgaacttcatggtctccaccgaccaatgcaccatggactacgcgcaatgggcaaacgaagtggacttcgtgtccaacgatcactacttccatgagggcgaatcccatctggacgaactcgcctgctcggacgcgctcatggactcgctcgcgctcggcaagccgtggtacgtgatggagcactccacctccgccgtccaatggaagccgcttaacacgcgcaagcgcgccggcgagctcatgcgcgactccttggcccacgtggccatgggtgccgacgccatcaacttcttccaatggagacaatccgcatcgggtgccgaggcgttccactccgcgatggtgccccacgcgggctccgatacgaaactgtttcgaggagtgtgcgaactcggcgccgcgctgaagacgctgtccgacgcgggtgtgcaagacacggaactgaagcgcgcggacacggcgattctgtttagtgcggaatccgaatgggccactcgctccgagaccctgcccagcatgaaactcaatcactggcatgacgtacgcgactggtatcgcggatatctcgatgccggagcgcgcgcggacgtggtcccgctcgcctacgattggagcggctaccagactatcgtgctgcccaccgtgatcgccctgtccgacgaggatacccgtcgcatcgcggactttgccgaaaacggcggtacggtcatcgtcggctatgccaccggcctgatcgacgaacacttccacatcggtctcggcggataccccggcgccggcaacggacttctgcgcgacatgctcggcatccgctccgaagaattcaacatcctcggagaagaagccgaagacgaaccggccgaaatcggtttgtcgaatggactcacgacacgtctgtggcagaatgacgtgacctcggtcgctccagacactcgcgtgcttgccacgtacgtgggtacagccgctgctgactgggagctcgacggcgtccccgccatcaccagtcacccccacggccaaggcgccgccatctacgtgggctgcgatcttggccgccacgacatcacccacttgctcaaggaactcaacacaacagccccctccgacgaaagggctcccgaccaaaggccgggtgggggagagatcaacgccgcaactacgaccgcagcagccacgactcatgacccccgcatcctgcacaccatccgccaatcctcagacggtaccatccgcttcgatttctatctgaaccgttcgaagcagcccgttgccgtcaacggtgtggaaggtgatcccatcatcgcccaccgttgcgagactgacgccgttggatatacgctgaaccgcaacgccattcttatcgctaaaacgtcctgctaaaccgcgctagaatggcaatgttgtccggatagaggagtgtggcatgagcgacgagaaaacagccaagcgtcgagtgacgctacgcgatgtcgctcaggccgccggtgtatcgctcaaaactgcgtcgaacgtgatcaatggctccgggcgtatgaccgatgaaacccgtgcaaaggttgaaacagtcattaaggacctcggctaccgagtcaacgtggccgcccgtaacctcaaccgcgatcacaccggtttcatcacccttgccgtgccttcgctgattccgccatatctggccgagttggccaaccgcaccatcgaggccgcccgtcagcgcgactactccgtatacgtcaccacgtatgcagagggctcggccaaaggagcgcgtgacctgctcaagaacttcaactccaccgtgtcagacggcatgattctctccatgagcgaggtggaggatatttcgcccgaagacctgaaggtcgatttcccgctggttattgtcggtgcccgaaccacatggggtgttgccgaccacgtgactccggacgatgttgccgccgcagcaacagcggcaggctacctatacgatcgaggttcttctcgcctcgctgtagtgggcgcacgagacgactataacgcggccgctttgttgcaggctgtggaaggcaacgcacaactgcgtttgcgtggtgtcattgaagaaacgcgccgccgtgggcttgagctggatcctcatctgattggcaacaccgatcaggattggaccatcggcgctggcgctcgcgtgactcagcgactgattgattccggcgtgccattcgacggtgtgatcgcactgaacgatcagttggccatcggcgcattgaccgctctgcgcaccgctggttatgaggtgcccgcgcaggtgcaggtcatcggcttcgacaacaacgaggaagccccctacctgcagattccgctgaccaccatggattcccgccttgactggacagctcccacggcagtgaatcgcatcctcggacgcatcgatggcagcatcaccaaacccgaactgctcaccaccgaatcccaagtcatcgcccgcgcctccacacgctgacgctaatctggctcccctccctggggggagctgtcaccgaaggtgactgaggggagccttgcggaacattgtcatctcccgtcgtaactcgtaattgtcactcgtttgagtggccccatgtgtcatcggaggtagccgttcactccgctccgagttcgtgcatctctctcccccccacgataagagacgccgttggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgccgttcaatcgtttagtgactttttgttaatttctgtgcttaagtagcaactttatgtgtgttttctctacgatctggtgtatattattttttggtttaccggtgtattgcacgcgcgatgtgtgaattgccgcaacatcgctgatatgcgtacatggaatctggaggaatgtatctgatgacggcatcaactgaatcgtctacgcaatcccatcatgatgagaaagaggccattgctcccgcgcgacttgtggcctacgcgctcggcaacttcggccagtcggcgttctacaacgcgctaagcacctacttcgtggtctatgtgaccaactcgctgttctccggagtggacaaggccgtggcgggcaagctcatcggcatcatcacctcgctgatcgtgatcattcgtatcgcggaaatcttcgtggacccgctgctgggcaacctggtggataacaccaccaccaaactcgggcgattccgcccttggcagctcatcggcggtctggtgtccgccgtgctgatcgtcatggtctacactggcctgttcggcttggtcaacgtcaacaccacgctgttcatcgtcctgttcgtggtggtgttcgtggtgctcgatgtgttctactccctgcgcgatatctcctactggggaatgatcccctccatctcttccgactcccatcagcgcggcatctacaccgcagccggcaccttcaccggatcgctcgggtacaacggtctgactatcgccgtgatgcccatcgtcaccttcttcagcttcgatgccggccagcagaaccagaatggttggaccgcgttcatcatcatcgtggccctgctcggcgctctcacggctctgagtgtagtgttcggtgtcaaggaaaaacagagcacgctgcgcaccaaggcccaggagaacggtaacccgattgaagcgttccgcgccctgattcacaacgaccagctcatgtggaccgctttgtcttatgtgttctacgccgtcgccaacgtggccaccggtggcgtgatggtctacctgttcaaatacgtgattggtcgcatggaccttttcccggtcaccggcgtcatccctattgcgtgcggtctgattatgtcggtactgttcccggtcatcactaggtgggtgccccgccgttatctgttcctcatcggcatgtccgtgatggtcgtggcctacctgctgctgattgtcgcctccacgaatataccgctgctgctggtggcactagtgctgttctacctgccgcagacccagattcagatgaccgtgatcgtgtgccttgaggactccattgaatacggccagctgaaaacaggcaaacgcaacgaagccgtgacgctgtccgtgcgtccgatgctcgacaagatcgccggcgcattctccaacggcttcgtcggcttcgtggccgtggccgccggcatgatcggttccgccaccgccgccgacatgacggccaaggacatcaccatcttcaagaccttcgccttcatgattccgctggtgtgcattgtgcttggcctgattgtgttcgcgattttcgtgaagatcgacgaaaaggcccatgcgcgtctggtcgccaagctcactgagaatcttgcgacggctggcgatggtggtggtaacgacgatggtgttggtgttggtgttggtgacaatggtgagcataatggtggccacgccagcatcgcgtcggaagattccgcattggcggaatacggtcccgaactcgccaagcgggtgttgctcggcaaatagtgttgctgtgcgaatgagctgtttcatggggtggtgattggcccatggggcggtgaattcctcatggggcggtggctgaaaatggctttattctgcggaaggtaaaattttaccgaccgccccatgggcaagttaccgccccatgggattttcgccgccccatggatgtacgggtaaaggcggccgaattgcctcgtgccgcccccgtggatatgcaagttaaagagcatcggcagcatgactgaatgcacatagagcgtcccccgcatggttgtgccacgttccatggcggggtcgccgtggtgactgtcgccagtacacgccatgccacgcgagcacgttgttgccggtgttccatggcggaaacgtcgtgggcatacaccttggatgatggcgacgacgattccaacacagtacccagtaaagtaaccgccgataacctcaagaaatacgacatcagcccgcaaggccaggccgatgagattcgcatggtcgccgaggccgtgaacaatatcggcgacaacgatggcgatggcgataagaccaacggtgcgaatggcaacaaggctactggcgtgctgagcaagaccggtagcgcggtgactgccgtgggtcttgcggtcgtcgttctcggtgcagccggcggggtctcgtttgctttgcgtcgtaagcgctcctgataaggactgactcggcattatgatgcggttgccagttgctggctgtcggctgtcgtctgccagatgcggctgtctcggcgtagcgatgcgattctgtcccggttcgcgcatcaatcgattgatgttaataccgggacagaaatcattgtcccggtttgaaaaaacgggcgtttttcgcgtaccgggacaattctcgttgccccgatacgagcgtcaatcgttttatgtgcgaaccgggacaacatgtcgatctcgggattgacggtattccgccgattctgcttgtcggggtatgtggactttgaaaattggtttgtcccggttctcaaaaatgggccgaaattgcgtaccgggacaacgatttctgtcccggtagaaacgtcaatcgattgacgttttcaccgggacaaattcgtgcccagaggaggggaagaggggctccgcaatggcgctgggcatcattgtggttggaggcaaattcgcgtccgggaacaatgggacgaggccccggtcgcaggagtagagcgtgatgttgtcatgattatgaccggctttcccacatggaaggccagtcataatcatgccgtttacccgcacgctccctgcacaccggccgcacatcacccacataaccgtgtacagtggcgtgtagtcgcagcaataaaggagcatcgcacatcatgaccaacggacacatcaaccccgccaacgtgccggacatcgccttgaaagacggtcattccattccgcaagtcggtctcggcgtgctacgtatcgacgatgagggtgtggtccccgtcgtcgaatccgcgttggaagccggctaccgccatatcgatggtgcggccggctacaacaacgaggccggcgtgggccgcgcgctcgccgcttccggatacaacaagggagccaagcgcgagaccctgtgggtcaccaccaagctgcgcgactcccagcagggctacgattccgcgctcaaagctttcgacaactcgctgaaactcctccagctcgattacgtggacatgtacatgatccattggcccacgccgttcgactggcgcagcaccgacacctggaaggcgttcgtcaagctgcgcgacgaaggcatggcacgcacgctcggcgtatgcaacttcatgcccgccgatctgaagcgtctgcacgaggagaccggcgcatggccggccgtcaatcagattgagctgcaccccacgtggcagcagcgcgaagtggtggcgttctgcaaggagcacggcatcgccgtggaggcctactcgccgatggcgcgtggcgccgacctcaacgccggcgacggcaccatcgagaagatcgccgccgcccatgaggtcagcccggcccaggtgattctgcgttggcacatcgaaaacggcacgatcatcatccccaagtccgtgcatgctgaccgccagaaggagaatctcaacctgttcggcttcgccctgaccgccgatgaacacgctgccatcgacgccctcgacggccccacccgcgccggccacgaccccctcaccttcacctatgcgtgattgatggcacgtcgtaacgcccacttccgccgtcgtttcaacgcttctggtccgctggagcgcgtgctgattctcatcgttctcgccgcagcaatcggcgtgaccatcggcctgctactgccgcaggtcagctccgacgcggccaaaatcacaggtggctacactgccaccggttcagccgccgacactttgaacgcgctcgccgtagacgacaaccaaagctcctccggctacgaccgcgattccttcggtttccgcaccaccgacgtcgacggcaatggctgcgacgtacgcgacgacgtgctcgcccgtgatctcacggacatcacctacaaatacgccggttcctgtgtggtcgagtccggcacactggccgatccgtacaccgctcagaccatccattttgtacgtggccgcgccaccagcgccaaagtgcagatcgaccatgtggtggcccttgaaaacgcttggcaatccggtgcgcgcgactggtccactgccaaacgccatgaattcggcaatgacccctacaacctgctggccgtcgacggcccggccaatcaggagaaggggtcggcttccgccgcctactggctacccaccaacgccgactaccgttgcgactacgtggcccgccagattggcgtcaaagacaagtaccagctcaccgtcacctcccaagaaaaggacgccatgctcgccgtcctccacacctgcccgggccaggccgtgcccgcagacgaataggggctaccgctcaggattgttgagcataggtgcctgcccctcgtcataagcgcgcaggagccgtcggagcaaaaatgtggtgaagtatggtgcggtgaacacgtgttcgctactaccgatattgccggcggatagtttcacgccgaactgaatttccggataagaatccgaagcgattagcgtccgcatggatttggcggtgccttttttcgatttcacctccaccggcaccagccattcgcgcgtgcggacgaagaaatcctgttccagtgtggaatcctcttttttgtagtagtacaggtcatagccggatttccgtagcgcttcagagacgatgctctcgtacatagcacccttatagacaccaagattacgattggcccgcagatcatcactggcctcgtcgtcaagcatcgctacgaacagaccggtatcgccgaaatatatcttgaacttgttttcgtcataattgcctttcaacggcagttcaggataggacatacatcggcagatattcaccattcccgaggtttcaagccattccacgcatcctcgatagtctttgaaacgcgctccgctggcaaccttgctgatttggaacttcttgttttccttggcgagttgcacgggaatatggttgaacacgttgagaattcgtgcctgatcgagtccttgcgcgtatttgcggatatcctcctggtagtccaaaataagctggcgctgcaattgcagtgttccctcgaacgtgccagtgcgtatatgggaggcgacaaccgcaggcatgccgccaagcacgcagtaatccataaatgccgtggagaagacgttcatttccacttcagagaatggcgtagcatcacacaggtgggtgaacatgctttcgatgacggcctcatcgtatccgcgagcccacagaaattcctcgaagtccaacgatcgcatttcgtagtcggtcttatatcccacgctattgctttcgatttgcttatagctgatgcccagcattgaaccgctgcaaatcacatcatatttgccgtcgattttaaagaacttcagtgcagtgacgatatcaggatgggcctggatttcgtcgaaaaagatgagcgtatcgcccggaatgaactttttagctgggttgatcagggaaatattgcggacgatggtatccgcgccataaccgtccgcagtgattgcgcgatatttcggttcctcaacgaagttgatttccactaccgaacggtagttgtgtgcggcaaagtaatcgatagtctctgtcttgcctacttgacgagggcccttgatgattagcggggagcgattcgggtcggatttccatgcattgagataggcatcggctttgcgtttgagatacatgaggagcccctttccgaattactgctatatcaatgattttacactttcatgagcgagttttctaccgtctggcacatttcatgagcgagttttctagtaatttcctcatttcatgagcgagttttcggcggtttgtcacatttcatgagcgagatggcggggaatgccagctgccagtccgccagtcatccatcaatcgtccgcagattgtccgtctgttgacgcgggaaacatgcccgcgctataactgagcccggtatgaagggagaagggaataggaacagacgatatggcagtaacacacaccgcagcagatgccattgcggcaaccactatgacgaacgccgtggcagacatcgaacaggaaacaccggaaatcgagaaggaacgccagcttgccggagtcggagccggagctggaaccgtggcaaacggcaagaaaaagccgcatgaccatgcgctggccagcatcctcggccccgcgttcgtggcggccgtggcctacgtcgatcctggcaacgtggcggccaacatcacctccggtgcgaggtacggctacctgttggtatgggtgctggtgctcgccaatgccatgagcgtgcttatccagtatcagtccgccaaactcggcatcgtgaccaacaaatccttgccggaactgctgggtgagcgtatgagcgatgccggccgtttcatgttctttatgcaggctgaagtcatcgccatcgccaccgatctggccgaggtgatcggcggtgccatcgccctgaacctgctgttcggatttccactgttcatcggcggtttggtgattggcacaatctccacggtgatgctgtggttccaaggcggcaagacacagaccacgttcgagcgcatcatcatcgtgatgctgctggtgattacgttcggcttcatcgcgggtctgttcgtagccccgccgaaccccggcgaagtggtcaaaggcatgattccacgcttccaaggcgccgactcggtgttgatggccgcctcgattctgggcgccaccgtgatgccgcacgccatctacctgcactccacgctggtgaacgaccattacgcaggcggcgaaaagccgtcgatcaaaacgcagctgagaggctcgaaaatcgatgtggcctgggcgctgttgctggccggcaccgtgaatctggcgatgctggtgctcgccgccaactcgctgcatggcatgtctggcacggattccatcgacggcgcacagcgggcgatcacgcaggtgctcggcccggtgatcggcacgatcttttccgtcggcctgctggcttcgtcgctgagctccacgtcggttggcacgtacgccggctcggaaatcatgcacggtctgctgcacgttaacgccccgatgtgggcctgccgcgtggtcacgctggtgccggcactgattgtgctgtggttcgccaaggacccgactcaggcgctggtcatcggccaggtggtgctttccatcggcatcccgttcgccgtgattccgctgatgcgatacacgcatgacaaggaactcatgggcaagtgggctgatggaaccgtcaagcacgtgatcttcatgatcgtcgtggcgctgattgtggcgttgaacgtgctgctgattgttctgacgctaatgggcagggcgtaatagactccagctgaaatcctgcgatagcacaacataataagaagccccggtgttggaaaccggggtttcttattatgttaagaatggttgaatctgccgtcagttcgcagccatacgccgcgcacgccgttcgcgcagcgcacgcaaggaaataatgtctcgcgtacgaccggcgccgtcgcccttgacgccgaagaacaccatcaacaccattgccagacagatcattgcggagatgcgcagcgcccattgaatgccaaaaatcgaagcggcgacggcggaggcgccgccctgcttatgcaaagcggcaaacgtttccatcagaatcaccaacacgggtgcgcccacagcgcccgcaatctgacgcgcggtattcgtcaccgatgatccggcggacacttcgctcggcccgttcaggcaattcagggaccacgtggtaatcggcatcagcaggaaacccatgccgatctgacggatgaactggcagatcgatacccaccagatccacgtatccatcgccaccagcgacatgcccaaggtgccaagggtcaacacaatcgaaccgaacaaagccacgggtcgtgcgccgaatcgatccatcgcacggccgccgaagaactgggagacgcactggccgatagcgcccggcaacatgatcaggccactcatcgtggcagaatacccacggtcggtctggatgtagagcggcatgatgaccagaatcgaactgaaggcgaaaaatgccagcgacgcggtaatggtgccgacggtgaacgaacggttcttcagcacttccaagtccagcagcggcggctgggggagtgccgacttgtcctcggctacggcctcacgatagcgcttgccggcgcgcaggttacgcagcacgaaccatacgatgccgatcagacccacaaccataggtccccacgtgaccggtgccgcgaatccataggtctctgaattggtgaagccgaacataagcccgccaaagccgatcaccgacaggcatgccgagaagaagtccgcgcgggccgaagggtcgtgtgaaccgaaattatgcagtccgaacatggccgccagcagcgagattacgccaatgatggtcatggtcaggaagatcgagcgccagccgttggcatcggtctgccagccgcccaaggtggggccgatggctggcgccacgctcatggccatgcccaccgtgcccatggcaaacccgcggcgagacagcgggtaaatggagaacacggtgatttgcagcaccggccacatcacgcccgtgccggcagcttcgagcacgcgcccgaccagcacccatacgaagtttggccccaaccatgccagcacggagccgagtgtgaacaccgccatcgagcagatgacgatctggcgggtggagaagcgtcgggtcagaaacgcggtcagcggcaccatcacgcccatgaccagctggaacacggaggtgagccactgcccggtggttacggagatgtggaattcggaaacgataatcggcagcgcggaactcagctgcaactgcgtgaagttgcccacgaaggtgatgaaggtcaatatcgcgatggagatgaacgccgcccggctgagtttgccgtctacatatgattcctcgcggctcagcacccgctgcagttcgccgcgatgattcttgattccctgagctccgttcattccactcacgtgcatactccactctcgctgatcgaccgcaacaacgcatcaggcggtctctcaaagcaaccccaacacgctacacccaggggtagtccgtggggtagtccgtcgagatgcaatgccgagatgactggccgcccggttgcagagcaaattagtcccgttattcgagacgtcaaaatgaacgtagttactatccgatcacgttcgctatgttggttttccaacaccccccccctagcggttaggggtgtgggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgccgtgatgtctgtaccatgttgaaggggtaaccccgtatacacccgtacacaggggaatccagagaagtgagagccgcgagacctgcagtatacggtcgaaaaggaaggactggtgtctgaggtgtcgtatctgagcagtaacggtcagccgtctacgcgcagcagacaggccaatagcggtgaccgaaccaccgctcagctcagagatatccgccaaaagcagctcagccacgtgctgtactggcgattcttcgtcaatctcgccctcatgcttatcgacgccgccatgtacatcatcgccggagccacggtgctcaatctgcgccatgaggcaacgccgctctattcgagcagattcaatttcacgattgactccaccgtttaccttattattgtggcctgcttctgggtgtggtcgctctatgttgccggcatttatcaccgccatgttatgggtgacggttaccagctcaatgtgctgctggtcaaaggcatggtcgtgtgctgggtggtgcagtgcgcgttcaactacttctttaatctgggtctgaccctcacgtcgctctgcttggtggtgattgccggatggttgctcaccatggtggaacgcatcgccagccgtgcattcattacgcgtagtcgtcgcaagggcacctacgcttatggcacggtgatcatcggttccccgcacggcattggtcgcacgctacaattcctcggtcagcgtcggcaactcaactaccgcccggtggcagtatgcccgattcatctcaatcccgataccggattgattgaacagagcaccgaccatgagacactccgtgaggagatgcaaaagaacgaaggctgccagctgcccgtactcgagtacagcgatcataatcttgctgaacagattattgacatgaacgcgcagaccgttatggtggctgacgagctgcgtcgctattcggataattacgatatcttctccgtgcgcatggaatcgttcggtctggagattgccatgctggcttccgccgctgacacttctaaccatgagattcaggttcgatccatacagggcaccacgattatcacgcagcgtcttgcgcaatacacgccagcccgccgtttgaccaaacgcttgtttgatttggtgatttcttcgctagcgatcatctgttcgtcgattatcaccatcccggtggcgatcgccatcaaagtcacggacggcggaccggtgttctacaagcagacccgtatgggcctgcgcggcaagccgttccagatgtacaagttccgttcgatggtagtgaacgccgacgcgctcaagaaggagctcgcaaaagagaccggccagaccgaccgcttcatcttcaagatgaagaacgacccacgcatcaccaaggtggggcacttcattcgccgcttctccattgacgagttgccccagttcctcaacgtgtggatgggggatatgtccgtagtggggccgcgcccgccgctgcctgaggaatatgcccgttacaaccgtctgtacgccacccgcatgctggtcaagcccggcatcaccggtccgtggcaggtgtccggccgctccgatctgtccgccgaggaaagcgaggcccttgatgtggcttacgtgcagaactggtcgattatgggagacattgtgctgctgttccgcacggtgggtgcagtgctgagccataagggagcgtactgattccttcccgtttcgctgtcacagttttgccgcgcccttgccgcaccgcccttgaacgtgattacagaaagataagtcgatatatctatgactgattcgaacataccagaaatacctcagccgccggcaccctccgagcggtcggaaaacgcggatgatcgccaagtgatacagccgtatgttgaccctgaggtacttgctgaagacgcccgagcggcggaacggcgtaagcaccgccggcgtatgagccatgaacatatcaggcggatcaagcgcaaaaagcgcattcggatggtgctgattgtaatcggcgcactgctgttgattattgccgcgctcgcggcgtggcttggcctttccgcgctcaaagcgaaaaatgaagtggaagcagcgattcaggccgcaagccgcatccaatcacaagttcaagccggcgacaccgacaaagcgcaagccagcattgaagcattctcccagcatatcgacgctacgtatgtgcagaccaagcagccggtatggaaactggccacattggtgccctattacggttctgacgtgaaggccgcgcgagacatggtgcacattttggaagacgtgtcgaacaacgcattgccgaagcttgccaaggcggcacaggccttggatttcaacagcatcggtatcaaagacggaacgattcagctgggggatatggccagcgtggctcaggatcttgccgccgccaatggagtagtggcggatgccagcgtagacatgggcaagattggcgatacgcatattccgcagattaccgaggcggtgcagcaggggcgtagcaggttcaaggagcttgccagcctgacggatgcggccagtcggctggcggatgtgctgcccaagatgttcgacttggatagcagcgagggtagtagcagtggcccgcgaacctacctggtgctggcacagaacaatgctgagctgcgtgccacgggaggtattccaactgcgtgggccacgctcaccgtcgatgcaggcaaaatcagcatgagcacgttcggcgatccgcctcgggatggtctgttcagccaggatgaagccgcgagcgtactgacggcggaagaacgcaatctcttctccaccaagatggccacggactacccggacatcaatttcactcccgatttccccgcgtcgctgatatcgcgagtcagatctggcatcgagccggtcatgacgatgtggatggcgtcatcagcgtggacccggtgttcctgcagcggttattgaaggttgccggccccgtgacgctctccgatggcacggtgatgagcggcgacaatgccgagcagcggattctgaaccagatttatattgataccgatacgcaggcggagcaaaccgacttcttcacgatggcggccagtgagatcttcacgcatgtgctcaagaatgtggacggcaagaatcagcagctggtgcaaacgttccaggagtccgtatccgacggccatctgtatgtatggagtgctcatgaagatgagcagcggcgtatctcgggtacgaccatcgccggcgaattgcggtcgaaaccggctcattcggttacgggggtgtacttcaacgatgccactatgggcaagatggactggtacctgaagcgtgaagtgaccagtacatatgacaaaacctatcccagtggcgccaagcaatacaccgttcacatcaaactgacgaatacggccgatgccgccaaggtgaatgccgctccggatctattgcgcggctatgaccataacggcaacccccgtacaggggagatcgaaacggtgctgtacgtctacgccccaatgaagggcgcattgtggattggacccaggatttcgatcagttcgctgtgcacgatggactgacggtgggtgtgaaaaccgtgacattgcggccgggggaaagtttcgagaccacggtgcatgtgctggccagtcccgcggccaatgaaaatgaaatgattttgagacagaccccttggttgattaaaggggcaacccctatacattaaggtggaaccgtgaataaggaagaacggagcatagctgtggatgaagctgaacaggtgcaggatggtaatggagtcaccattctcgatttattcaatgcggtaagaaagcatgtgattaccgcagtggtcacgctggttattgtgatggtggcaatctgcgcgtacacctttacccgcactccgcaatacaccgcgacttccgaactcttggccacttatcgcagttcagcggctgcgtcgggcgcatccagcaatgcagtcgagctgagctctggcgccaattacatcaatagccagattcaaacgtatccgcaattgataaaaaccgagtccgtattgcagccggttattgacgatctgggtcttgacaccacggtaaaggaattggctgcgagcgttaccgcttccaacccggacggcaccatgctggtggatatttcggttaatgatccagacccgaagcaggcgtccagcattgccaattcggttgccgaaaacctgagaaaacaggttacttccacgatttacagcgatgagggcgataagatcatctctcccgtcaacctgactgtggtgcagcaggcgtacgctccggcttccccagctcacccaacgtcaagctgaatatggcgataggccttgtgtccggcattgttctcggcgtcatggtggcccttatcaaggatttgctggacacccgtgttcgccgcgattcggatgttactactgttatcgatgctcccgtactggggtcgctgagccgcaatgaggcttatgtcggtacgtcgccggtgattatctcccgcccggcctcccgcgaggcagaagagattcgacgtctgcgcaccaatgtgatgttcgtgctgcccgatgagccgttatccaatgtgattgtggtgacttccgccggcccgtctgaaggcaagaccacgctgagcgtgaacctggcgactgcatttgccgaaaacggcagcaaggtactgctgatcgacgccgatgtgcgcaacccctcggtgagcaaggccctaggcattgagggcgcagtgggcttgacccatctgattaccaaccgtgtatcgtcgcatgatgcgattcaacgctactggaagccgaacttccacgtgcttcctgctggaaaacaaaccatgaaccccagcattctgctgaattcccgcgctatgaaggcactggttgagcaggtttccggagcctatgactatgtgattatcgataccgcccccatgcaggtggccaatgatgccgccgtattcgccaaggaagggccggaactgctgctggtggccggcttgggagtgacggaaaagaaactgctccggcagaccgggcgcgaactgagcacactgagcatcgatcccgtgggcttggccatgaattacggcgagacggagaagccccagaagggtggctattactactacggcgacgagtccgatgacaacggcaggaagcgccaaatccagcacaaaaagagcgagaaaatgaagaaggactgaggccatgaggatcgcgttcatcggccacaaacgcattccgtctcgcgaaggtggcatcgagattgttgtggacgaactggctacacgtatggctgcacgcggagaacaggtcatagcgtttaaccgcaaaggccataatgttgccggtgcggtgttcgataatgcgtcgaatcagaatagcaagccgttcatgtatcgcggagtgaaggtaatacctgtcaccactatcgatgcaaaaggtctggccgcgctcacctcgtcattctttgccacagtaaaggctattatggcccgccctgatgtgattcattaccacgcggaagggccgtgcgtgccgttgcgttttgcgcactggttcggtattcgtacagtggccacgattcatggtctagattggcagcgcgccaaatggggtaaattcgcctctacgtatctgaaattaggggagcgtaccgccgctacctgtgccgatgaagtgattgtgctgagccgcaacgtgcagcgctatttcaaagacacctatgggcgtgatgtgcgattcattcccaatggcattgaacgcaatgagtctgttccagccaatgagattactcggaaatatggtttggtgaaagacgggtatgtgctgtttctaggccgtatcgtgccggaaaaaggcgtgcattatcttatcgaggcattcaagcaattggatactgataagaagctggtcatcgccggcggatcttccgattccgctgaatactatgaacagattcaatctgctgcggctaccgatcctcgcatcgtgttgactggttttatcgagggtcaggaacttgcggagttgtacagcaatgcttatatctatgtgttgcctagtgatctcgaaggcatgcctatgagtctgctggaagccatgagctatggcaattgttgccttacttccgacatccccgaatgcgccgaggtagtagaagaccacgccgttaccttccgcaagggtgatgttgcagatctcactgccaaactgagcaacttgctcactgacccttcccgcgtggcgcagctacaagcgaccgccgccaactacatcactcaaaaatacaattgggacaaagtagtggaccaaaccttggcgttgtaccaaggaaaagacccctctgacgagggggctcccggcggagccgggtggggagagcccaccacgaccatcaggaggcttcccaatgaaaatcctcctagtcaataaatacttctaccgcaaaggcggtgccgaaacctactttttcgcactcgccgaaggcctgaaatcattaggccacgaagttgccttcttctccatgcagcacccgaacaacgagccaagctattggagcaagtatttcgtatctgaaaaagactacgtcggtaaaatttccgcattccaacaggcaaaggaagcggcaacgctgatctattcgttggaatccaagcgcaagtttgaggcgctgctggaggagttccagccggatgtgatccacatgaacaacgtgcaccgtcagctgacactgtcgattctggatgcgccgtacctgaagaagcatcgtgtgccagtggtgtacaccgcacatgactacattctgctgtgccctgcatacaccatggtggacggcaacggcaaggtgtgcgacgactgccttgatcgacgtttcatccatgctgtgaagaagacttgcgtgaagggttccaaagccaaaagcggactcgcgttcctggaggcggagttcctgaaacaccatcacagctacgacaagatcgacaagatcatcgcgccgagcgagttcatgaagagcaagctcgacgagggcggctatgcgggccgtaccgtggccatgcagaacttcctgaccaccagccagatggatatggctcataaagtaacgaatacggacaaattcaacaccgtggacccgtattttctgttcttcggtcgtctctccaaggaaaagggcatccttaccttggtcaaggctttccttcaggccgcaggtctgctcccgctggcgggagctgtcgagcaaagcgagactgagggtggtcaccttgtagctaactgtctcccctccaattggaccctccacatcgtcggcgacggcccagaacgccaaaccatcgaaatgctcatcaaatctgccggctccgaagccgaaaatcgcattaaactcctcggctacaaaaccggcgaaaatctccagcgcgaagtcggcaacgcccgcttctctgttctatgctccgaatggcgtgagaacatgccgtactccggcttggaatccttggcagcgcagaccccggtgatcggcgcgaacatcggaggcatccccgaactcgtggtggaaggcgaaactggcttcaaattcgaaagcgggaaccaggacgatctggcccggacattgaccaaggcggcacaggtggacgccggacgctacgcctccatgcaggagtcctgcggccgctatgtcgaggaacggtgccgacaggatatgtatgtgcggcagctggaggatgtctaccgaggcactcgcaatgccgacggcatgtccgtggtttccggcgttgccgggaataggtaagttgacacgggccgtctgatagacgcgtggaagcagaggagagcaagaaaatatggtcgcaggtcattcaagtatcaaacgaatcgtccatcgtatcggtgaggagtgccgttccacggcggagatcgcccggctgacgtcatggccggaggcgttggagaccttcatggcgaaggtggacatccagatgatgaatcgcaacggattcaaagaaccgccggcggtgcgcaaccgtctggtacacaagcatgagattctcatgaagtacttcgagcagcgttatggccgcttcgccgatgagtatgacttccatgcccccatgcaggcgagcgaccccgctcttgaaggcaagatctggacgtgctggtggcagggcctcgatcaggctcccgaaatcgtcaaatggtgcgtggaatccatcaagcggaacgccggtggccgcgaggtcatcatcatcaccgatgagaactacgaacgctacgtgcacatcccccagtgggtgaaggagaagcagaaggccggcatcatcacgcggacccatctttcggatctgcttcgtttcatgctgctgtcgcaatacggtgggctgtggctggattccacgttcttctgcaccggttccttggaggatgtcgcgtttgcttcttccctgtggtcgatcaagcggccggattatttccatgcctctgtggctcagggctatttcgcgaactactcttttgcgtgccattccgataaacgttgggtattcgccgctattcgtgattttgttctggaatactggcgtaccaatgattccatggtggattatctgttcgtcgattacctgattacattggcgatacggcatgatacggcaatgaaggaagcattcgcggcgattccttccaataaccccaattgcgatgaattgttcaaagtattgggcaagccatatgacgaacgactctggggaaagataggtaaggagacctccttgttcaagcttacatggaaacaagtttttcctgtcgagcatgatggtgaaaaaacattttatggaatgttgaaaggcataggagattaataatatgcctatcctttcagttgtcataccctgttataatgcctcgtcgacaatcgaagaatgtgttctgtcggtcatggatcaatcgttaactgatttggaaataattgtggttgatgatggatctacggacgattctttagctatttgtcgcaggttagccgaggaagatgaacggatttccgtttatacaaaaaagaatgccggtcaaggcattgctcggaattttggcatgtcgcatgcaacaggggaatacatagcttttgttgatgctgatgatacatgtaatgttgagatgtacagggcgttgattgattcagctaaagaattcgacgcagatcttgttttctcgggatatagagacattaaagacgggaaagtggtagaagagcatccaaacaatagagaagtactccaagacgatgctgctattcgacaacacatggccgatcttatagcttcttctgcagggaatgttggttcgtgctgtgttgcggtctgggatggcatatttaggttatccatgctaagaaaatatggcatagaattcccttcagaaaggactgtttattccgaagatcttgtattcaagctaagagcacttgcattgtccaatacggtatctttccttccggatagttattatgaataccatataagcgaatcttcgtattcaagatgtattgatgtacatgttattgacaagcttatttcgatgtataaaataattgagtgtgaattttcggaaacactggatgagttctgtttctcatcaagaaacgcagcgaggctgtttgcctcgctccgttttgctttgcgtagcgcaccgttggataatggacgtttgtcgtttttcagagcagttgtctcaaatcaggatttacgagtttgtttagcgttatttaagccgaattctgccttggataagcttatatatagaacgtttttgaaggaagaatacatcattctttctctcctatttttatgtttccagctgaaagggtatctgaaatgaaaattggtgtcatcacgtttcaccgtgccatcaactacggtgctgcactgcagacttacgcactgcagagggccatatctgacctcggttttgataccgaggtaattgattaccggtgtgaacatatggaaaatctgtataaactgattggtggtttcaagcagaagacatttaagcagaatatcagagggtttattaatcttattccatcttggaagaagatgaatagtttccgctctatgattgctgggaatactaaattaagtcctgttgcgtatgattcaaagtcaatcgccacagcaaatcaacgctatgatgtattcatcaccggaagtgatcaagtttttaactatgcttgttcagattttgataagaattattatctttcgtttgtagaagatactaggaaaataaattcttatgcagcatcttttgggattagtgaaattcctcaagagtaccagagtgagtacacgaggttgcttaatagatttaatcatctctcagtccgagaagaatccggacgccgtatcgttcgtgaattgacgggaagagattgcgcattacatgtcgatccggttttccttttaaatgccgctgaatggtcgaaactcgcgaaagatcctggtattgataattacattcttatttatcgtttgaataagtcaaatattattgatgattttgctagaaaacttgcaaaaaaaacaggaaaaagggtcattaatattggtcaggacttgattgacaaagtcaagaatccagattttgaaggtaatcttagcacttccgttgaagaattccttggtctattcaagcatgccgattatgttgtgactaattctttccatggtacggctttttctgtaatctttaatcgtaagctatatgtagagacaaaacagaaagatttcaagaagaacgatagagcagagaatttacttaaactaactggtctcacagactcgattatcgagactttggatgattgtaatcttgatattgttcgtgattttgagcatgctcaatctgtactttctagcgagagagagtctgccttagattatctccggggaatttgttccaatgaatagtctgatatataagttaagaatctggctgagaacaactccaattgaagattatttcattccatgcatattgcttatattagttttttctactgataataagctaatattcatcacgagacagttagccattgtgcttacggctgctattttctgtttcgcattgatgtcgaaaaggaagtcaggtttatcctctgtcgtagagaaagtctacgtagcttttttcttgcttatctgcataagctttctctacacaggtgatcgcttaacttatagtaagtattttccttacgtccttgccatcttttctatgacgctttttgaattcgatagtaaattttttagttgtctcatcaggcagtttgaatttctgttctggatatttatcttttcgatgtatctagagttattggctcccaatctattttctttattcttcggttttcttgatcatggaagtagccgatctgcagttatggttaacactggtggcgctatttcgggattagcttatgaaaaaggttatgcagcgttcctatgcaacatgggattaggcgtgctatttgcaaagtttttcgtcagaggatttaccttagctagattgttccaaatcattggtgtctttgctgctttaatgatgacaggtaaaaggactttgtttcttattccagtgatgggacttatcgtatttgcgttgttcttctccaagaagcataagatttcaattgctcttggtctatcctttgtgctcgttgtgtcattaacaatagctgattcgcttattcctcaagtgtctcttgtattcgacagattgtttgcagataacggcgatcccttgagcggtagacaggttttttggacatatgccatgcagatgtttgaggcatctccgcttatcggcagaggctttctttcatttaatgcgtatataaatgctcaaggtttccgttattatgggttgctttggagctatcaagcccataacgtttatttacagcttcttgctgagcttggtattgctggttttttgctattcgttgccttgcttgccacgcttacctttggtctagttcgtagttttttgagttggaaagacagccaaggcttggaacctgttattcttcttactgcagtatactggattattctcatagccgtgtatagcttgaccggcaatacaatctactattcgtgtcaacttgtggtgctcggtatttgtatagctatatatcagactttcaaatttaagaaagcgttgcagaaaaatggaaccacttgttagtattattactccggcttttaacgcctctaagtatcttgtttctttcttcgaatctgtgttagaccaggaatattccaactatgaactaattttcataaatgatggttcaactgatgatacagaggaaattgcactacaatacaagaagatttttgaagaaaaaggtcatcgattcgtttatcttgtaaaagagaatggcggacaggctgctgcccttaataccggtttcccatacatgaagggaaagtactttatctggcctgactctgatgatactctatgctccgataatctgtcagtcaaagttgacttcatggaaaaaaatccgagtatcgatcttggtatcgcgtgggcgatacatgtggatgagagtggcaatgatttaggtgttctaaaaagaatacctgcggaaaatgataatctattccgtgatttacttgtcagtaataatgtgcagttctgtccaggtatatatattattagaacttccactttcaaaaagtgttaccctgagctgcatattgatgagagtcgagccgggcaaaattatcagcttcttcttcctatggcgtataagtatcgttacggttatattaatagagttttgtatacatatatcttgcatcctgccagtcactcaaatttcaagccgcatgatgagcaagcccagatggaacgttttgagagacaagagcatcttttgctgaggctcgtagaacatatatgtgtccaagatgataaggttgagatgattgctctggtcaggagacattttcaaggcatttatctgaggattgccaatgaacatattgacagaagaaaagctgcagcctccatgtattcgttatgtcgcatgcatcaggtgaattgtaaggatatcatctacgcattcgcaacttttgctggaatcaagcttaaatgaggggtgagcatcttgggaaggacaagcaaattcgttctcaatgcgatatcaactgcgcttcttcagatagtaactatggtagcagggtttattacaccccgttttcttttagtcgcttatgggtcagatattaatggtcttatctcatccatcaatcagttcattgtttactttaatcttgtagaggctgggttgtcaagtgccgctgtttattcattatataaaccaatagctgagcataattataaccaaatcaatcgtgttgtagttgctgcgcgaaatttttatgttaagtctggcttcatctttgtcggtcttgtttttctgcttgcatttgtatatccttggataacgcatacagaggtactggataagggaactgttttttgtctagtccttgtacttggcgtaaatggtgctcttgaatttttcactctggcaaaatatagagctttattgacagcggatcaaaaaacttatgtgatctccacggcatcaatcgtttatacaatccttaatactctcattgtcgttattctatcgactttgagagttgacatattactccttcggatcgtcgcccttatttccatatttgctagaagtctgatcttatatatttatataaagatacactataagtttattgattataaagtagcaccagataattctgccatggataagcgttggagtgcgttgtacctgcaggttgtgcagactgtacaaaatgcttctcccgctgtattgactacgttattctctacacttaagatggtcagtgtttattccgtctataatatggtgctcgctggaatcaatggtgtaatgtcggtgttttctactggagtatctgctgggttcggagagctcctagtaaagaaagacatgaaagcgttcagcaaagcatataaagactttgaatacctatattatatggcgatgagcatagtatacggtgttacgatggcaacgattcttccattcattcaggtgtatacaaaaggtgttaatgatgttcagtacgtgaatattgtttttgccgtattgtttgtcctcaatggggttttttataatctaaagacacctcaaggaatgctagtgattgcagctggtctctacaaggagacgcggattcagagcaccattcaggcgggtatcctggttgttggaggtgttgtcctcggctattcatttggtcttacgggtgttttggttgcctcttgcttgtctaatttctatagatgtgttgatttgcttttcttcattccgaagaatgttacgcatcttccgattctcccttcattacggcgaatggtggagacgctggtggtcattgtcctgatatgtgccgcttcatggctctgccttccgttccatccgaacactttgatgacttgggttggttatgctttctgtaatcttgtgttggcggttctgttggtaatgctgttccatgttctttttgagcgatcaaatattcatattgttgttgacagagttcgttcgattttcaagagaaaatagtacatgtctttgtggatcatattctatgaatgcatattccttaatttaaaactggctcgcttccttttttatagtgtgattaacgaatgttggttgaacagcattgtatagggtccggatttcaatattgctgacaatatgggcatatactctgaattgaatagaaaggatgttctaatgaatatcaaagatgaagtaaaaaagttaactccagtttttttgttggaaagaaaacagtggctgcatttaaaacatgaatcgctttatcaactgaaacgtttctataatgccattacgaatggtagcaataataatgtaaatcactgcatcgccaaggtaacgttctatagtcatcaaatcgaaaaaggattaagccatagtaattttcgctatggatttgggaagtcagctttaatgaatctttcctcagccttagaagatctgaaacgatgtgattctgactatccggaatgtgcggcttatcagagtgctgtggcagcattgcaggaataccgctataagcatgaaaatgctggttatcacatagatgatatgattgcgctttttccctcggacatctgggatgatgcttctgcatctgcttccgctaacggtggaagtgttccggttaaagcctcattgaaagatggaaatgccaccattccctttgagaacctgttcctaaaccgtaggtctgtacgcgaattttctgatagccctcttaccgaaaccgagattcaacatgtgattgaagtagctacgaaagcaccgtcggtttgtaaccgtcagccggttcgtgtgtacgcgattacgaataaatctgtaattgagaaagcgttgaagctacaaggaggctttaatgggtataaggttcccccggctttgttcttgatcacagcagacaatgaagcttttctttcgataagcgaacacaatgaaggttttgttgacggcggtcttttctccatggccttactaatggctatggaagctaataagatcgctgcgtgtcctttaaacactatgttctcaaaacagattgatcaacagacgcgtaatttaatcggagttcctgaaaacgagttcttgattatgtatattgctgctggacattttcctgatgaaacacatacatgtatttctaaacgatatcctgttcaggatattcttactatcgtcagatagtgtattctgaaatacagtacaaggttcatttctatgtttcataacagttcatcgccagaattgtgataattaagtactatctaccacttttttcattactggcatgtcgaagagaaaggttgataaatgaacggagtcaaagatgatgagctccataccatcgaacgtgtgatagcgtctcctgacgaggatgcgattggaggcacggctacatactgcataggatgtggttcgtgtgcggtaatagatccagcgtttcgcattgcaaaaaatgcagatggctgctatcgagctagtgttgtcggtgagcctcgtgattggattgcggcggagcgtgtttgcccattcgcgtcctcggtagacgagaaccagctcggggaggagctgtttagcaaacagtccggcgttaagtatgaccagcatctaggttattacctgagtgcttatgccggatatgtgtctgtggacggttggcgttcccggggcacttccggtggcatgatcagttggctggctgctaaaatgcttcaggatgggcttgtagatgcggtcattcatgccaaagatggtcctgatcctaagaatatgtatactatccagatctcccgtactgtcgatgagatcaaagcgggtgcaaaagcgaagtattatcctattgaactcagcgaggccattaaacaggtacgtgagcacgaagggcgttacctatttatcggccttccgtgctttgttaaggccgttcggcttttacgtcgtgaggatcctgtgctgatgaagcgcatcccctattgcatcggcttgatatgcggacatttgaaatctgatttctttggacaagccgaagcatgggagtcaggcgtgcctcttgacaagattgcacgtgtggacttccggcacaagacttccggtacacgtgcctcggattatgcaattgaggtgcgtcgcacggataaggatgagcctatcgtcaagcgcattgccgaattgtctactgcaaactggggactcggctatttcaaatacaatgcgtgtgattactgcgatgatgtgcttgccgagaccgctgacgcgactttcggagatgcatggattcccaaatatgtgtcggatgacaaaggttgcaatgttatcatcattcggaatcaagccattcaggatttgtttaaccggtataggaatgaactcgtcctgcatgattcggatgccacggaagtctatcaatcacagtccagcggattccgccatcgtcgccaaggtctagctgagcgtctgtacatccatcaacagcgtggcgaatggacacctaccaaacgtattaagccgtcccttgatggaattcctgaacggcgtcagcgggtttacgcaatgcgcaccattttgaaaaatgagagctttgtagcattccgtgaggccgtcaaagccggggatttcaccgtgttcaacaaacacatgaaacccctcgaacgtaagtactggcgcgttagtatccctttcaagaagcgtatgatgaacctcgtcaaacgagccattaacaaactaggccgaatccttaaaaagctctaatttccgccgcgaatatgttccgatgttctaatgccgataatcggaatggattcatatcgataggactaccattttggtgcaggggctgcgggcgtctttttaagatagccatgcagcccctattactgtgatgcgtacaatgataaggggggtgaagaccaaagtgcgcaaaactttgggccctaggggacacttgcaggtcgggtgcgacgttgtacaacgccatgcgcatctgcccgtagctcatatgggcagacaagggtaagagagatgccggttccacggccgtccttatcgggaggcttctgttttctctatgctcggtcgtcataggtctgttcctccgacggtgcggctctgcgaatgaaatcacccatgccgggaacggtgaatgccaagagcccacgttctggcgaatatgccagcccggaatcgatgatgccttttctgacccgtacgacatccgcaggtggccgtcccagtcgttccgcgatctccgccgagctgcacacgcttttttcgagcgaggccatggccctcatgtattcccgttccagtgggcgggcccgttgccagcgtgattcgtataggccgctgtccagtgatgcctgcgctatgggttcgcccttgatgacggcggacaatgggattggtgatgattcggattcatcgaaggctgcagaaccatatgcctggatgaaatacggataccccttggagagctctatgagacggttcagggcatcgtcgtcgaatcgcacattgattttgccgatggtcttttcgaagcattccctggtctcgtcttcggggagccgtccgattcgcttgtactggaacaggcgttcggcgtaggagcgtgatttggtaagcacgccgggaaggttgggcagtcccgccgcgatgacgtagaagggcagatcctcctgtcccatgctgtgctgcagtccgatgatggtgcccatcaggtcgctggacatcacttggaactcgtcgatgaacaggaacaggcccgatccttcctttttgagttcgcggcatagttcctcgaccatcatttcgagtcgcagcgagtcgctggatatgcctttgtcctcgttgccgagcccgattgacgttttgattaacccgagttcgagggaaacctcgttgacgtgtttgagggagtcgagcattttctgtcggagcgttcctcttctctcgcgcagtatcgctttggagatgccgtcgaagaggagttcgtagtcgtgggtctcgtttcccgtggcttccatgcggacggtaatgagtccttggccggcggccatgtctttcattctcagcaggagcacggtcttgccgacgcctctcagcccgctgtagaccagtccgcggtcggagtatcccgcttttgttctggcgatgattctgtccatgatttcgagttcctgctcgcgtcctacgagttccttgggttgtcttcccgctccgggcgcgaatggattgagggcgtgcatcgcttctttgcgtctggctaaatccacggtgttcatgtgcggttcctttggccttccataagttctaggtaaaaatatacacttatatacacatatatacatgaatatgtgagttcaagcgaactgatgctacgccggctcgtccccgtccccatcaaacttgtgctcatcctcgtaggcaacgatgtccatatcgcctcgatggagtttcttgagtgtttcagctactcgcgcctgctcatcatcaacaatagggcgctcgccggctaagcatgtgagaccatcggatactgcggaaaacactgccgaacccgcccaacaaacattgaagcaatacattttttatttgcttcgttactgcgtattctgcactccacatgtgcgaaacgttggaattccgccaaaattttatttgcctggtatttgcttgggtgggtcgcaaagcgcggttgcggcacgattcttagtggtggtgccttatggcgtcgggctttcctcgcaaatcgaggtaaggaaactggcccttaacccggaatttgaaaaagtaaaaggtccctggctgttcaccagccagagacctttttggtaacaactgaggttgaggaaacctcggcagttgggtccaacggggcgaaagtctgtggcgccgccgagaagattgccccgaagctagcgcgacctttctgctacaacacagcataccagcatccatcgaaccttatcttttacgggttccggcccctcgtcttcaatcagggcaccgtttcaaggcagaagaatcaggcggccttcttgcgaccgcggcgcttcatggtgccggcggtggcattggccgcatcgaagatcacggtcttgctttcggggtaggcggtaccgttgacggactggtaggcgatttcgccttccggagcctcgggcagagtgaagtatgccttcactgcttcaatgagcgtggcttccttgacgcttaccgaagcagcctgcttgccttcgggcttgctgaacttaatggcgttgtcggccttggcggtggtcggggtcacggcgatctgcctggtcttgtcgttaatcagcaccttgacgtacgccgggaatccgagcacttcagcggtggctttgttgaaacgaatggcggaatcggtgacggtcagaacggtcttgcccaccggcttgaccagctgaacctcttcgaatccctgaagcaatgaagccataattgctctccttattgcattggtcacgttttttttatttacgtcactaattgtaaccagctaatttcgcattatacaaaccatatgcatgcatgattgcataattgaagaacatttgacctacgtattgcgctccccgaatagcactgatttaaccaataccaagaaaagcggaaacaagaacccgcaatatcagccgtattgaatatagaaatatgcaatttcaacatcgcaataactgacggtctttttgctggctctattcgccgatatcgcattcaggccacagcgccgagcataatatcgacgccgtgcttgatttccgcatacacgcgttcaaacacctcgcgtgattgacgatgagggtcttcggtttcgagtgccgtaggcaaaaacggccgcagcataggtacgcaatccatgatttcgatgagcctgtctgcggcggtatcgccggcaatcggaccctcggcatgcatatatttgcaagcgttcacgaagtcattgaacagaaatactttgcgaatagccagtggattctgttcaagcaaatcggaaatttgctcacgctcaaaacacagaatcaggtcggcttgccggctgatatcggtggtgagaggggtggaagaatgggaattcgcgtcaatgccgtcgttcttcagcaaatcgataaccatcggatcagcgggatgcgggggatagtgcagagtacccgcgctgcgcacggtgatattgccgctctgcaagccaattcctcggtcggcaagcttggctcgggtgtagtattcggccatcacggaacggcattgattgccggtgcatacatacatgatttgcataacaacgtcccttctcaagtgttgtgagcattccctcatatattccagtgagcattcctcgcgaatatgcgtgcgttatgtaccgtagcaataacatgaaaaaaccgggaatcatcgactcccggttcagtggtattcgcgaactatgcttcagcgtctactgtttattatgtcagtcacgtcagcgacgagtggtgttcttgcggacggcgaacagggcgatgcccgcggcggcaagcagcacaacggccacaccgtacggtgcgatggccgcaccggtgttggcggtggtagcagtcgtggtaccggactggtcaccggttccggttgccggaacctgaatggtggcggtcttggtaccggatacagcgccaacagccttgaccgcgatggtcttgccagcctggctggccttgaacgtgtacagcaaagtcaaggaaccatctgccttggcagtgaacgtcttggatacttcagcgatctgctggacgtcggcgacgatggcatcatcgtagtacacggtgacggattcattcggttggaatgtgcctgcagggaacgtcacggtagcggtggtgccgctgtaagtaaccgttgcaccgtaatcatcagccatggcggtattcgttgcgaaaccaaagcccagaactgcggcgataacggccagcacggccataatcttcttcttcataacttcgaacctccacaatagaaccggttactaccgatgagaaatcggttcttatcaatagaaaatcggtcttccttcaattacaacccccaaccatacacccccctttgtcggtatataaggggtaattatgttaacggataaggggggtgacaacgtggtcacatcatgtgacaacgttcgaacatattgtcgccgcattaccgttgcggcggggtctcctgacgttctgaaaacgttgctattccaacgattgcggtgattggcgatacgtgcatggtaaacaacagggaaatttttttctgcgacacgccgacgggctactcggattctgattcgtactcgtcgtcaaaactgaacaggtcctctacggtggtgccgaacacccgcgccaaatccatggccagacgcaatgatgggcagtattgcccctgttccagccttcctatggtctcacgtcgcacgttgaccagatcggcgaggtcggattgcttcataccgcgttggagtcggtgaagtttcagactagtcttcatcgtcgcctccggtgccggtatcgtgttccagccatagatatcgaatatcggaaatggccaaggcacacatggccaatgcgggcagtagcattggcggaataatgtgaactatcgagcggtcaatcagattcagtgtggtgtagatgaaaccgacaattaccagaatgcccaccaaactgaccagcgcgaattgcatggccgcgctttgatgcatatcggaaagctcgtcgcgtcgcgggttctgccgtcggaatacagtcatgccccatacttcgccgccgatccacaacagcgccgcgatcgctgccacgattactccgagcaggttattgccaataagagccatcagcatgcaggcaatggcacctatggattcaaggatggcacgaaagcaaatataccgattaaaggtcatggccgtctccgtgaattatgcgagcgatattgaattgcatacgcaattataaagttagggggtaaccccttgtgtggtggttaggccaaccggcggaggctctttgcgtagaccgagaataatcgcaatcagtaattgttatgggcgatccagtagttgtacgctgcgacgatgccgccgtagcgctgctcgcagtagctgatgaaccacttgaactgggtcttgtagttggtctgccagtccgcaccggcggaagccatcttgctaccggggtaggcctgacccaagccataagcaccagacgtggggttggtggcggtggggctccaaccggactcgtggttgatgatgtagttcgcagcggtgaagtccgcttcgctatacccgttgtccaacagatactgatgcgcccaggactgcacttctccagccggaacagtggtgccgagatcggccgacgacggcgacttggtggaaccagtgcccactaggatcaccttatccaccggggccttcttgacccatgaggcgaatacgttggaagagacgaccttgtcgccggctcgcttgaccagcgaggtggtctccataatgcccttctggccctcggtctcgaccttttcctgacccttgggcaggctgctggtctccttgcgcacttcattgaaggcgatctcggtatcgttggtctccacatcggcatccgcgcgattaatggtgaccacggtggcctcggtgaccttggatttcagcgagggagatatggcatcatccgggtcaagcgtgatatcacccgtctccagcacgtccttgacggtggtcatgttggctttttcgccaagtactacgcgcgaatcgccattaatcttcaccgtaacgaacgtggtgttcttgtcggcgctgttgattgcgccacgagtggcagaacgggatgcggccgaatcggtggcggagaacgaagtgatggtggaaatcggcttcacatcatcagcatggtagaaactgcgcgacaccaatcccgccgtgccgagcagacctgccgcggccaccacagccgcgatcttcatccactggcgcttgttcaacggcctgagcataagggttggcttggcatgtctcgtcattgcgctccttgatcggatttcacactgcccaccatgataggcggcgcagtggatgaaggaaaatcaggctcaggcctgctggtcggcaccggactgggcggccttggcggcggccagatcgagtgccttggcctgggcgatcagatcgtcgagatcggcggcctgcagcgcgccggcctgctggaagatgacctcgccctgcttggcgatcatcagcgtgggcaccgcctggatgccggcggcctgggccagatcctggttggcgtcgatatcaaccttgacgaaggcgatgttcgcgttctccggctcgttggaggccgcctcgaaaatcgggccgaacgcgcggcacgggccgcaccaggtggcccagaagtcaacgaacacgatttcgttgtcggtgatggtcttctcgaaatcggcggaggtgatggcggtggttgccatgatgttcccttcttttgtgttttccttggcgtcgccgtacggccctcgtgcgtggccgccgggcgattgccttattcatgcaatacgtcttggcgcttggagccgtgcggttcgtggccgtcggctccctgctggctaccagcttcccagcaccacccaacatttgtgtcgtattttccgccgccggccaaacgtttcccaagatttcgctggaaggtgacgcgcggcgcgctgtgacgcgcaataatgggatgcatgccagtcatgaatgatgaagtgcccgacgagggcgattatgatgccggccgtggccgcggcgaattcgacaacatcacgcccgaggacttcatccacggaggcggttctggccatggcaacccgccgggctggctggggccgtccgacatcaaccgggcgcgccatcagatgcccatcgcgtatgtggagatcgtgcccgtacgcaccgatgagatgggccgcatctcccaggtgggctcgctgctgcgcgtatccgatgacgggtcgatcgaacgcacgctgatcaccggccgtgtgctgtaccacgagacgctgcgcgaggccatcgcccgcaatgtggccaaggacctgggcgacatcgccctgccgctgctgccggtcggactccagccattcaccgtggccgaattcttccccacgccgggactgagcgaatactacgatccgcgccagcacgccatcgccctgtgctacatggtgcccatcgccggcgactgcaagccgcaggacgagacgctggatgtggaatgggtggatcccaagagcgacgtaatgaacacgttcgtggcgcagatggtcaacggccacgggcgcatcgtgcggcaggcgttggcctgggccggaatctgacagttgttttgccttccgttggcggggatggcgcgtagcgacggagggcggtccgctttgagaccgctcccagccgactgtgtcgacagctccgccagtggggcgcgaatgtgaaggagtaacgacaatggcaatcgaattggccaatcatatctaccgcgacggcgaaggcgtgccggtggtgctgatgaacgcctacccggtggaccaccgcatgtgggacgtgtgcgcgaaggcgctcgccgatttcgccgacctgaacgatgtgccggacttcccgatttgggctccggacatggccggctccggcgcatccccggtgccgagcgacgccgattcgggcccccgcatggcgaacggcgcgtacagcgaggcgttggatcgcctggccggagcctacgtggacctgatcaaggccgccggctatgagcaggcgatttgggtcgggctgtcgatgggcggctacgtggcgatggacatccagcgcctgtaccccgaaacggtggccggactggccttgtgtgacacgatggccgcgtccgacggcgtgggcggagagaaccgactgaagatggcggacgccgccgaacagacgaactcggtcgaaccggtgatgcacttcgcgcagccggccgatggcgattccaccgtcaagaagactcctgaattcatcgcgaccatgaccggctggatcaacgaacagaacccggctggtctggcctggcgtcagcgcatgacctacggacgtcctgaactggggcggtgccggaaacgatcagcgcaccgagcctggtggtatccggcgaactggacccctccagcaatccgagtgtgatgcggccgctcgccgaacgaatcaccggcgctgaattcatcgatattccggactgcggccatttcagtgccgtcgaacatccggataccgtggcgcgagcactgctctcgctcgtcaagcgcgtgcagagcgcgcagaagaacgcataggagacttcgatgaccgctgacattcatttctcgcctctggcactgacccatgcgctgccgttcctgccgctcgcacaaggtgacatcgactatcaggtggaccggcgcagcgaacccggcctgatcgacgagctgttggccgagccgaccaccaaagtcgtgcttacgcgcggcggacttgtcgccgtaccgcgcggccaaggcgagcttgtggactatgagaacgtgaaaatgcggctcgccacgttgccgggcgcctatgtgtccgccgaactggcacgctaccccgaagcggtcgccatgttccttggctcctatgtcggggcgcgcggcgaatccgtggtcgccgtggatatcacgcgcgtgccggaagccggcgttcccggtgttggcgggattgccggtgttggcggtgccgtcggcggcgtgctcggcacccaggattccggcactgtggacggcgcgctgggcaagaacggcatcagcggaggtgctgccgccggaatacggcagccgggaaacgccaagggtaatggcggcgtagccgcagccaaaatcgccgggccgctcggtgtaccggattcggccgggcaaggtgcggacgatgccttcgatgattcggtcggcgcgcccgtacagcccttggccccgaagcccacgctgctgcaacaggccgtgacccggttcgactgggtggacctgcgcggatttgcccctcactccaacgcgcgcgaggccgggcaagccaccagtgccatcaccttaagcatctggcacagccgccagcggttctgtcccacctgtggcgcggcggtccggccggcgctcgccggatgggcgcagcgatgcaccaacgaggcggacggcaaccgtgtgctgttcccgcgcgtggagccggcggtcattaccgccatcgtggacgggcacgaccgtctgctgctgcaacacaacgcggcatggaaggattcgaggctgtattcggtgtccgccggatttgtggaggcgggggagaaccttgaacacgcctgccgccgcgaggccatggaagagaccggcatcaagcttggcgaggtgcggtacctgggttcgcagccgtggccgttcccggcttcgctgatgatggcgttcaaggcacatgcgatcaccaccgacgtgcgtgtggacggcgaggagaccatgaccgcgcgatgggtcacacgcgacgaatacacggccgagctcatcgccggccgtatggtggcgccgggccgcgccaccatcgcccgctacatgattgaggaatggctcggtcgcgagctgtgacggaccgcgaagataggttaggcttatgactatgagtgatgacaacgaaaacgaacagccgctgaatctcgacattcccgaccacctcgaatactccgaggagcatgcgtgggtggaccgttcggtcgaccccgcaatcatcggcatcaccgaatacgccgccgaccagcttggcgaacttgtgttcgtggatctgcctgagcctggcgcccgtgtggaggccggcgacgagatcgtggagcttgaatcctccaaggccgtccagccgctgatcagccccgtggcgggtacggtcaagtatgtgaaccgtgacgtggcggacgacccgtccgtggtcaacggcgatccgtacggcgaaggctggctgctgaaggtcgagcttgacgacgatgagccggagctgctgagcgccgacgaatacgcgaaggtcgtgcggtagttccttttgagctcccctctctgaggggagccaagaaaatgaggcgtatggcctatattggtgtctatgagaagcccacgcgaggattttgaggcggcaggcaagcgactgccttgggatgctgctgcttgcaatgcagcgctgtccgccaccgcgccagtctctgacgtcaaggcatccgccaatggtgccgacaatgccagcaacgctgaacattccgatgacatgcccaccgtgccgattcccgcacgcaaggctgccacgacgttcgacaccccctccaagcgtgagcgcatcgaagtcaagccgccgatcacccgattcatacgtcgtgccgtcacccgcgtgttcggtgtatggtcacgcatctccactcaggtggtgcgccaatgggactggtatccgcgagtggaaccctatgtgggttatggtaccggcgattactcgcgtctgatctgccgcacggtatacgcccccaggcacgcgcaatccggcgaactgatccgtggcatccgcggcatgcttgccatacccgcgccgcgcacccacgtgcaggccagcattgatgacatgccgctcaacaccgtgcagatcggtgtctccgaggtctatgacaaggtggaccgcacgcgcgatctcggcagcgaatacgccatctccgattccgccggatatctcgacctcgtggccgagcatcgtctggtgcccggcatccatcgcgtctcctacagcgtggccaaccgcaaacccgtgagcgccaacctgtacaccatccccgccagtgccaaagtcggcatcatctccgatgtggacgacaccatcatgatcacgcaggccccggtgccatggaaggccgcgtacaacctgctgttcctcgaccccaagaagaaagcctccgtgccgggcatgagcgtgctgttcacccgcatcgccgacctgttccccggcgcaccgttcttctatctttcgacatcgccctggaatgtggagagttcgattcgcaacttcatcactgaccatggttttcccgaaggcccgctgctgctgcgcgacctcgacccgaggcccaagaccttcgtacccaccggcccccagcacaaacttgagtttgccgaacaacttatggccgacttcccagacatgaagttcattctggtgggcgatgacgggcagaaagacccgaccacgtacgccaccatcgcccgcagatatcccggacgtgtactggcgatcgtcattcgtgagttgagcccgcgcgaatcaaccggattggcgtcggtgacggggctcacctcgacccagccgactccggtaaccgatgtgccagtattcaccggcaccacaggctcgaacattctgaagaccatgctgccgtatctgaagacggtgttgcgataggcgcggcgtgatgaacactgaatgcgtcccggtgcggtgcctcgcctataatcgcgtggtatgactgacgagagcacaaacgccgcggccgcgatgccgccttacgccaagcgcgagccgaagcgccgcgaattccacggtgacgttttcgaagacgattacgagtggatgcgagacaaagactccgatgatgtgcgcagctacgtagctgccgaaaaccagtactgcgagcgtcgcatggcgcatctggcggatttccggcatacgttgtttgaagagctgaaatcgcatgtggaagagactgatatgtcggttcccacgcgcgtcaatgattactggtacttcacccgcacgcagcagggcaaacagtatggcgtgcaatgccgcatccccgtgcgcgatgccgatgactgggacccgccggtcgtggatccgcaaggcgcgcccggctccatgcccggtgaacaggtcgtttttgatgcgaacaaggaatccgaggggcatgacttcttccggctcggcggcttggatctgagcaaggacggccgttggatgctgtacggcgtggatgttgcgggagacgagcgatatgatttccgcattcgcgaccttgccgggctggagaccggggagccggtcagcgaactgcccgaacagttcaccggcattggcagcgcatgcttcacgccggacggccaatgggtgttctgggtggaattggacgattcctggcggccgctcgctgtgtggcggcatcgtgttggcacggcggtcgaatcggatgtgtgcgtgtaccgagaaaccgatgaacggttctgggtgggcgttggcatcagttttgatgagcgcaatatcgtgatcggcaccggttccaaaaccaccaccgaagtgctgatgctgccggtggccacgcctgaaggcgaattccaagctttcattccgcgtcagaacgatattgaatatgatgtgagctttgcctgttttgaaggcgcgggggagaacggtgcggatgtgccactcgccgtggtctatcacaacgctgccaatccgaatttcgaaatcgacgtcattgacatgcgtggccatgagccgccgtaccgactcggcgaaggcgtgtgcattgccgccgggtcgccgtacggctgtgaacatggtgagccggataagccgattaccgaggcatacttcaacgccgtcaatccggcgatattgcagggtgcccacggtctgggcatcgaaggcatcgcgttgcatcgcaactttgtgtccctgagctaccgtgccgacggccagccgcacgtggcatacatgaccaagagcgcggctgccgccgacttcctggccggacggccgtggcggtttacggaattgctgccgcctgccctggaggacgactgggacatggttgccgacgatcgcgaaaacttcaccggcgatcatggcgaaatcttgtggaccgaagatgaggcccccacggatcacacgtcatcttccgatggtgctagcgacgaccacctgcccggtgagacccggcgcttgtacaccatcggcgtcggcggcaacccctcgtatgaggcgccgcgcatgcgctactcgttcgccagctacacccgcccgggcgagttgcacgaaatcgatcccgccaccggtgaagatgcgctgctgaagcgagccaccgtgttgggcaacttcaatccacgcgattacatggaacgccgtgtgtggattaccgcgcgcgacggcgaacgcattcctgtttccctcgtctggcaccgcgattgcccggcgcaggattcgccgatgttcattaccggatatggtgcatacgagatttcctccgatccggggttctcggtctctcgtctgagcatgttggatcgcggtgtgctgtacgccgtgccgcatattcgtggcggcggcgaaatgggacgcgcctggtatgagcaggggcgcagactgaacaagaagcattcctttgaggacttcgtggacgccacacgcgcgctgcagaaggcgcatttggctgatgcttggcgcaccgtggccaacggcggatccgctggcggcctgctgatgggcgcgattgccaatatggcgcccgaatgctacgccggtgttgaggcggatgtgccgttcgtggacgcgttgacctccattcttgacccggacttgccgttgaccgtcaccgaatgggacgaatggggagacccgttgcatgaccctgaggtgtatcagtacatgaagtcgtacacgccatacgagaatgtgccggtcgccgtgctcgagggcggcaacgacgaggctgccggtgacggcagtgctgatggggcggccaccggcgcggtcgccgccgcgcaattcccgagaatcttcattaccacctcgatgaacgacacccgcgtgctgtacgtcgagccgctcaaatggctggcccgtttgcagtccgccggcgtggacgcggtggccaagattgaggtcgaggccggtcacggcggtctatccgggcgttacaagcaatgggaagaggtttcctatgagaacgcttggtgcatggatgtgatggggctcgctcattaggccatgtccactagctgagcgggttcgggccggcaggtgatagcgcgagtaggctccttgaactatggcaaagacatataaaatcgccgttattcccggcgacggtattggcaaggaagtcactccgtgggctcagaaggctttggaaaaggccgctgaaggcgtagctgacttcgagtacgagaacttcgacttgggtgccgagcgttatctgcgcgatggtgcgattctgcccgaggacgaagaggagcgcatcaaggccaacgacgcgattctgctcggtgccgtgggcgatccgcgcatcaaggccggcattctggaacgcggcctgctgctcaagctccgcttcgacctcgaccagtacgtgaacctgcgcccctccaagctgtacaagggcgtcacctcgccgctcgccaaccccggcgacatcgacttcgtggtggtacgtgaaggcaccgaaggtctgtactgcggtgccggcggcgcggtgcgccgcaacaccccgcaggaggtggccaccgaggtgtccatcaataccgcatacggtgtggagcgtgtggtgcgttacgccttcaagctcgctatgaagcgcaagaagcacgtcaccctggtgcacaagaagaacgtgctcgtcaacgccggtgatatgtggcagcgcatcgtcgacaaggtcggcgaggaataccctgaggtcacccacgactaccagcacattgatgcggccaccatcttcctggtctccgacccgagccgtttcgatgtgattctcaccgacaacctctttggcgacattctgaccgatgaggccggctccgtggtgggcggcgtgggctactccgcctccggctgcatcaacgcctccgacgagttcccgtccatgttcgagccgattcacggttccgctccggacatcgccggtcagaacaaggccaacccgaccgccgccatcctctccgccgccatgctgctcgagcatctcggctttgatgatgcggccaagaagatccataccgccgtcgaagcggacatcgaggagctcggctccaccgtgcgctccaccgaccaggtcggcaaggacattctggcccgcatgtgacctcaaacctggctcccctcgctgaggggagccagaaaactctctatactgagttgcatgcaaatgcgacatggggaatgcaaaaccgttggcagcaaactagtcgccgtgaccgtatccgtcgatgatgacggcaccgcacagtcatgccatatcagcggtgatttctttattgaatcagtttcggatgccgaatcccatgctttgttgcatgacctggaacgagctctaattagcgatgattcattgcggtccgtattggacgctcatcctagttgccaaattatcggcacagatgaagttgccatcaaaaccgcatacagccgagccgtaagcagcaacttacccccgctggcgggggctccagcgcagcgggtggggtgggcagccccgatgcgccgaacatcccagcatccatcaatacacaaaccaagcagcccgacaaaagctctgaataccgggagcgctggaacgccctcaagcctcaactcaccgtgatccacgaccatccgcgtactccggacgagcaaatggccattgacgagacctgggcgcgtgaagtcgcagcaggaacacgacagccgaccatccgattatgggagtgggcgggcccggctgtggtcatcggccgtttccaatcggcccaggacgaggtgaatctggacattgccaagcagctcggcttcgacgtggtacgccgttgcacgggtggcggagcgatgtttatcgaaccgggcaacaccattacctattctctgtatgcgccgctcgatttcgttcagggcgtaagcatcgaagaatcctaccggctctgtgactggtggctggtcgaagcgctgcgcgaacttggcttggatgtgcggttcgcgggcctcaatgatatcgcctcgcagtacggcaagatcgggggagcggcgcagcggcgcttccccgtaggctcaggcggcgcggtgctgcaccatgtgaccatggcgtatgacatcgatgcggccaagatgagccgtgtgctcaacaccagtcgcgagaagatgtcagacaaagcggtgaaatcagcggtcaaacgcgtggacccgatgaaaagccagacgggtctcagccgcgaacacatcgtcgagcaccttattgactggtttgcggcgtgatttcaccgatggccgtatacgattttgccggtggccgtgcgcggttttgtcatgggcgagcgcggtagccgcgacagtgccgtttttcgcggtaacgcattcgtcagcatgtcgtacggctatcggatcgtgccacacatgaagtgacgaatgagggcatgctcctgacgaaacctgtggggcgcgttacaatatgacggatgggcgacgacggtcataggacaataaggatggtgcgatgagcttggaaacgccaaacgcttttgctgacgaggaaaacatcctgttgcatacggcattgttcaagcaggtatcgccagccgaagccgaggagctgttgccgcatttgaagcatgcgacgttcgataaaggcgactatatcttctccgaaggcgataccgatcagcgcatgtatttactggagcaggggcgcgtcaagctgattcgcacttcttccgatgaccgcgtgcagctgctgtccatccacgcgccgggcgaagtgcttggcgagattccggtattcgaccctcatggtggcccgcgcaccgcgtccgcggtgtccatgagccatggcacgcgcgtggtctggctggagcatgatgccctgttcgcatggcttgatgagcatccgcgtgtggccatcgacatgttgcaggtcatggccagccgccagcgcggcaacaacgaacgcatctccgacttggtattcatggatgtgccggcgcgtctggccaagacattgctcaacttgggctcacgtttcggcgagccggtggaacagggcctcaaagtgccgcatgacctgactcaggaagagctggcccaactggtgggctccagtcgtgagaccgtgaacaaggcgttgatggacttttccaaccgcggatggatcgcacgtgacggccgatcgatcatcatcttccagcccggtatgctgattcgacgctcgcggcgctgaccgttcggctgacttccagccaatgttacgctagtgcgattcttgtgatgatatgttcacgggagctgaccgtaagcccggttggtagggcaccccatttagaatggggcccatgcccaaaaagaagtccctcactctccaacgtgtgcttgttctcctcttggcctatatcatgcttgccgtctgcggcggcgtggcggccagcgtgttgtttgtaccgggtgtgatcggtgccaataaagccgccaaagcggtgattccgtcgctcaaggtagaaaacgtggacttcgacgtgactagtctgccccagaagtcgacgatgtacgcgcgagacggttccaccgttatcgcgacgttctacaaccaaaaccgtatcgtcgtgccgctgaagaagatttccaaaaccatgcagcaggcagtggtggcgcgcgaagaccgtcgattctggactcacgccggcgtcgacgtgcaaggcgtgatgcgtgcgttcgtgcagacctacctcgtcaaaggctcccagcagggtggttcgtcgctgacccagcagtacgtcaagaacgtgctgctgatgcaggcgatcgaggatgacgattcgatcgcccagtaccatgccactgaagacaccatcgcccgtaagattcgcgagatgctgatttccgtgcagatggaaaagaagtattccaaggccgagattctgcagggctatttgaacatcgcccagttcggcaacaacctgtatggcgtggaaaccgcggcccagcgctacttcagcgtgtccgccgccgatttgaacgtggtgcagtccgccaccatcgcggctatcaccaagaacccaagcctgtatgatccgctggtcgaagagaaccagaaggaaagcgaaaaccaacgcaatatcgtgctcaagctgatgctgcaggaaggatacatcacccagaagcagtacaccgaagctgtgaacacgccgttgaaggacacgctgaaagcacaggacgtgaatgtcggctgtcaggacaccggcgattacgcgtacttctgcgattttgtggtgcatcgcatccagaactccgaagaattcggcaagactcgtgccgagcgtaacaagctgctgcaggagggtggcctgaaaatcgtcaccacgctggatgtggaagcgaattccacgatgatggagaccgcgcgtaataccattccaccggacgatcccagcggcatggagatagccatggccgcagtcaaaccgggaaccggcgaagtgctgagctttggcctgaatcgttactatgacgccactccggcagccgcgaacgatcccaccaagacgagccagaactatgccgtcgatttggcggatggcggtggttctggttggaccatcggttcgtcctggaagccgatcaacctgattgcgtggatggaagcgggccattccatcaacgacaacctccagacctcgacgtcataccccactacggacttcgcctgcagtaactattcgggcggtgccgattcgtggaacgtgtcgaacgccatgggcgcaggtacagtgaacccagaaagcccattcctcggtctggtccgttcgcataacactactcaggcttccatgggtgccatcctcaaactgtgcaaggtggcggacaccgcgactgaactgggataccatgacgccgccacgggtgagaccatcgacaaaacccaggtgtatacaccatccatgatgatcggctcggtgaatgtgtccccgctgaccatggcgagcatcttcgccgtatacgcctcgaatggtgtgcaatgcaacccgattgccatcagcaaggtgaccgataaggacggcaacgatctcaaggttccatccgcgaactgccatcaggcggtggataaggacatcatccaaacactcgcttataccctgaaccaaggtacggtgcggccggatggtgccggttggtcattcagattggctgacgggcgtaagtcgtttggtaagaccggtaccagtgaggatcttgcggtgtccggtggatcgttcattcctaatcagattgcggcgttcgctgtggtcggcgatgcacagaacccgtacaccaaccgtatttccaacattgccatcaacggccggtacaacagctattgggatggttcgacaatcgcggctccggccgttaccaacttcttcaatagctacatttccaagaagaaaataccgattgacaacgattacggccagcccgtctcgaagtacaccacgactggcaagtatctgggcattggcggacgaacgttcagcgtgccgcagaccactacgaatggcaacagccaatcgcagagcagcaacaatcagtctcagtcgcagaacactgggcaaaacaacacccaaacccagggcaccaattcagagcagtcgaatgatggccagtgattggtgattggcgtttgacatttggtgattgcatgccggctgagtctgcgtaacatggccgactgcgatacccaaattacgtagtttgcgggcgttacctgtttcaggtgacgcccgttttacaatacttaatgacaacgccatcgcgttcatcgaatatttgccatgaacgtgcatcggaaaggggaacgatgagcaacgacgatctgacgcatgagaattttgattttcgtggattcgacgtgccggatctcaaagcggtgacgctggcttcgtcttcggacggcgatcagtccaagcagccgaagaccaagcacgaggatgcatcgaagaaccgtaagcacggtaagaagaagtcaaaatccgatgcacggtccaagaagcgggccggcgcgggcaagacgagcgaatcgttcgatgattatgaggattatgaggaaagggaagctgtgagcaaggcagataagaaagtcagcaaggaccgtccggggctgtttgcgccaatgacgctgcgcgaggtgaccgtgcgtaatcgtatttggttgccgccgatgtgcacgtattcgtcgttcgcccgcgatggtaggcccacgccgttccactaccagcattacgtgtctcgcgcgttcggcggattcggcatggtgattgtcgaatccaccgccgtggctcctgaggggcgtatcacgccgtgcgatctgggcctgtgggaagacgggcagattgatgcttggcgctggatcgtggacggtattcgcgaggcgggtgcggtgcctgccatccagctcaaccatgcggggcgtaaggcttcgactggttgctttgccgttggttacgacggtcagaacgtgccggaggaggcgggcggctggcctaccatggcaccgtctgaaatcgcgttcggtgggttgcgtacgccgcgcgcgctgtccgtggatgagattcatggtctggtcggcgcgttcgccgtggcggcgggccgtgcggtggccgccggcttccaagcgattcagattcatgccgcgcatggctatctgatttctcagttccttgacccgctgagcaatgagcgtgatgacgaatatggtggcgatttgaccggtcgctctcggttcctggtcgaggttgtggatgccgtgcgtggggccgtccctgagggcgtgccggttctggtgcgcatttcggccacggattgggccgccggcggttgggatttggaccagaccatcgcactatccaaggtgctgaaggagcatggcgtcgatgtgatggacgtgtctaccggcggcatcatgtcgggagtgtcgattccggtcaagccgaactatcaggtgccgttctccgagcaggtcaaggccaaggccgatattccggtgaccgcggtgggtcttatcaccaagccgaagcaggcggccaagattctggcccatggcgaagccgatgccgtggagattggccgcgccgcattgcgtgatccatactggccgttgcgtgcagccaacaagctgggcataccgtccaccgagatcccctacgccccgcaatacgtggccggtgcgtactaaatcctcatggggcggtaactttcccatggggcggtaaaaccctcatggggcggtaacccaaaacggcggtattctgcggaatgtgaaatttggctaaccgccccatgggacaatcaccgccccatgagggttttaccgccccatgggtaatagggcaatatgtgagttcactccacgtccacgccgacggcgtcggagacgtgctcgaatccgtcgcggcgcagcagctgggccagaccgcgcttcaacacggtaatctgctgcgggcctcggtacatcagcgaactgatgaacatgaccaagctggagccggaacgaatcttcgcataggcttgctcgggggtaaagacgccaccgatgccggcgatagcgaaccggtcgccatactctttatacaccttgcgaatcagctcggtgctggcgttggtgcacgggccgccggacaggccgccctcccaatcgcgcggaatctcgaggccggtgcggtccttctgcagattggcgatggacagcccctgcacattgtgatcggccagcacatcgagcagctccttgtactcgccccacggcttgttcaacggcatcttgaccagcgtgggctgcgggcggtcgatcttgtcgagcgccgtaaacagacggtcgagcgcttccggagtcgcggtgaacggttcgccgacgtgcgtgttcgggcaggagacgttgacctccaccatcgcggtgcggccggcggcgcggcgcatcgaaatgcagtaatcctcaatgccttcgtccaaatcgccgcactggtcgtcgttggtgcgggcgatcgacacagacagctgcatctggcgggcctgagtccaagccttctcggcgcgctcgatgaccttgtccgaaccgatgttggcgaggccgacgtgcaccatcatcgaatcgtattcaggcagacggtggaaccacggcttggcgttgcccgggcagggacgcgaggtggtggagcctacggtttcaaaaccgaagccggcatggtccagcaccacgggcatgtcgcagttcttgtcgaggccggcggacaggccgaacgggttggtgaaatcgacgcccatcacattcgtttccagaatggggtcggtgtagtcgagcatcagctgctcggcgagcagcagcggcgggacgttcttgacgacgtggcagaactcgatcatctgatcgtgtgcctcatcggggcggtggttgaacacgaagttcggtttgatgatgtgcttgtagccgaaggtgaacagatcggtggtggctttgttgacggcgtcgtgccagaagctttcagaaacgtaagtcataccgcctattgtctcacgcttgggctggtgcggctaggcgattcctgcctaggcgaattggggaaggggctaccgcgtgtcgaggcgcacgcaggcgtcggctcggcagaagatacatgaatcgggatgcaccaggtatcaggcgtgactcgccgctgagcaacgcgctcgggagagtcgtcggtcgtgagtcatcgcgctagtggtcgctgcgagaatatcggttcgcacaatgtgcgattttgcgcggttttgtggaaatgaacacctgaattgcccgggattttcgagagattgtccccaaaacgctcaagccggtttggtttgtgagcttttgtgtgcgataatgttcgcatgatttcgtcacaacgtcagcacctcatcttgagcaggttgcgcacacgcggggcagtgcgcattacggcgctatcgaaggaactgggtgtgtcggcgatgaccatccgccgcgatatcgccgaacttgccgacaagggactgttgaagcgcgtccatggcggcgcggtgactaccagtaccttgctcagcgaacccctgttctctgtcaagtctcagatggatatcggcctgaaggacgccatcgcccaggaagccatcaaatatgtggctcccggcgatgtaatcgccatcggcggcggcaccacggcctatgtcttcgcccagcatctgctcgaatcgcagcagtccagcggcatcaccatcctcaccaattcgattcccgtggccgagctggtccaggccctcgaatccaaggatgtggaggtgatcgtcaccggcggcgtgatcacccgatcgaactcgcttgtcggcccgatcgcggacaaggtcgtcgcttcgctgcgtgtcaacaccgtattcctcggcacccactcggtgtcgattccccgtggcttcctgatgccgaattcgctggaagccgcaaccgatatggcgatgatggacatcgccgatcgcaccatagttttgaccgatcacaccaagtggagctgcacgtcgctgtcgctgtttgcgcgcttcgaccaagtggacacggtcattactgacgacgggctcgaccccgactccgccgccaaaaccaaggatttagtaaaggagctcgtgctggcccaccagagcgagaccattgaggaaagtgagcaaacccatggctgatttcgccaactacacccccggggagtatgcgaaggagcacatccgcatcacgccgacgacgcttgccgacggccgtgacttcttctacctggacgacgaccccgagttcgtctccggtgccaagacccgcgagctcaaggacccgcgcccgctggactaccgtttcgccccgcacctggacgccgacggcaacgaagtgccgtacgccgccccgcagatgcgccgcgacccgctgaccggcgactggatcccgatggccaccgcccgtatgaaccgcccgatcaccgccggccccggcgccaccgccaagggcaacccgctggccgcccgcaagcccggtgacccgtaccaggacggcgaagtgccggacaccgactacaacgtcgtcgtgttcgagaaccgcttcccctccatggtgcgcgtgcccggcgtctccgaggacgtgacctacgttgacggcaacccgctgtgggagaagaagctcgccgccggccgctgcgaggtcatctgcttcgacccgaacgaggacggcctgccggccgatctgccggtctcccgcctgcgcaccgtggttgaggcttgggccttccgtaccgccgaaatctccaagatggaaggcatcgagcagatcttcccgttcgagaaccacggccaggaaatcggcgtctccctcgctcacccgcacggccaggtctactgctacccgttcatcgccccgaagatggagaaggaactccagcacaccgaggcctaccacgagaagaccggcggcaacctgcttaaggacatcatgaacgccgagctcgaagccggcgaacgcatcgtgatgcgcaaccacagctgggtcgcctacgtgccggccgccgcccgttggcccctcgaggtccacgtggctccggtgcgcgacgtgctcaccctcgaccagctcaacgacgaagaacgctgggacctcgcctccatgtactcgcacctcctgaagcgcggcaacgccttcttcgacaagggcgacggcaagggcatggacctgccatacatcgccgcctggcaccaggccccgatccacgacgcccgccgcgagaactaccgcctgaacctgcagttcttctccttccgccgcgccgccaacaagatcaagtacctcgccggctccgaatccggcatggccgcctggatctccgacaccacgccggaactcatcgccaagcgcttccacgagctcggctccatcgacatcgccgactgatagaaagaaaacatcaatgactgctgttgaattcattgagccgctgacccatgaggaaggcgtctcgcaagctaccaagctgttcgtcgacacctacggcgctgcgcccgagggcgtgtgggctgctccgggccgtgtgaacctgatcggtgagcacaccgattacaacgccggcctgtgcctgccgatcgctctgccgcaccgcaccttcatcgctctgaagccgcgcgaagacaccaaggttcgcgtcgtctccgacgtggctcccgacaaggttgccgaagctgatctcgatggcctcaaggcccgtggcgtggacggctggtccgcctacccgaccggcgtggcctgggcgctgcgtgaagccggcttcgacaaggtcaagggctttgacgccgctttcgtctcctgcgtgccgctgggctctggcctgagctcctccgccgccatgacctgctccaccgctctggctctggacgacgtgtacggccttggttacggcgattccgacgccggccgcgtgaccctcatcaacgctgccatcaagtccgagaacgagatggccggcgcttccaccggtggtcttgaccagagcgcctccatgcgttgcaccgaaggccacgcgctgctgctcgactgccgcccggagctcaccccgctggagaacgtctcccagcaggagttcgatctcgacaagtacaacctcgaattgcttgtggtcgatacccaggctccgcaccagctcaacgatggtcagtacgctcagcgccgcgccacctgcgagcaggccgcgaagatcctcggcgtggccaacctgcgcgtcaccgccgacggcatcgccaaggccgacgacccgttccaggcgctcaaggagacgctggacgcgctgccggacgagacgatgaagaagcgcgtgcgccatgtggtcaccgagatcgagcgcgtgcgctccttcgtgcgcgccttcgccagcggcgacatcgaggccgcgggccgcctgttcaacgcctcccatgattcgctggccgcggactacgaggtcactgtgcccgagctcgacgtggccgtggacgtggcccgcaagaacggtgcctacggtgcgcgtatgaccggcggcggcttcggtggctccatcatcgcgttggtggacaagggtcgttctcaggaagtcgctcagaagatcgccgacgaattcgaaaagcaaggcttccacgcaccgcgcgcgcttgccgcgtacgcggcgaaatccgcttcacgcgaggcatgataataaatcacaatgctaaatggcgggtgtcttccctatacttgggtagtcacccgctttttgtatacgaccagggagagccatgaacaaggcaatcatcaccgtcgtcggtcaggacaccgtcggcatcatcgcgcgagtctgcacctacctgtcccagcacaacgtcaacgtgctcgacatctcgcagaccatcatcgacggttacttcaacatgatgatgattgtcgactacgccaacgcggacaaggacttcggcgcgatggtcggcaaccttgaggacctcggcgacgacatcggcgtgcgcatccgctgccagcgtgaggaaatcttcaccaagatgcaccgtatttgaggcggcccgctcagcaggccgcctcacgcgaggaggtggaaagcccggtgggctttccactgacggagccatccttatccctctgatgagggtgaccgccaaactagtctttaaatatcctgtaaggaacaaaccatgctgaacatcatggaggtccacgagaccaatcagatgatcgagcaggagaagctcgacgtccgcaccatcaccatgggcatctcgttgctcgactgcgcctcggacgatgtcgacaagacctgcgacaacatctaccgcaagatcaccacctatgccaaggacctcgtttccaccggcaaggccatcgaacgcgactacggcatcccgatcgtcaacaagcgcatcaccgtcaccccgatctcactggtcggtgccagctcctgcaagacgagcgaggatttcgtcaagatcgcccacgcgcttgacaaggcggccaaggaagtcggcgtcgacctgatcggcggctactccgcactcgtttccaagtccatgaccccggccgaggagctgctcatccgctccctgccgcaggctctctccgagaccgacatcgtctgctcgtccgtgaacgtcggctccaccaagaccggcatcgacatgaacgcggtcgaactgctcggccatatcatcaaggacgttgccgagcgtaccgccgacaacgactcctacggctgcgtcaagttcgtggccttctgcaacgtgcctgacgacaacccgtttatggccggaggcttccacggcgtcaccgagggcgacgcggtcatcaacgtcggtgtctccggccccggcgtggtctcccgcgcactcgatgcggccaagggcaaggacttcgagttcctgtgcgagaccatcaagcgcaccgcgttcaagatcacgcgcgtcggccagcttgtggcccaggaagcatcccgccgcctcggcattccgttcggcatcatcgacctgtcgctcgccccgaccccggctgtgggcgactccgtgggcgaagtgctagagaagatcggcctcgaacaggtcggcgctcccggcaccacggcggcgctcgccatgctcaacgaccaggtcaagaagggcggcatcatggcgtcctcctacgtgggcggcctgtccggcgcgttcatcccggtctccgaagacaagaacatgatcgacgcggcttcttccgattgcctgaccatcgagaagctcgaagccatgacctgcgtgtgctcggtgggcctcgacatgatcgccattccgggcgatacctctgcttccaccatctccggcctgatcgccgacgaggccgccatcggcatggtcaaccagaagactaccgccgtgcgcgtgatcccggttgccggcaagggcgtgggcgagatggcgaacttcggcggcctgatgggctacgcgcccatcatgccggtcaaccagaccagctgcgaggcctttgtgacccgtggcggtcgtattcccgctccgattcacagcttcaagaactgattcagtagggtatctgccttcaaagaggtacatttgcgcagataggtatctgctttcagaggggtacctcaatcaagaaaccccgagtacaagcgttgatatttcaacgcctatactcggggtttcgtcctttaacagcccctcgaagcggcaatagacctccggcagatgccaaatcagcccctcgaagcgccgatagacccattttctgcgatgatggtcgtgctgcgaggctcagggtttcctctctcacgcctgtcggcgttcgttcggcgtcgctactcgaaggcccaccgggccttctcctcagcgccctccagcgaagttgagttggcgccaggcttcgtagatggcgatggacgcgcaattggtgaggttcagggaacgcaaggacgggcgcatgggcagtcgcacttgttcggccacatgagggccctccatgatgtccatcgggtcggggatgtcgccgggctcggggccgaacagcaggatgtcggtcggcttgtattccacctcggtgtacagcttggtagcatgtgcggtgaacgcgatgatgcgcgaattgggcatggactccaccaggttgtcgaaattcgggtgcagcaccacgtgggccatgtcgtggtagtcgaggcctgctcggcgcagcttggtgtcgcgcaggttgaaacccaacggctccaccaaatgcaggatggtgccggtcaccgcgcacaggcggatggccgagccggtgttgccgggaatgcgcggtgagtagtagcacagatgcggtgttacggtttcggtggtggcggccttttcagccgagagcatctcgtccaccacggagatggggttgccatgcgcgtcggttacgagttcgtccggtccgtaattcgatttacggtacccgtactcgaacatcttctcgacttttgtttcgggattctgtgcgttctgcgaattctgttctgcttcgttcgtcatagctgctaagaataagaacgatgaacgacacagcaatttctttgcgattgggcgcatggtgggaggccaatgcgcgcgatttgccatggcgcttcggccgggccacgccgtggggcgtgctggtatccgaagtcatgagccagcagacgcagatgagccgtgtagtgccgtactggaccgactggatggaacgttggcccgacgcccgcgccctcgccgaggccccaaggccgaggtgatcaccgcatgggggcggctcggctatccacgccgcgcattgcggttacaggaatgcgcccgcgtggtggctgaagattacgccgacaaactgccgcgcacgtatgacgaactcactgcattgcccggcatcggcgattacaccgcctccgcggtgatgagctttgcgttcggcgaacgaattgccgtgatcgataccaacattcgccgcgtgctgagccgcgtgttcctgggcgtcgaatcgcgcgggggagcgaccagcccggccgaacgcgcgctggcgaaccgcatgctgcccaaagacgagattctcgggtgcgatgctgacgtcgccgataatgccggtagcgccgaacatgtcgtgaacagcactatccgtggcggcaaacgctctcgactgcatcgtggcgagcgcccatcggtcacgtggaaccagtcggtgatggaactgggcgcggtgatctgcacggccaagtcgccgctgtgcgacacctgcccgattgcggacgactgtgcatttctcaaggccggccgccccggactgggggagcgccgcacccgcccacgccaacgattccaaggcacggatcgacaggtgcgcggtctggtgctcgccgcgctgcgcgagcttcccgctggagccacgttgcccagggaagatgccgacaagctttggaaggaccagattcagcttgccgcctgcatcgccagccttgacgatgacggcctgatagagattctggacggcggcctgcgactacccagctgacattgtgaaaaatggtgggctccccaagcgtgtatgggcgtggtgaccgtagactggaagagttatggcagtgcagaggaacacatcaggcgcgagaacggcacgcggagccggcaccggggccaatgggccatccggcgggccctcccaaaacaaccgttccggcaagccgcgcaagcgcaggatcagcaaaaagcagcaggccatctatcgtcgtcggcgtatcgtggccggtacggtgctgctgctgataatcgcgctgattgtattctgcgtgtatagccttggccggggtatcggtgccgtgaactcgatgatccaccatgacgaggtgtatgcgatttcccgcgacgccacgccggcgccgaagaaagtcagcaacgtcaaggattgctcggccagtgatgtgacattgcagctttccgcggcctcccaatccgtgccggtaggaggatcgcttgatttcaccgcgaccatcgtgcacgaggggtcaggcaactgtttagtggacgggtccgattccggccgtgtgctcaccattacttccggtcaggaaacgatttacaagtccgatgtgtgcccggcggattcacgtctgctgctgatggctaagggcgataaggacgttcagaaggtcacgtggaataccaatgcgaacgccacgctcgccaaatgcacggatgagtcaggttgggccaaagtcaatgcgggaacgtacgtggcgcagctgagtttgaaggatcatccgaaggtgaagagcgatccggtgacgtttacggtgcagtaaaagtcttgccttagcgctattcttttgactttgcatgaggtgtgtcatattgcgggcatgccgtcgacaatgaagcgtccgcataggcatatggtggccatgccggcgctcccaggggaattaccacatattagcgagcgataaggaacgtccattggctactgagtctacgacgaacaccaccaccatcatcgcacgcgccgaccagcatgatattgacctgcacaaggcgtcggatcgcgtgaacttcggttccatcaaggaacccatcgatgtgccctacctgctgggcgtgcagaccgacagcttcgattggctgatcggcaacgaacgctggaaggcgcgcgtcgaggaggacgaaaagaacggcactaacaccgtggcccacacctccggcctcgatgaggtcttcaacgagatctctccgatcgagaacttcgctcagaccatgagcctgaccttctccgatccgtacttcgaagagccgcgtcacaccgtgcaggaatgcaaggagaaggattacacctactccgcaccgctgtacgtgaatgccgagttcgagaacggcgacaccggcgagatcaagtcccagaccgtgttcatgggcgatttcccgctgcagaccccgcacggtaccttcatcatcggcggcaccgagcgagtcatcgtctcccagctcgtgcgttccccgggcgtctacttcgaccgccagcaggatcgcacctccgataaggaagtcttcggcgcgaagatcatcccgagccgtggtgcatggctcgagttcgagatcgataagaaagaccagccgcaggtgcgcgtggaccgcaagcgcaagcagtccgccatcgtgttcctcatggccatcggcatgaccaagtccgagatcgcccaggcattcaaggactacccgctggtgctcgacgcactggagaaggaaaccctcgagacccaggacgaggccctcgttgacctctaccgcaagattcgtccggccgacaccccgacccccgaggccggcaagaatctgctggactccttctacttcaacaccaagcgctacgatctggcccgtgttggccgctacaagatcaaccgcaagctgggtgtcgaggccgatttcaacgatcgttccctccaccaggaagacatcatcgccacaatcaagtacctggtggccctgcacgacggtgcggcgaccttcccgggcaagcgcaacggcgaagacgttgacctgcgcgtggacgtcgacgatatcgatcacttcggcaaccgtcgtatccgccaggtcggcgagctgattcagaaccagctgcgtaccggtctgagccgtatggagcgcgtggtgcgcgagcgtatgaccactcaggacgccgaggccatcaccccgcagtccctgatcaacatccgtccggtgaacgccaccatcaaggagttcttcggcacttcccagctctcccagttcatggatcagaacaacccgctgtccggtgtgacgaacaagcgtcgtctttccgcactgggccccggcggtctgtcccgcgaccgcgcctccatggaggtgcgcgacgtgcacccgtcccacttcggccgtatgtgcccgatcgagtctcctgaaggcccgaacatcggtctgatcggctccctggcaaccttcggccgcgtcaacccgttcggcttcatcgagaccccgtaccgcaaggtcgtcaacggccacgtgaccgacgaggtcgagtacatgaccgctgaccgcgatcttgaccacgtcattgcccaggccaaccaggagctcgacgagaacggcaacttcgtgcagaagtccgcccttgcccgagtcggcgaagaagaggcggtcgatgtgccggtgagctccgtggactacatggacgtctccccgcgccagatggtctccctcggcgcctccctgattccgttcctggagcatgatgagggccaccgtgcactgatgggtaccaacatgcagcgtcaggccgtgccgctgatcgaatccgagcgcccgctggtgggcaccggctccgaatggcgcgccgccaacgactccggcgacgtcatcaagtccgagaaggacggtgtggttacctacgtgtccgccgacctgatccgcgtgatgaacgacgacggcaccaccagctcctacaagctggccaagttccagcgctccaaccagaccacctgctacaaccagcgcccgatcgtccacgacggcgagcgtgtggaagccggctcggttatggctgacggccccgccatccagaacggcgacctggccctgggcaagaacctgctcatcgccttcatgccgtggaacggctacaactacgaggatgctgtgatcatctcccagcgcctcgtgcaggacgacaccctctcctccatccacatcgaggagtacgagatcgacgcccgcgaaaccaagctgggcgccgaagagatcacccgcgacctgccgaacgtcggcgaggacgctgtggccaacctcgacgagcgcggcatcatccgcatcggcgccgaggtcgaggccggcgacatcctggtcggtaaggtcaccccgaagggcgagaccgagctgaccccggaggagcgcctgctgcgcgccatcttcggcgagaagtcccgcgaggtgcgcgacacctccctgcgcgtgcctcacggcgagaccggtaccgtcatcggcgtcaaggagatcacccgcgaggatgccgaggaggacggcgacgagctgcccaacggcgtcaaccagatgatccgcgtctacatcgcccagcaccgtaagatcacggtgggcgacaagctctccggccgccacggcaacaagggctgcatctcccgcattctgccggaagaggatatgccgttccttgccgacggtactccggtcgacatcatgttgaacccgctgggtgtgccttcccgaatgaacctcggtcaggtgctcgaactgcaccttggctggatcgcccactccggttgggatatctcccttgacccgaacatggaagccgagtggaagaagctgattccgtccggtgccgagaaggccgagccgaacaccccggtcgccaccccggtgttcgacggtgtcaagcccgaagtcctgaagggcctgttgtccaccacgctgccgaaccgtgacggcgaccgtctggtcggccccgacggcaaggccaccctgttcgatggccgtaccggtgagccgtacaccaagccgatttccgtcggctacatgtacatgttgaagctgcaccacctggtcgacgacaagatccacgcccgttccaccggcccgtactccatgatcacccagcagccgctcggtggtaaggcccagttcggtggccagcgcttcggcgagatggaggtgtgggcccttgaggcctacggtgccgcctacacgctgcacgagatgatgaccaccaagtccgatgacgtcgacggccgcgtgcgcgtctacggtgccatcgtcaagggcgataacctgccgccggcaggtatccctgagtcgttcaaggtgctcctgaaggaaatgcagtccctgtccctgaacgtcgaagtgctcaacgccgaaggcgtggccatcgacatgaaggatgaggatgacgatccggccagctccgctgacgacctcggcttcaacattggcgcccgccccgacgcggccgccaaggaagaccagaaggccgaagagcccgaataccagtgatccctcgggctgcatgcggtcaatacgccgcgtgtagccccgccaacgtgaaatagataacgtacagagacctttccggtttgcactacccctcagtcagccttggctgacagctcccctgacaaggggagcttgggaaggtctcaagaacagaaacggattaacaagtgctggacgtcaacgcatttgacaagattcgcatcggccttgccaccgccgatgacatccgtggttggagccacggtgaggtcaagaagcctgaaaccatcaactaccgtacgctgaagcctgagaaggacggtctgttcggcgaacagatcttcggcccgacccgtgactgggagtgcgcctgcggcaagtacaagcgcgtgcgcttcaagggcatcgtctgcgagcgatgcggcgtcgaagtgacccgcagccgcgtgcgccgtgagcgcatgggccacatcgagctcgccgccccggtgacgcacatctggttcttcaagggtgtgccttcccgcctcggctacctgctgaacgtcaccccgaaggatctggagcgcgtgatctacttcgcctcctacatggtcaccgaggtgaacgaggacgagcgtcacaacgatctgcccggtctgcaggacgagttcgattccgagatcaagcgccttgagcagcgccgtgactccgacatcgaagcccgcgccaagaaggtcgaagaggatctcgccacccttgaggaggccggtgaggccaagggcccggcccgcaccaagctgcgtaacggtgccgagcgcgatatggccgccatccgcacccgctacaacgaccagatcgcccgtgtggacgccgtcttcgacaagttcaagaagctcaagcccggcgacatggtcgacgacgtggacctgtggcgcgagatgcaggaccgctacggcgattacttcgacggctgcatgggcgccgaagccatcaagaagcgcctgcagtccctcgacctggagaccatctccaaggaactgcgcgaggagatcaaggacgcttccgagcagcgtaagaccaaggctctgaagcgcctcaaggtcgtcaacgccttcctgaccaccggcaacaagccggaggccatggtgctcgacgtgatcccggtcatcccgccggacctgcgcccgatggtccagctcgacggtggccgtttcgccacctccgacctcaacgacctgtaccgccgtgtgatcaaccgtaacaaccgtctgaagcgactgatcgagctcggcgcccctgaaatcatgctcaacaacgagaagcgcatgctccaggaagccgtcgactccctgttcgacaacggccgtcgtggtcgcccggtcaccggtgcctccaaccgtccgctgaagtccctgtccgacatgctcaagggtaagcagggtcgtttccgtcagaacctgctcggtaagcgagtcgactactccggccgttccgtgatcgtggtcggcccgtccctgcgcatgcaccagtgcggtctgccgaagccgatggccctcgagctgttcaagccgttcgtcatcaagcgcctcgtggacctgaactatgcgcagaacatgaagtccgccaagcgtcttgtggaccgcggcgacgccgaagtgtggggcgtgctcgaggaggtcatctccgagcaccccgtgctgctcaaccgtgcacctacgctgcaccgtctgggtattcaggcattcgagccgatcctggtggaaggcaaggccatccacctgccgccgctggcctgcgccgccttcaacgccgacttcgatggtgaccagatggcagtccacctgccgctctccgccgaagcccaggccgaggcccgctcgctgatgatggcttccgacaacatcctgaagccggccgacggccacactgtgaccatgccgagccaggatatgatcctcggtttgtactacctgtccaccgtgctggaaggcgtcaagggccagggccgcgtgttctcctcgctggaagaggccgaaatggccctcgaccgccacgagatcgacatgcaggccaaggtgctcatccgcctgcccgagagcttcgtgctgccgaagaactgggagcccggcgaagtcaaggtgctcgacccgcgcgaaggcgaggacgaggtcgtcaaggaagaacgcttccacgacggcaccgtgctgttcgccacctcctacggccgcatcctgttcaacgagaccctgccgaccgactacccgttcgtcaacgagcaggtggccaagggccgtctgtccaagatcgtcgatgacatcgccatgcgttactccacccagcaggtggccgccacgctggatgccctgaaggatctcggcttcacccgcgcaccgtggtccggcgtgtccttcgcgttctccgacgtgaacgagccgcccgagcgcgacgagaagatcgccgagtacgaggccaaggccgacaaggtcaacgccaactacgagatgggtctgttgaccgaggaagctcgccgtcaggaactcatcgacctgtggaccgagtgcaccgccgaagtgtccaaggaagtcgaggagaagttcgacccgacctccaacctggccatcatcgtgcagtctggtgcacgaggcaacatgatgcagatcaaccagattgcaggtatgcgaggcctcgtggctaacccgaagggtgagatcattcctcgtcctgtgaagtccaactaccgcgacggcctgtccgtgctggagtacttcatctcccagcacggtgcacgtaagggtctggccgataccgcactgcgtaccgcagaatccggttacctgacccgtcgtctggtcgacgtctcccaggacgtcatcgtgcgcgaagaggactgcggcaccaaggccggtctgcccatccgcgtcgccgagcgcgacaacgacggcaacctggtgctcgtcaaggccgccgacggtggcccgtactcccgtctgctcgccgccgacgtcatcgacccggccgacggacagaccgtgctgtacaagcgcgacgacgccctgtccatggacgtgctcaacgacctcgtggcccacggcgtcgaggaagtcaagtgccgttccgtgctgacctgcgagtccaagcgcggcgtgtgcgccaagtgctacggctggtccctggccaccaacaagctggtcgatgtcggcgagaccgtcggtatcgtcgccgcccagtccatcggtgagcctggtacccagctgacgctgcgttccttccactccggtggtgtggccgcggcctccgatatcacccagggtcttccccgtgtcaccgagcttttcgaggcccgcaccccgaagggtgaggccccgatcaccgagttcgccggcagcatcaagatcgtggagaacgatcgcggtcgccagatcatcctgaccccggacgccgattccggcgcaccgaaggaagacggcgtgatcaagccgatcacctaccaggtctccaagcgcgtgccgctcaaggttgccgacggcgaccacatcaaggtcggcacccagctggtcgaaggttctgtggaccccaagaagatcctcaccatcctcggcaagcgcgccgcccaggtcaacatcgtggaggaagtgcacaccgtgtaccgctcccagggtgtggatatccacgacaagcacatcgaggtcatcgtgcaccagatgacccgtcgcgtgaccatcatcgactccggcgacaccgacctgctgccgggtgagctggtggacaacgcccgcttccgcgagatcaaccgcaacatcgtcaagaacggtggccgtccggccgtcggtcgtccggcgcttatgggtatcaccaaggcgtcgctggccaccgactcctggctgtccgccgcatccttccaggagaccacccgcgtgctcaccgaagccgccctctccgagaaggtcgacgacctcaagggcctcaaggagaacgtcatcatcggtaagctcatcccggccggtacgggcctcgcgcgctaccgcaacgccgtggtcgagcctgacaaggccatccgcgacaccatctacccgaacttcggtctgggcggcgatggcgatctcggcgacgcgagcttctccgacgccgacctgtctgacctgaacttctcgaacctcgagttcggcgatctgaagctcggcgacgacttcaacccggatgatttctactccgatcagggcggtcagcctgacatcgaggagtaagtgagaaggtcctagaaaggatgccccttctaggactcagatcttgcgttaatcgcaataagatggcccggaactatatcagttccgggccatccgtatatttgccattgtgattttcctgttgaacaagagcaggcagccgctcgttgcttgattactcaagcctgtttttcggtgaactggaagaactggtctccgatacgcaccgtggcaggcgcgctgagcttgagcggtgtgcccttggtgacttgtgtctcttggccattggtgatgatgtaggtgccgttcaacgagccgtagtcctcgatccacagcgcgccatcggtgtcgatgctgatggcggcatggttgcgggatgtggtgcgggtcgggtctacgatacgcaccgccttggcaccctgcggcacatccatggaaggcttgcggcccagcaacgtgctcttatcgatcacgatggtctggccggtgacatcgttatgcagcaggtacgtcttcttcggtgccttggacgtgaacgaggaggagagcacggtgctgtcccaatcctcgatgtcgttttcggcggcgtgcggtgtggtgtctgccggagcggtggcagcgggctcagcggcggcggccgtggcggcaggctctgcggtaaaagcggtattggttgccgcttccgcggtactgggctgcccgtagtcgttctgcggttcggctgtgccaactgcggaatccggggtgccttccaccggatcgtcagaataccaacccagttcaggtgctggagggtagggaagtttggccatgatgatgccgtcctttcactgacgggaagccagagcggcgttgattgccgggtcgccgagctggcccagccattcgatcagtgccggataggtgttgggattacgtgcgatgcaggcgcgtagttcaggcgcgtactgggcaatctgggcgatttgcatctggtcggtggtggtcagggcctgttcggcggtgaaaccgtaaggattggtggccacaggctcctcgaatgccgcctgagccgcgggctgctgagcctgttcggcggcgggctgctgggccgcctgtgccgtggctttctgatcctgaaccgggccgccgaatgcctcggcagtgaacccgtattgcgccagggtctcgcgggcgcgaccgtcaccgaactcggcgatccaacgcttcaagccgggataacagcgcggattcacggcgacattggcaccgaattccggattctcgtaggcgatttttgccagcagaatcggatccgcgttcggatcctgaacggcagcgaccgcagcatcataatcaaccatgggattacctccttatgttcgctcggttatgccgaacgtatggtccgtagtgtttgtagtgttgcgtcttcaatggcgccgatatcctcaccttcgtccagcctgaatgcgctgaacgcatgatgttcgggttcggtcaatggcatatcggccacaatcacagtgatattgtcggttccgcccgcatcaagagcggccgccaccaaggcgtccacggcctcctgcggactggaatgcgccgcggcgatggccgcgatctgttcgtccggcacctcgccatgcaatccatccgaacagatgatgaagcggccggtcagatcggcgacatatacgtcgggcatgatgccatccggatcacccagacattgggtgatgatgttgcgtggaatggtcgcctccgcctcttccggcaacatctgcccggaatcgatggcttcttggcgctgggaatggtctcgcgtgatgcgggtcagcgaagcggcgtcccacacgggaatgatatccgtggcgggagcatcggcatgcgccaacggactgagatggtaggtgcgggaatcgccgacattgaccacataggtctggtccgagaagtcctgatcatcggcgtcactgaacaaagcagcgctgcgggcgctggcggaatccgcatgatcttggggcagtaccaaaccggagcaggttgtgccggccacgccgccaaggcggtctcccagatcgagaatgtcgtgctgggcccgtgccaaggtgtcgtcgatatcctgacgggtgcgtgaaggcatggcggccaattgtgcgaaatgctgggcagccaactggcttgcctgctcgccgcctttgccgccgcccatgccgtcacagaccatgaacacgccttgttgcgcgaatccggtgtcttggttgtttttgcgcctaagacccacgtcactggtcatcgcgatacggatggagcctgtggtcatgacgccttccccttcttacgcgtgcgcttgacatgcgtcgtgtgcggctttgctgcgtgcccatttgacagtatagccacgcttttcagggaaagtcgtgtacgtatcctcctgaaacgcggcaaagaagcgagcattgccttgcgtaattggtcgactcctgtccaatatgtggtggcttggcccgattcaatgtcttgccccgagaacgtggcgtagtcggcttcccggccaagctggatcaaagcctggtcatctgtgccgagttgacgggcgatggcaccggcctgatctcgacgagtgcccttggctgtgatgccgctttgctcggcaagcatgcgtatggcattccaacctgctgccacacgggttttcggactgccgtgtcgccgcgctcgtgccagcagtatggccttgaacatcagaatcagaccgcaggcgatgagtagggtccacaatgggctgccgtacagggccaccttgcgggtcactcgccagaaccgcgcccagaacaggttggtcggcgaatcatcggcgtcggcgccggccaatgagctttggcccttggcttgcgtctgatcgcgcagcggatcggtcaacggcactggtggttgccggaccagcgtctgcggattcggcggcgtcaggttctggttttcatcaggcatcttggtctccttgggcgtcggatagaacgccacccatcccaggccctgcaatttgatttccacccaagcggtgacatcgttgccggtgaattcgattttggtgccattgcctgaggtcttctccgtgcgggcatcggtgatttcgccatcctcgtttttcggcaggaagcccaggaccacacgggagggcagtcccagatcacgagccatcagtgccatggcggaggcatattgctcggagtcgcccaccatggccgtgcctgccagcagcttgttgatgcggtagttgccatggccggcatcggagggatagtcgccttcaagtccatgagagaaccatccggagtctttcaatgtgtcggccaacgccgtggctgcggcaccgcccgaggactgcccgccggcaatggacgtggccagtttgctggccgaatcgggaacatcctgggcttctggttgggtgatgcgggccgcagccgcactgctgatctgcttatcggtgggattacgggcgataatgccggattcggtataggtgaggcctttacgcgtgccggcgggaataatggcggaatcggtatccgtgttgtagtaaaacgtgtcattgccgttgtcggcatcgttggcgaagctcacgccagtggccgctcccgccagcggcagccaggtgtcggtcagtccctgatcgacggtgaaggtcgcagtgaaggatttaccctgctcatccgccttgatcgtggtgcccacgcgatgataattcgaggagtccgtggcttcggaagaatcggacaggttccatactgtgccatcgaatcgatccatcaccgcaagtttgaccggtgttccggccggcagattatgaacggtcagcaacacgtcttttttgtggtccttgatataggatcgcatgccgctgagcgggctggtgtaatcgtaggggcttaacggcggatcgtagcggtcacgcagcacgaaacggtcctgtggcaccagcaacgtgcccccgaaagcaaggccggcagcgagcacgacgatgatcagcgcggatatccagcgcccccattccagcagttcaagacgccaagacagccagataatcagcagcaaggcaaaggcaataccgcagatggcgcgttgccagccgctgtctgtgcccagcagggcacatacggccacggccgccgcaaggggcagcactcccaccagagacaaccatgcgttggcattaatggcaaacacgccggtgaagaacgtaagccacaggccgatggtccataccgccatcagcacgccgtcttgcgtgcccagaggcggatcgacggaaataatgtacttgaacgagccaaacgtcatttcccaacctgaactcaaggtcttcaaggtgggaatcacgtaatgggacgtagtggaactcagcgttaccaccgggccgatgatgaattgggcaaacgccagaaacacgatttgccaccacagtcgcaacgccggcaacatgcccgccagagcgatgatcgcgcccagcaaggtggccggtacagcggcaatcgcccaagtggccacgccgccgtacacgtcgatgagattggcttgcgccagcaacatcatcgccgctatgagtacgaggctggcgattcgtttgccccacggctggcgactgaggcccatgccgcgaagcacattgcctctggtcatccagataaccgaatgtgtggagtcggcccaggagccggtggtggtggaggtcccggtgtacgtgccggaggaagtgccggtgtatgtgccgctcgatccggcgtacgcagcggtattggtattggtgatactggactggtcgaaggtcatgcgagcacccccatgatcagcgggagatcatcgaggtcgccgatggtggccaatgtgaagttggcgaatcttctgatgccgcgattggcgccggcgctggcctgcaataccacgcagctggccgatcggggcaaggccaaggtcatgcgcttgatttgctcgatgtctttcagcgatccaacagtgaaaaaatagaacgaagcatcaggactgtgcttcagcgtgccctcggcgagattcggattatcctcacgatcaggctctatggcactggcgttgtcgaggaactccatggcgttgcgcggctggccgtgcgcgttgcccgcgtggcagaacaatggacgatcctgcagcaggcatttgacgccgatggaggagtggatggacaccgccatctcgaattcctcgccgttgacgtattcgtccgggttcacgctgatggtcaccgaggtgtcggtgcggcgcgtggcctcatattggcgaatcatcaacgtgccggttttcgcggagctcagccagtggacgttacgcacgtcgtcgcccggctcgtattcgcgcaatccgtagaagtcgagatcatcatccacgatctggccggatggttggccttccaggtcgcggggcacgccggcattcagagtatcgagacgcacggtacgagggtggatgaatacggtgatgcggtcggccagctccttttcgtgacgcaccagaccgaacgggtctcccttgcggatgcgcaatgggccgatgggcagtattgcgcgcgatacggtacggaactccacatcggtttgcttggattgcccgggagccagcatggggatgttgaatcgttcatgcgcatcgccgattggcagatatccgcgtgccgtggtcgtcggcgttctgccggtgttgtcgatgccgacgataacggatacggtgtctcccacggtcacgcgatgattggatacgacgatggacgcgtggaagcgtgtgttgccgagggaaagcacgattgccgcgagcatcatcaccatcgccacgatgccgaatacgagcagctcataccagcccagaaacgggaacgcaataaggcatgcgatgcctgcgcccgttaccgcccagcccaagggcgagacgtaggatgcgaagaaccgtctgatgcgtcttaccgcgcgcttgaacatgcgttcagcgcgccggcgacggcgtaatgcggcggatgtagatgccatggtcggatacctttccgggccctatcaggaaccgatggtgggggagggaacgtcttcgagcacctgtgcgatcaggctttccggagtcgcgccatcgaaggtggcttccggagtcagcgtgatacggtgtgcgagcacggccactgcaaggtccttgacgtcatccggcaccacgtaggcacggccatcggccgcggcccagatacgggcgcatcgggtcagtgccaaagcgccacgcatggaggagccgaccgtgatcttctcgttgtggcgggtcgcctcgacgagcctgacgatgtattcacgaatcgcattatccacatagatttcggtggccacctgacgcagccgcatgacatcgtcaccgctcagcaccggggaaatggtctgcgcacggtcggtgatatcgacctgcttgaggatatcgacggacacatcatggcccgggtagccgattgacgtcttgataaggaatcggtccatctgcgcctcaggcagcttataggtaccgagctgctcgatggggttctgggttgcaatcacgataaacggctgcggcacatcatgtgtgacgccgtcaacggtgactttctgctcttccataacctccagaagtgcggactgcgtcttcggcgatgcacggttgatctcatcggccagcacgatggaggcgaaaatcgggccttcgcggaactcaaattctccgcgcttctgatcgtagaaagtcacacccaccacatccgaaggcagcagatcgggcgtgaactgaacacgcttgaaaccggtggaaatggaattggccaagcctcgggccaactgggtcttaccggtgccggggttgtcttcaagcagaatatggccaccgaccatcagtgcggtgacgcattgcttgatagggatggtcttgccgataaccaccttggagacattttcgaccagcgcattgaaggactgctggaaatcccggacctgagccgtgggctggggcagtagtccggaattgatgctggcgggcagtgccgatgcggctgcttgcgcggctttgctcgactgacgctgcggctgtgattgcggctgggattgcgcggtggcctgctgcgggatggctggcgtcgatcccttgcgcggcttgagcacggtgctgtcatcgcccgcaggaatggaggcggcatcagtagtaggagacggcttttctgacggcgcttgtgacggccgctgcggcaggttaggcagcgcaacggactgcggcgccgactcggtgcttggggtcgtgccggtgtgtggtgcggatgccaggtgcgtggcgtcggacaagtgcgtgctgtcggatagctgcgtgctgtcggacagacgggtcgtgtcagacaactgcgtcgcgtcatcgatgttctcgctcatggatgttctcctactgcttgtgaatggtggttgacgatattggggtattgccgaaaccaagaatccaggggttcttggccaaagtggtgacatcggtaccggatttgagcgacttggtcccctccgaggagtcagagggacgtgtgcccgcgacgctgcctccgtccgcagtgttgtcgagaccggagtatcccggcccgccggtgactttgacgctccacgcgtagttgccatcggcggccacggccaagtcggtgacatccaatggctggccggagttccacgtgaacggttggccattgatgatgatttgtacagtggccgacttgccatagacatcaaccgaaccgccggtgacgttaatgacgtgagcgttgtctgaccagcgcagctcctgcggtttgttgattacagccttcttctcataggtgtaaggagcgccattgtgcgggcctccggtgacggcgtcgctggtagcgccgttgaacacctgttgcaccgatgcggtgttgcatttggcccaaggactcattcggaagtcgagtgagttccggttagtagctgtaccggaatcgatgccatcggcagtcacgctgtaggactgcgcatgtccctgcttggtccaatgcacggtgcatgtactgccggatccggtggtgtagacgtcagtgggcggctggaccttgtactgcgggacaaagctgctcttgcccgtgccggaggaagcatcgcgctgcggcaccacggtggccgttacggtgatttcccgggtgttcaaatcgttctcattgatatcgaacgtagcgccactgtcactgcaatcgatggtgtccttgacgtctcctcccaaggaaattcgccggcagccggcattgcggttattgccgagagtgactttcgccgttaccgtggtgtcgtcgttcgacaacgcaatgttcggcgcatccgggtctccccagatcttctctgacggcgatgcggcggactcggcactccaattgattttgttatgggctttgacggtcgccgtaatggcggtgccatcggaaatgtcgttgttgttgaacgtaaacgacagctcggtggccgtattgccggtttccttggtctgcggagcacctgcaccggtgacggtcactgaatagttgtcgacggcgctgaaatcaccgctcggcgctttccacgtcaccctggcggttttattgccacctgtgatcgtaacatcggtgggagcggacggcaccttgtccggtgtggcttcgacggcggtggacggcttggaccagccgacgtcatttcgcgcggcgacggtgaaggaataggttttgccgttcttcagaccagtgacctggcatgaggtgacggcaccgcaatccttctctccggtgacggcaccggtccaactgaccttgtagttggtgatcgggctgccattggcggcaccgggcgtccatgtgaggctgaccgcgctgtcctgcggttccccggctacgggggagagcagtggcggctcgggcttgtcgatcacggacacggtaatcgatgcggtgacttcacgatccttggacttggtgccgtcttgcacggtgacgagcacggtgttcgtggaagcacctacatcggatgcgacggcgatggtgatgtttccggaggcatcgcatccggcgatggtgagtttggcggcgtcatccgccttgcagctgatgacggtcagcgaggaatcggggaacggattgtacgcgccggtaagcacgttcacggcatcgctggcaccggccttgatcttcaacgtcttgtcgccgacgcgtgtcagcggacgggtcgaagacactacgcgcacggtcacaccggcattcacggtgcccgcgccgtatgcgatttgcacgggaacggacgcggtggtgccaggagcggcatccttggtggcggaaacctgcaagctaccggaacgggacaggtttgcggtgatttgcctggatgatgagcttccaccggaatacgtgtattgcttttcgtcgtcatacacgccggacggtgcatgggtgagcgccgtcagatcaacggtcttggggtccgcgcccgcctcgacatcaatagtggaggacgagaacgtgggcggcggcacatcgcggcctatcaccgtgatctggagagtgatcactgcggaattgatgatcttggtcttatccgatccctgcttgccatccacagcggtaaaggtaatggaggcggggcctgcgtagtcttttgccgcagtgaacttcagggtcttgtcgttcacgtagaaatcggagttggaagccttggtggcgctgacggaatcagcgctttcgatatacggttccttgccggcgccgacgcggacatagtcattgatgttgatttcaatggtctcgcgcgagttgaccttcaattccggtgccttgggacgcagcgtgggcggaaagacaccataggccggtacctggatgaacgcggtggaggtgatgttgtatttcgtattggtcaccgtgtaaggcacggctcgcgcctgtgacgtcaggtcgacggtgatggtggtcgaatgctcgccgcccttgacgtgagcgtgagcgctggcggagggatgcacgccgaccttgagctcattggctgtgccggaaggattggcgatccactgggaaacatccacatccacggacttcttatcgatggtggcggcggacggcacacgatagtcgtaggcggtaggcggctcgatggcggcactcggatccacgtttaccgtgagggtggccgtatcggacaagccggccttgtctttgaccgtgtaggcgatatagtcggtggtggcgctgtcgggcgtggtgaaggagagcatattgtctttcacgctcaccccgtcgagaccttggacctcgacatgcttgtcgacggtcagattggtgttgtcgccggagatgtcgttctgcgcgaccggcacggttgcggccgtattgggcctcaacgtgatttcgtcatccctggcgtatacgccggagtcggacgatccttggaatacgcccacgcggatctgcgcctgtgcgcgctgaccggtccaatcctccacggcataggagaaggtgtcggtgccggacgaatccggatacgcttcatagaccaagtagtcggaaccgacttcggatatgcggcccagcgtgggtgccttgttgcccagacccaacagctgattgtcgtcgccatccgtgtctatgccggtcagtgtgatggggatgcggaccttctgcccggcggcaacctgcgcttcggcgtcatgcggggttggcgcggccttgctcgctgcgtcgctcttatgcacggtaatggtgatattggcggaagccacattacccagattgtcttcaaccgtataggtgatggggaagttgccggtctcgctggatgcttggtagcggaccgtgtctccagagacgaaggccagacccttgaacgtccccttgtcgtattgcaggttgttcttgagtttgaccgtggtgccatccgagtaggccacatggtcaagcacatccacggacacgatgccgtcggtacgcacctgggcattgatattgctggccttgggcactgaattcgaggtggccagagccggcggctgcaacacgatggtgcccttggcggttccggaggcgttggccacggtgtaggtaagggcgacgggcttcgtgggcacctgacgcgcggtgatatacacgcgcttatggctgacgagaccaaccttgatgccggagtcggccggtgcgctcaccgtggtgacggacagcacaccgcccatcggatcgacgtcattggtgagcggctccacaatggcggtattatccgcgccaagcagggcgacatcgttggcggcaaccggtttggcggcctcgccggtggcgggctgcacctcgactcgagccaatccggtggccggaatcgaaccttgagtaatgatgtagggcacataataggtgccgggattggtggccttgaacgtcaacgacatatccgccgcattggtggtcgtcgaagcgccgttgggcgtatccacctgagtcagttgtgccggctgcaaggaagtgccatgcacataagaggacagcttgacgacggtatccgtgttgggaacggtggttttcgctaccgggtcgatgaccgcggccaaggtgttcgcgggcttgaccgagaaatacaccatgccggtgccggttgccgtgccgtcggagacggtgacctcgacgcccacacgtcccgacgccagcgcaccggtgttgaacgtaagctggccgtcggctcgggtggacacctgcacctggtcggtgttctgggccacagcggagaccagagtgagcgggtctccatccggatcgttgaagctgctcagcgcattggcggtataactggctccctgctccacatcgatctcgggaggagtgtcgaactgtacgggagcgtggttgcctccatcattcagggttacggtcaccgtggcggaagaggtctggccgcgaccatcggaaatatcgtaagtaaaggtaacggtgcctgcggatgcggcggaggcatcgagttgcagataccggccgtcgtaaatcggcgaaatggtgacgtctttgttgtttggtgcgccaaccttggtgattttcagtacggaacaatcggtctgctcgtcattgcgcagcgcgtcgagaatctgttccgaaccggctcgtgcgccgatttcatcatcctcggctttgatttggccggattgtgcggaacaggtcttggagaagtcgtggtggttgttggccgagtcgttgttctgctgttctttctcggtctgctcggtctgtattttgttccactgtattttgatgactttggtggaatcctcagggttccacacattgccgttaaccgtgtcgttgagcaccacaaggcgatggttggtgcggaacaccaattcggaagtagtattgacggattcgagggtttgcggcttgacgctggtatccgtgggggagcaggcgcgaatgtagttgctggccttctggctccaagccgagtacacgcagcccttggacgataccggtcgtgccggattcgccttgcccccgttggctatgaaattcgccttggcattggacttcaacgggataagcgcaaggcctctcggtgatgccgcggccacccaatcggactgtatgtcatcggtgggaggctcctgaagggtgagggtgccggtcgtgtcgacatcgacgcggccgcccttgaatatgacggttttgccggttgcgattaccggcgtgctcccgatgacggtaaagctttcaacggtctgctgcttgccgtcggtcagcgattcgagggttttgacgttggcgctgctgggattgtcaagacgcagcaccataccgtcggatggacggtatccgtagactttgccatcgtgggttactgcgatgcgcccgccctcgcccagctttattttcggatcggaagtggtgggggtcacggaatcaaggttttccgacaagccggtccacacattgccggtcttctcgttgatcagggctgcggtatccccgccgaccacagtggtggtgctggctttgatgtcggtcttgacaccggtgctgaccgtggatgccttgatggtggaggctttggtcgtttcggtcaggatggtgtcgccattatgctgtgcgatgtcgaatcgtggggcggaggaggagacgccggcgtcggcctccttgttctttacgttgaatcgtgcggccttctggtttttcagcgaagtgacccatacggtgccatcgtccagttgcacatggcggcgcgtgacggtgctcatgatcaccgcgccggcaacaagtcccagaagcagcaggagcgtgattacgggaaccgtccacgtatgccctccggagggcataaggcggcgcaaagccgcgctgatgcgtcggcgacgatcgtatgactgggacgatgtggccatctgaactccctgacccctgttttctctggttgctggtgtaatgacaacgctttacggttccaatacctgccgttcctgttgtccatttggtgaattcgccgctgctgggcgcacgtctgatgcgatacgcaatgccagggtggcatgcccggcagtggcgagcggatcattcttgcggcttggccgcacaggcgatggcggggctgacggacatctggcggttcttgcgcacaatggacacctgaatgcaggtctgcgagccttcctgcgcgttgacggtcaccgtgggatctgacgttgtgacggtttgcgcgctctggtcggtattgctgccctgcactatggcccacgcataggtatcaccgctttgcgggtctggattcgtccaggtgaacgtcacggatgacccatccgccgcataggtgccgttcagattctccggggaaggaatctgggcgttcgcggtatcggtgatcacgtcatcctgattattgcggttgttgtcatcatccttggtgccgggcgtcgccacctgtttggtatctgatccggtggcgctgtccatgcggggaacgaccacgaaggcgaatatcagtgccgctgcggtgatcgccgcaagtataccgacggtaatacccaccggtttgacccatcgccgtgacgaacgggtgatctgatctcgctggtccgtggcccggcgccgacgctcgatgtctttgggataggccggcatcccttccacggtaacgggagtggcatgcccgaaatatgcgaattgcacacgctgcatggcacgtgcgaactccaacgcggagtagtaccgctggtcggggtccttgttcagggcccggcgcagcaccgcttccacatcggccggcacgtcggggcggttgaggcgaggcaatggctggttgacgatcagcgaaatcagttccgattgcgaacgcgggtgataatcgtgctggaatggcgagcagccgacgaacatggcgtacagggtggccgccagtgaatagatgtcggcggcttccgaaccattggtcagatgctgaagcacttcaggcggtgcccacggcggcgagaatccggtttcggtacggtcatacacatcggtggagataccgaaatcacccagaacaggcaagccctgcgaggtgatgagaatgttgctgggcttgatgtcgtgatggatgatattgctgcgatgcgcggtgaacagcgcgcttgacagcttgatgccgaggtcgagtacctgctcgcaggtcatggaccgggccttcatgatgctgttgtaggtgccgcccggcgcatattcgatgacgatgtagccatggccatcggaggtgacgccggcaccatataccggcagaatgtacgggtgggatgacagcttggccatgaagttggcctcgcggttgaacagggcagcggcccgtgggtcaagggttttggcgctggcctttaccgccaccgggcgtgcgggcatacgctggttatataggtacaccgtggcggtggcaccgcttcccaacatctggacgaaatcatatccgggcagcttcggcggtctcatcggaatgttgtccatctgttccctccctccttggaaaatgcgctctccctgcattcgttctacaggataccgtcaagggtacgattcttcgtcgggttcggtaaaatttttccctctgtgacggtcgggtttaggctggagccatgatgacgagacttgaacctggaacagtgctggacggcatcgaccgtgatggagcggcgaggctgattgtcggcacgcctggaagcggcaaaactgaattcgccttatcggtgttgatggcggggctgcgccgctacggtggcacgcaggcggtgatggccgtatccggccgtgtggccgccgacgcattgggcaatcgggtgattcgtgagctcgggttttccgtgcaggccaggccggtcaccacgctgggtgccgtggcattccgggccatatcggctttgcgcgagggaactggattgccgtcgcctcgattgctgaacggtgcggaacaggatgctttgctgcgtcaagtcatggccgtgcatctgcgccatgccgtagcgggagatgattgcggcacctgtgatttgctgcgcgtctactttgcccaggatgactgggcgagactcatacgcgatgccggtgccggcgagatgcccggctcggccgcttccgcacaatcaagcctctcgcaacaagggtcggattcgccgtctccgacgtcggcaggcggctcgaccagcgcggataggttcacgcgaggtatttcagatgcgtttatcagccagttgcgcgatatgctggcccgattggatgagctcggtgtaggcgttcacgaagagccacgtctcttggacgccgtgacggaggacgcgcgattgtcggtgcaatggcgtttggctttcgcgttgcgccgtgaatatattgcagcccaaagcgcggtatatccggggcaataccgtttggatgcctcgtatttgctggtggcaggcgctcgtgtggtgcgtgaggcattcgccgccgatcacgcggatgattccgaccggcctatgtgtgtggaggcgttgggcttgccccggctgctggttgtggatgatgttcaagacaccacgctggccggcatgcgcttcttggaggagttggggaatgccggcgtcaagttggtgctggtcggcaacccggatgaatcggtgcagaccttccgcggatcgtatccggaatatctgatgcgccgtgccgtggaagggcggctgaaggccaaggaagaacagctggttggcggcagtgccgtcgctgatcagtcgcacatgacgatggctgatgtgatcgcgtctcgtatttcgctgtcgattccctcgccggaagacgagccgctgcctccggccgagcgtcccggcaagctgaccgccatactgggcggagtcgatgcagcgaattatcaggcggacggcacggtgaccgccggcctgtaccgatcctcacgtgaggagctggatgatgtggtctggcgcatcaagcgggcgcatcttgaccggcatattcggtggaacgacatggcggtcatcacccacgacaatgccgccgtgcggctgttcggcgaacgactgcgccgagatggtgtaccggtgcggtattcgtcggtcacccgtcctttgaaggacgagactttcgtgcagggattgttcgcgcttgtggagcttgcccgattgcgtgccgaggggatggcggaatgccagatgacgttggcttcctgcgcggcatatataaggactagagtggccacgttgatgaacggcccgttggtgagtgccggggccaaacccggtcaggggcgtcccgcaaggcttgcgccgatcgaatcggccatggggtcgttggagtcgctggcgcatctcgccacggatgatgccatgctgacctctctgacgacggcatgggaaacattgcgtgaaacataccatgaaacacggcgtgaaacaggtcgtgaaacatcctcgtcagtggtttcgacgtcagcggtttcgtcgtcagtgacttcgttgccagtgtctgtcgaaatactcggtgaaccgtccggcgatgacttggcctttggcgttgacgcgctgtacgtgatgcttgccattgatgatgccgccgcgccggcgcaggctgcgctcgcatccatccacgcggtgctcggcaacgaccctcaggcccgcgcttttgcgaacctgtggcatctggtgggcagcgttgcttccggcttggagcggctgccggcaagccagcgcgtacagccgcgctatgcgctgtctgttgcgtggaacgccaccggtctggcaccggtctggcagcgtgcggcattattcaacacggcagaggggcgtacggccaatgaccggctggacgcggcaatgcgcctgttccagttcgccgatgattccaccgccagtcgagacatcacgtcattcatggcacaggttcggggcatggaagtgcaggccgattccttggcccacataggaccggtggaagacgcggtgacattgactacgccggcaggcgcggccggacgccactgggaatatgcgtggataccggtggtccagcaagacgtgtggccgaacctcgccgggcgcaacaccatgttcggtggtgaagaccttgccgagctcgtgctgaggggagcgcttgaagaaagcgacaaaaccgggcatgatccgcggttcgcggctgtattgtcgggcgagaagaagagtttcctggtcgcgctgacccgtgcacggcgaatcatgatcagcgcggtatggaacgacagcatgagcccctcggactttctcttcgggtatctgccggaatactatccgcgcaaccggcaacaggcgcctttcaccacagtgggggcacatgcgggattcgccgaatatgatctggccggattggacgccgacccacgtgggttggtcagcgccgcccgcgcggttctggccactgctcaaccgcagcaggctgccgcaaaggacgccgcgattgcgttgacactcctgttagagcatggtgtgcgcgccgcaaatccgcagagctgggcgtttgtggaatcgccggcccaatcggatagcgcgtcatctggcggtgcgtcatctggcggtgcgtcatctggcgatacctcatctgacagtgcctcatccgacagcgcgtcatctggtggtgtacagcctgacggtatccaaacagggaaaggcaagacggatgcgcaggccgcgcccatggtcaccttatctccatcggcggtcgacagcctatgggcgtgcccggtgtgctggatgctggagaaccggttcgccggtcctcgccccagctccgtggccaccagtttcggaaccctcatccatgcggttgcgcagcaaggcagcgaggaagggctggaccatctttcccacaatgcccaggcgttggccgcactgggcttggactccacggccggcgcggaacgtcgcatcgaggctgtctcggcacggcttaatgccatctatcagagcaaacgtcctgatccgaatgccatagccgacacccggaaccgctatgaggccacccgtaaggacgagtccgcggcggataccctgcgcaacatcgccgattactttgtgcgcagcgacgccgatccggaaacgtatcttggcaagaactccagcaacttcagcattggcgcattggccggtgccgaatgcgaacgggagtttgccgcacgattcgatgtgcgtgacatactcgacgcatacaatgccgtgcccggcctgcacccaatcggtcggaacacgctggtccgtctgatgggagcactggtcggagggtggccggaaggcatggacgagcatctgaccgtgagactgtccgggcgcatcgaccgtatggaaacccgcgtactcgcagacggcggcgaatgcattcgcctcattgactacaaaacaggcagaacgcccacggtcaaacagattttcaatgatttgcagctcgtgtgctatcagcttggcctcgtgttccccgaagacgggccgcgcggtgccaaggcacttgccgcaatgccgcatatcagccaaagcgtgctattccatgtcgggcagaatgcggcaccagccagaagctacgctccggaaggtgccttccagccgccgctgttcactgatggctcgttgaatgccgaaccgttcacgccccgatactggtataaagaccccaaccgtttcttcgacatacccgccatagatccggctactcctcccgaaggtgtgagtgccgaagcgtgggcgcaattcgccgcgctcgccggtacgcagacgttatggtcgctgaccatgatcgcccgcgtattctatgccgcggcggccagcagatcagccatcatcgaggcccatccgcaagacacccatatcggattctgccgtatgaagaacgtctgccctgcctgtgcaggccagatcgacacgattttcgaaacgaggcaagcatgagcacgttcactcccagtgcggaacaggccgccatcatcgatgcgccagtcgatgctgacgtattggtggttgccggtgccggttccggcaaaacctttacgatgacccaacgcatcatcgcgcttatcaatcgaggtgtggcacctgaacgcatcctgggcctgaccttcacacgcaaggccgcaggcgaactgctggaacgcgtctccgccgcagtggccggtgatatggcgggctctacgaccgccacggtgtctgatcgggcattcctcaagccggccattttcacgtatgacgccttcttccagaccatcgtgcgccaatatggactgcttgtcggattcgatcagaacacgcaaccattgagcgcagccggagcgcttcaactggccaccgaagtcatcgacagtcacatggatctggcgttcagtgaggattttggcgccttctccagtttggcgaaccgtgttctggcgttgtcggatgccattggcagtgccatgatcggtgccggctgcaccagcttcgatgatgcgatcaatcgagtacggcaatgggattcggcattcatcaatcgattgcaacaagccgttgcagacgaacccatgcccgaggacgagccgaaaatccccaagatcaaacgactgaagaaagataccgacgccagctggcaagccaagctcgatgaccgtgccgaacatttgcacgcccgctgcacctatcattgcggtgcgctgctggagaccacacgcaaacgcgatattctgctccagctggtggaggcctatgcccaagccaagcgggaacgcaatatggccgaattctccgacttcaccattgccgcgtatcagcttatcgagcgcttcccctccatcggagagcgtacgcgccgcaggtacagccacgtgctgctcgacgaatatcaggacacctccaccacgcaggccgctctgctggcagcactgttccacgtggatgcgtcacagaggtccgccgtcaacgcggtgggtgatccgttccagtcgatttacgcatggcgtggtgccagccctggtgcattccgtatgttccagcaagatttccacctgcctgccggatacaagccattcccgttgtccgtcaccaggcgcaacagccgtatagtgctcgaagccgccaataatctcacgctgccgttgcgctccaatccgtcgcgtccctccagctcattgatgcgtgaggtcgatgtctcatcgctcgaccccatgcctgatgcccccgaaggaacattgggagtactgggcttcgccacggccgggcaggagatcgacgccgtagtgcgtttctgcaagacggccatcgcacggcaccgttccgcagccgaacaacaggaacagatgccgggcgaacagaaagcgccggtcgccgtgctgtttcggtccaaatcacatatgcccgaatatcaggcggcattggaacaggccggattgaccacattcgtggtcggctattccgcgctgctggaacgtccggaaatccgcgatctgatggcgttgctgcacgtggccgccgaccacaccgatacgggatcgctgatgcgcttgctggccacgccacgattcaccatgtccgcagcggatttgaccatgttggcccgttttgctgaagaacagaacatggaacaacgcttccaagcattggtgcaggccggccttgcccaaccggatacaccagcgaatgaatgggcggctgtggtgcgtgagtaccgcgatcaggtggccaatgcggtattcctgccagacgtattgctacgcggcgacctggtaaaactgcttgaacggttgagcgcacacgggcgcaacgccataacctgggccgcggtgatgctccgtcaggtgcatgatgccgtcgggcggccactgggcgacgtgattcgcgccggcatagaagcgttggatcttgacatcgacaccgtattggccggtgtgctgcataatccgcagcaccgcgccaatcccgctttggcgcatatgcctatggatgcgattgtggatttggtggatacgtacacgcaagagattgccgctgagcaaactccctcgttgcatgggttcatcacatgggtggatcatctggcttcggtggaggatgaagccgccagtctccccgacgctccggtggatgtggaactgatgaccgtacaccagtccaaagggttggaatgggatgccgttgcggtagtggggcttaccgccggcggattccccagcaatcagggcgaccatctcaagatcgtgctggacgaacaccatacgggaggcaccgagcaaggtcactggaccgcacccgaatatcatgagaccgccgactcctggctcaccaaccccaccgccgtgcccgtgcctatgcgcgccgatgccggcattttgccgcgattcccccatgatgccgatgtggaagccgaccccatcgcatcgttggcggctttggatgatgtggagcttatcgatgatgaagtgttcggctccatgcgcgaattcggcgatggcgtggaagaagtggatgcatccggctggtatttgacgcaggcggaggaatatgggcgtcggctgcatgccgacgaacgtcgattgatgtatgtggcgcttacccgtgcgcgggaagatgccctgatgacctattgcgcctatacgggcgaatccgggcgggacccgtcagtggtgcccaaaggctctcgcgccgctcagccatccaatttctggcttgaagtgcatgacgcgctccaagcccgtgaacatgcgatatcggctcaggactgtgtggaacggctgcaaaccgccaatgccgggaagcccatgctgatctcggcgcaaggcgaagcgattgcccctcccgaagggttctttatcggagagcatgccgcggcatacagtgacgccgtggtgggggaggcgtggcaaacgccgattacgcagacgaatgccgccgtcgaattgccgtggccggctaccctcagcgacgcggtgcatgaacagctgtcacgcggcatcgatgtcatcgccgcagattcctcgtcacttgagcagcaccaagacgccggcccactcctgcaacgggcacaattgctggtggacgacgccgatttgatggccgatgccgccagcggccagtcgcttgatgaggcagtcaaagccaaggcgcaacgcgttctggctgcaggacgccagaacgtgacaagcctgcaagcccgcgtaggtggcatgaacgaacgggaggagcgcctctactggcgtagcattatccgcccgattccgcgcatatcgtctccggcggccgaggccggcacgcagttccatgcgtgggccgagcaattcatcaatgccggtaagccggatgaagcggtactggcatatgaagccgaaccaagcatgccgcatacaggtcaggatgcgggattcgtttcccgggaagccatgttggccgatttggccgaacgggagcggcaatgccgcaagccatccacacggcagcccgctgtcccacagcccacggctcaacaatccgtatccgccgtatccgccgtatccgccacttccataagcagcgacaatgccaccgagtccaagctggtggcgtggcagcgcagactggccgaatcatcgtgggccaagcgcatcccggcgtggacggagcgtgccatcgtcgtggacgtgccgggcgtgggcctggtcaatggcaaactcgatgcggtattcatcggtggacttgacccgtccagcaccaccgcacgctttaccgtggtcgactggaaaaccggtcgtcggcccaccaagccagacgacatcacccgcaaacttgcccagctcgacatgtaccgactgctgctggcagcggtcgaaggtgtggaattggacagtatcgacgccactctctactatgtcagtgagcccgacgagggcttgcgcgagcttcacgcccgcgcgaaaaccaaacaggaaatccttaccgagttgagctccggcattcccgaacaatctgacaacgactgagcccaaaggctcatgacctgtacagcatcggacggccttcaccggtggagagaccttatgcatcgcaaggcatctccgacgatgaagacgactggccacgtaccggtccgcggttgaaacgcaccgcgtgacgttgcccgggaaccgctaccctcggatggcacgtgtgggcgggcgcacgtgccggacaacgcaccagtaaggagttattgtgtccacgactcgcgcggtttcgaagtcgtccgctgcccactcgccctaccagcgcctgttcatgctgcccggagccaaggcgttctgcctgtccggcgcggtggcacgattgccgatctccatgatgagtctcggcatcgttctggcgctcaaccatctctacgacaattggaccatcgccggcaccatgagcgccgcctatgtgctggccatgagctgcgtcaccccgttctacgcccgcgccttcgaccgtttcggccaagcccgcgtgggccggcttgcgctcgccgtgcagattgtggccatgctcgccttcgccttcgcggcgttggtgcgcgtgccgattccgctgctgttcgtcctggccatcatcatgggtctgacgcagttctcattcggcgcattggtccgaacacgctggtcctatgcgttgcgcggtgtggaagatggtgaacagctgctcaacacggcctacgccatggaagccgccattgacgagatcgtctttattctggggccgattctggcggcttggctggccacctccgtgcatccggtatcccaactgttcgtgcccaccgtggcatgcggtatcggcggcaccatattcttctcgctgaaatccacccagccaccggttatcgtggaacaggtcaccgtggccgcgcacgatgacggcagccctgctgcaagcgaagatgccgaccagctgaccctgcgccagctcaaacgcagcggcgccaagcccaagagcgtattgctctatgccggcgtactgccgttgctcgctgtgttcatcgtgttcaatatgagcttcacgtccttcgacgtgtccattaccgccaccatgaaatccatgggacttgagcccttcctcggtctgcaattggcgatgttcgcggtcggctcgtgcatcggcgcgctggtgttcggctcttgccgactcaaaggctcccattgggcgcatatggtgatgttcctatcgctgctgaccgtcggctacgtgttcttccggctgtcaatggacaatctcatcctgctgggcgtcttcgaaatcctcgccggcctgaccgtctcgccgacgttcgccaccggcaacctcatcgtcaaggatctggtgccggcggaatccctgaccgaagggctgagctgggtaaccaccgcaggcacggtcggcacgtcgatcggctcgtccgtggccggcattgtgcttgacgcctccaaccctcatgtgggcatgatgctgccattcatcttcacgctggcgtccgtgccattggcgttggccggatgggccttggccaagcggcgtgggtgaaacgggatcgggctacgcccgatggatggttggcggcttcgccggggtctctccctcagtccgcttcgcgtccagctcgaacgcaattaatgatggctttcagccaactgaattattgctcactgtcgttcgccctcacctaaaaacgcctccggcgttttcttcacggttcggctcatcagagggagctcgacttcacggttcggcttgtcagagggagctcgattctgtggacgggatattggcgtgagggcttggcggtgataggctgattgccgattggaaaacgttccgggtacattgccgggcaggtacgggtagacagggaagaagacatgatcaaggtttcggtggtcggagcaaagggccgcatgggctcgcacgtggtcgaagcggtgaacaaggccgaggatacgcagctggcgctcgcattggatgccggcgacgacctgacccaggtcaccaccgacaacaccgatgtggtcgtcgaattcaccgtgccgtccgtcagcctgaacaacgtgctgaccctgatcggccaaggtgtggacgtggtggtcggcaccaccggctggaccgacgagaaactcgcccaggtcaaatccgccatcgccaacggcccgaagcccgaaacccagaaggtcttcatcgcacctaatttcgcgatctccgccgtgctggccgactactttgccaccaaggccgcgaaatacttcgaatccgccgaagtcatcgaactgcaccaccccaccaaggtggacgccccctccggcaccgccatccacaccgcccacggcatcgccgaagcacgcaaggccgcaggactcgcccccgtgccggacgccaccgaaaccgatggcggctcacgcggccaggtggtcgacggcatccacgtgcacgccgtgcgtctgcgcggcctcaacgcccacgaggaagtgctcttcggcaacgccggcgagcagctgaccattcgggccgacagcttcgaccgcaccagcttcatgcccggcgtcctgcttgccgtgcgcaagctcgccggcgacgctccggccggcctgaccatcggcctcgaccacttcctcgacctgtaatcgacccgcagtcgaccagtagtcgcccccgcatttcaggcagggaagcgcgccgggacgcgcatcacggcattgccaccggctccggtcataatgccacgcattcagcaacaatcaaggtacgtaatataagagtccacaatgggaagtacggtgaacactatgagcgagcatgacatgcaccttcttgagccagcacctttcggccgcattctgccggctatggtcaccccgatgaaatccgacggcagcgtcgatttcgccgccgcgcagaagctcgccaaatacctcgtcgccgatggcgcggatggtctggtggtcaatggcaccaccggtgaatcgcccgtcacccatatggatgagaaggtcgagctggtcagggccgtcaaggaggtcgtcgacgttccggtgatttccggcgccggctccaacgacaccgcacacaccgtgcgtatggtcgaacagactcaggaagcgggcgccgacgcggtgctcgtcgtcatgccttactattcccgcccctcgcaggacggtatcgtcggccactacaaggccgtcgacgaatccgccgaaaagccgatcatcgtctacgatgttcccggccgtaccggcttgaaggtcaaggtcgaaacctacgaccgactggccggacttgaacacgtcaaggctgtcaaggacgccaccggcgatcttgcagccgcagtggagaagcagcagcgcaccggcctcgcctggtattccggcgatgacggcctgttcctgccgttcctctccatcggcgccgtcggcatcatttcggtgattgcccacgtcgcctccaaccccatgcagcagcttgtccaggcattcgatcgcggcgatatcaccaccgcccgtcgcctcgccaaccagctcgccccccttgtccacgcgttgaatggcgacggctatcaggccgtcatggccaaggctgcgctcaaggtcaagggcgttatcccctccaccaccatgcgtctgccgaacatcggtcccgacgccactcagcttgacaaggctgaagagggcatgcgcgctgccggactgctgtaagcccgaaacgctgcatacgggttgccagcccgccgcccctgcatgacagagcagaggcaccacaacagaaatcccaaaaaggttatggcacaagaacaaaagaaaacaagcaagaacacgaattctcgccgtcgcggttccgcgcgcggccgcaacaccaacggatccaacagccgtacgccgtcccgtaagatcaacgccacccggcaggccaccgcaccccagcaggatgccgtgctgatcgccccgccgaagtaccgcaagggctccatgcgcatcacgccgctcggcggcttgggcgaaatcggccgcaacatgaacgtgatcgaatacaacggtcacctgctgctcatcgactgcggcgtgctcttccccgaggaggagcagccgggcgtggatctcatcctgcccgatttcagctacatcaagaaccgtctcgacaaggtcgacgccctggtgctcacccacggccacgaggaccacatcggcggcgtgccctacctgctcaagctgcgtccggacatcccgctgatcggctccaagctgaccctcgccttcgtggacgccaagtgcaaggaacaccaccagaaccccaccaaggttgaggttgccggccgtgagaagctcaaggtgggtcccttcgacctcgaattcgtcaacgtcacccactccatcccggacgccctggccgtctatgtcaagaccccggccggctccctgatcgacacgggcgatatcaagctcgaccagctgccgctcgaccaccgcatcaccgacctcgtcgaattcggcaagatcggcgaaaagggcgtggacctgctgatgatggactccaccaacgccgaggtgcccggcttcgtcaagcccgagacctccatcggcccggcccttgaccaagcgttcgcccaggccacccgcaaaatcatcgtcgccagcttctcctcccacgtgcaccgtgtgcagcaggtggtggacgccgcccacaagtacggccgcaaggtcgtgttcgtcggccgttcgatggtgcgcaacatgtccatcgccgccgacctcggctacctgcacatccccgaaggcaccgtcgtggacctgaagcaggccaacgacattcaggacgacaagctcgtcttcatgtgcaccggctcccagggcgaaccgatggccgcactcggccgcatcgccgacggcaaccaccgcgatatccacatcaacgagttcgacaccgtgattctcgccagctccctgattccaggcaatgagcacggcgtctacaaggtgatcaacaagctcgtgcagctcggcgccaaggtcgtcaaccgcgacaacgccgccgtgcacgtgtccggccactgcaacgagggcgagctgctgtacatgtacaacatcgtcaagcccaagtgcgccatgccgatccacggcgaaaaccgccatctggtggccaacggcctgatcgccgtcaagaccggcgtggacccgcagaacgtggttttggccgaagacggcgatgtggtcgacctgtaccacggcagggccgcggtcgtcggctccgtgccgtgtggttacgtgtacgtcgatggcgattccgtcggcgagctgaccgatgacgagctggaaaagcgccgcattctcggcaccgagggcttcgtctccgcgttcgtggtggtcgacaccgacaatcacgaggtcgtcaccggcccgaagatctacctgaatgccgtggccgaggacgaaagcgagttcgacaaggttcgtcaccagatcgtcgaacagctcaacgaccagatgatgcagggcacgcgcgacacctacaagctgcagcagaccatgcgccgcacgctcggcagctgggttgcgcgccagctgcaccgcaagccgatgatcgtgcccgtcgtggccgacatcgcccaggacgtcgaaaccgtagaaaccaagtagtccggattatccagggacgaccgtaaggagtaattgaagtcatgcccggttctaatctcactcgtattgaagccgaagaacgtaaggccgttatcgaagcgccgattcactatcacgtcgaccttgacctgacggtcggcgcgaagaacttcggttccaagtcgttcatctgcttcaacgcgaagcctggttcgtcgaccttcctcgacctgatcgccgacgaagtgacctccatcgacctcaacggcaagtccctggacccggccgtggccttccaagacaaccgcatcgaactgaccgacctcaaggagaagaacgaggtcaccgtcgaagccaggtgccgttactccaacactggcgagggcctgcaccgctcggtcgacccgtccgatggcaacatctacctgtactcccagttcgaggtgccggacgctcgccgcgtctacgccgtgttcgaccagcctgacctgaaggccaccttcgacttcaaggtgctcgctcccgccagctggatcgtcacctccaacatgccggttgccaccatcgaggacgatccgcgcgaaaccctcgacggcaccctcggcgacaagccgaacgaaagcacccgtctgtgggacttcgagccgaccccggtgatgagctcctacctgaccgccatctgcgccggcccgtacgccgaatggcacaccgaatacctgaacgaagacggccgtaccgtgccaatggcccagtactgccgacagtcgttggccaaggccttcgcgaaggacgtcgactacctgttcgacatcaccaagaagggcttcgcgttctacgccaagacctggggcgtgccctacccgtacgccaagttcgaccagatctacgtgcccgaatacaacgcgggcgccatggagaacatcggcatggtcaccatccgcgactcctacgtgttcgaatccaaggtgaccgacgcgctggccgagcgccgcgtggtgaccgtgctgcacgagcttgcgcacatgtggttcggcgactatgtgaccatgaagtggtggaacgacctgtggctcaacgagtccttcgctgaattcacctccacgctggccactgccgaagccaccgaatggcatgacgcttgggccactttctgctccggcgagaagagctgggcgctgcgccaggatcagctgcccaccacgcacccgatcgtcgcgccgatcaacgacctcaacgacacttacgtcaactttgacggcatcacctacgccaagggcgcctccgtgctgaagcagctggcattctacgtgggccgcacgcagttcttcgaaggtatccacaactacctgaaccgtcacgcctactccaacgccaccctggccgacctgctgagcgaactggaaaagacctccggccgcgatctcaaggcctggagcgccaagtggctggaggaatccggcatcaacacgatcgccactggcctgaccgtaaacgcggacggcaccatcgccgaactgaagctcacccagagcgcgccggccgaacacccggtgctgcgcccgcatcgcctggccgtcggcttctacaacgaagacgccgcaaccggcaagatcgtgcgcaccgagcagttcgaactcgatgtagatggcgaaaccaccatcgtcgaggccgcagccggcaagccgcgcccggcattcgtgctggtcaacgacgatgacctgacctacaccaagattcgtttcgacgccgaatcccaggcattcgccgaagccaacctgcatcgtttcgatgatgccctggcccgcgccgtgacctggctcgccttctgggatatgacccgtgacggcgaattcccggccgaacgcttcgtggacatgaccctgcgtcttctggccacggaaaccgaatccaccaccttccgttacgcgctggcctgcatgagcaccaccgcccaccactacgtggcgcccgcccgccgcgacgatgtgctgcgccacgtggccgccgaactgtggactctggccaacgccgccgaagccggctcggacacccagttccagctcgtcaccgcctacttgggctacggtgaggagggcgacgccgcattcgccgccaacgcacacggtctgctggacggcaccgtgcgtcttgaaggcctcgaaatcgacaacaacttcacgtggaccatcgtccaagcgctcacctccgtcaacgagatgaccaacgacgacgtggacgcgcagctcgccaagaaggagaccacggaaaaccgcgagttcgcctacggcgcccgtgcctccatggccaccgctgaggccaaggaatgggcttgggatcaggcgctccacaacgacgagctgaccaactcccagctcgaggccgtggcccgtggcttctccgccaccccgcgctccgatctggccgagccgttcgccgccaagtacttcgagactgtggactgggtctgggccaacaagacctaccacatggccgacgccctgctcaacggcctgtacccgggctacgccgatcccgccacgctggtcaagctcggtgacgcctggctggacgagcacattgccgccgacaatgccctgaagcgtctgatcgtcgaaaacgtggcatcctcccaccgcaccctcaaggttcgcgaatacaacgaagcgctctgatttccttctggctcccctcgggcgcgaggggagctgtcgcctcaggcgactgaggggagtcgcttccgcgagaagctacgtccacattccaacataaaacccgcaaccaatcctcaacagcgtattctcgctcaaggccggcaatatgccggtcgatgagcgacaaggatacggggaatgattgcgggcttttccataacttcattactgctgattctgttggccggaatcggcgcaggattcgtgggctatgcggtaggcgcatcgtcactggtctcatacccggccctgctcgcgttcggcattccgcctgtattggcaaacgcttctaacaccgttggcgtggtcggcacgggcatcggtggcgtgatgggtgcgcgcaaagaactcaaaggccaagcggtacgctccattacgtatgtggtcatcggcgcattcggcggggtggccggtgcgtttctgttgctcaaactcgacccgagtgtctttgaatttgccgcaccagtgctgattttgctgagctcgctgatcatcgccatcaatccgcgcggccgcatgcaggccaagcaagccgccgcggatgccaccgcgcaactcaagcacatcgaagccactgaagccactgaagccactgaagccactgaagccactgaagccgccaagcgcgcaaccacccctaccgcacctcaccgcccgccggaacaactcgtgcagcccatgagtcaggattcctggtgggtatggctgggcgtagcggcggtcgccatctactccggctacttcggcgcgggcgccggtaccttggctctcgccgtgcttgatgccgccaaaatcggcccattccacaagatcaatgcattgaaaaccctgatcggcacaggcgcgaacatcagcgcctcagtggtattcatcatccaaggcgcggtcgattggccggccgccatcatgctgtgcatcggatgcttcatcggcgggtacatcgccccgtccatcacccgcaagattcccgcaaacatcatgcgcgccgccgccgtaatcgccggcatcattcttaccatcgatctggggctcaaaacctattgattcgtgccttacactgatgcagtgaagcatacagcatggccgtcaaccgcagcgtggtcgcagaccccgataaggtggccaatgtctggcatttggcgactgcggaacctgagcgcctagaaaccagcgcggcaggcgaagcggtgaacgacttcctcgatccgccagacacgtcgcagattcacggcattgcgtgtcatgctgattggcggttcgcggcgcgagcaggtgctgttcgccggcgttatgaaggagctactcgcgcccatcaacaatccgcgatatgtcatcatcggtaaggaatggggcgtgcgcgcttactgcgtgagcttcccctgcccgtccgtatttgcccgccgccagcaggacgccgagatactgagccggcagttggaccgctgcctgacgcattgcaccatggtatacgcccgcactgaggaaggtcggcatacgctacttcgctgccaaacgcgttctttcctcaaccgcgacgagcaactgccgcacatactgaccacaacatcggagtaatagatcgttgcattcatggccgagaccaccccggtagaggagatgccgttgggcatgttcatcgcatggctcagcgtgttcctcgccgtcgttctgtttggtgttgctttgccggttatcgatgtacgctgggtagttccgttcgtcgtatttgccgctgtattgtttacaggcgcgtttgccggcccgttcttactagtgcgatggcttcgttcccgtgccggagtgcatcggtccgcccggcatgcccgctaacgaatgtatctcatcattcatccgccgaacaagatgaatatgcgggtttgtgggtgatgccattgcggctgttgaatgctgatttccggttctggagcagattccgtggcggttttttgccgagtcgggtcctagggtggagcacaacgactacgatggtgcgggtaacgcgatacaaggagtggaacttcatatgccgaagatgtttggaaccgatggtgttcgaggactggccaatagggatttgaccgcacgtctggcgttggatttgggcgatgccgccgtgcgtgtgctcggcgacgccggcacccaagacgatcagcctgaggggcgccgccgcgcgctcgtgggtcgtgacacccgtgtgtccggcgattttctggcttccgccctgtctgcgggcatggccgccggcggattcgacgtgatcgacgcaggcatcatcccgaccccgggcatcgcgttcctgaccagcgtgctcaacgttgagatgggtgccgtgatctccgcctcccacaacccgatgcccgacaacggcatcaagttcttcgcacgcggcggcttcaagctgcccgaccagaaggaagacgacatcgaggccgtgctcggccaggactgggaccgcccgaccggtgccggcgtgggccgcgtgagccacgaccagaccaccgccaccaacctgtacatcgatcatctggtggccaccatcgctccgctgaacgatgacaaaacccagcccaagccgctcaagggcctgaagatcgtggccgactgcgccaacggcgccacttccgtggtggctcccgaagccctgcgccgtgccggtgcggatgtaatcgtgatcaacgcctcgccggacggctacaacatcaacaagaacgccggttccacccaccccgagcagctgcaggccatggtcaaggccaccgatgccgtgatgggcgtggccttcgacggcgacgccgaccgttgcctcgccgtggacgaagacggcaacatgatcaacggcgaccagatcatgggcattctggcccgcgccaagcagcgcgaaggcaagctcaaccacgacaccctcgtggtcaccgtgatgagcaacctcggtctgaagctcgccctgaaagatatgggcatcaagaccgtggaaaccgccgtgggcgatcgttacgtgcttgaggaaatgctcaagggcgattactcgctcggcggcgagcagtccggccacgtgatcaaccgcgaattcgccaccaccggcgacggcaccctgaccgcactgaccctgtgcaacgaggtcgtcaagtccggcaagagcctgaaggagctcgccgccgacttcccgcagctgccgcagaccctcatcaacgtgccgaacgtggacaagaaggccgcctccaccaacaagcgcatccaggatgccgtggcccgtgaggaggaactgctgggagacaccggccgtgtgctgctgcgcccctccggcaccgaaccgctcgtgcgcgtgatggccgaggccgccacccaagcctacgccgacgaagtctgcacccgcctcgccaagatcgtcgccgaagaactcgcgctgtagcacccttccctaaggaaaaaaacaatgtttggaaagaacgccaaagtcgacctcgaactcaaccgtgatgtcgaaaaactcatcaaaaccggcggcaaggagaagctcctgcccatcgtgcaggccggcgaaccggtgttgcgccaacggacagtggcctataatggccagctttccaagcgtacgctcgccaaactcatcgatacgatgcacaccaccatgctggaggcacccggcgtggggctcgccgccacccagatcggcttggggctcgcgctcgccgtggtcgaagaccacgtgcgcgacgacgaggatgatccgcgcgaaatcgcggaattccccttccacgtgatcatcaacccgagctacaaacccaccagcgacaaaaccgcctcgttctacgagggctgcctgagcttcgacggataccaagctgtgcgcaagcgttggctcgacatcaccgccgaatgggatgatgaagacggcaaacaccacagcgagccgctgcacggctggcccgcacgcatcttccagcacgaaaccgatcatttgagcggcgagttgtatatcgatcgcgccgaaatccgttcgctgaccaccaacgagaacctcgaggactactggtgcgaagacccggtgcccaccgaggccgctgaagagctcggtttcgcactatgaccgaccgtgcatggttcgacgccgccaagggagacattccccaatgggcggcgtccatgcccaaggacgccgatggcaccaccatcgactgggactgggtgcgttctctggacctggcgcatggcgtcggcacaataccggaatccaccccacagtccatccacgacgcattgaaggccgactacgccacacgcgagcgtctggaatcgatcatcgcccaatgcaacagcgcattcatgaccgatttcgaccggttcatcggctcctatcgtctgcctcgcgcgctcgcctacgccaatcgtcggctcaacgacaacatcaacacgctgttgcatctgggcgaacagcaacacctatgggcggtcagtcgcgaacggcgggggagggccaccattgccgtgctcaagccgtactccggcagcggcccgtcgaacgatgaccaaggcatgctggatctgagcggcgaagccggtggcacatctgccggaaacactgccgccgaaaacagcgatgtcaagttccccacaacagtcgccttggacgatgtccaagatcgtacggcagcgattcttgacgcacgcgccgaacggcgtaaggcccagcgcttccagaagcgggcgggcgatgcggcgatggcccgcgccaatctctccggcgcgacttcgccgggtggtgccgctctgccgggtggtgccgccgcgtctggcaacgctaccggacaccatcccaagcccgactggcgcgacgcctacctgcccggccgcgacgtggatgcggtgatgggcatcgacatcgaaaccaccggcatcgatccggcacgtgactacatcatcgacgtcggcttcgagttcatgaacatggccagtccgcgcccggccggcgaacccgagacatacgcctatgagcagggctattacgccgccggcgacgcctacggccagtcccgcctcgcttttggcgtgccgccggaaaacgcggcgctcggcaacgccctcatcgccaaactcaccggtatcgatgtacgcggccgcagcagcgaggccgggtaccgactcttcgacgaatggccccaagcccaggccggcctgctcgcgcggcttacccagcagccgtacgtggcgcataacgccaccttcgaacatagctggttcatgctgaacgtcgccggatacgcggaaagctaccgcgccgggcgcatcaccatcatcgataccctgccgatgagccggcagtgggaccccggcgcggtacccaccaacgagcatccttacggagacaacacgctcgacgcctacgccaaacgtcagggcgcgcttgattccgcccacaacgaacgccacctgggccttgaggattcgcacatcatgctggtggccatgaaacaccatctggcggcgctgaaagcgcaagggaaagggccgtgggggtccaccggcagggcgggcatcggcggcaagtcctgcggtcgtaagcggtgagtacactattggtctcgtgagtaactatcaggacagccgacagcagcgtgagaaccgccgccgcaccatcgtgcgtgtggtgtgcgtggtcatagctgtggccatgctcggctccctggtcatcccggcgatttacgcggggctttgacgttgccttcgcatattcgtgcccgcagttgaacacgtctgatgcgagggattcgtgaggtcgcccggccggttatcggcaaggcaggcccggaaccttctgacagcatggattgcaggcggatgcgcgtgtggcgcggcaatgcccgccaacgccagaggaatgtgcgaaggctgtcaacaaggacgtgacttcccaaggaatctcaaagaatcaacagtaaggtaaaccacgatggcagaatttgactttacccaggcgatcggcgaagcccgcgccaaatacgaatccatcgccaaggcgctggacgtcgaccgactcaaggccgatatcaaggatctcgaaacgcaggccgcggccccgggcctgtgggatgacccggaaaacgcccagaagatcaccagccggctgtccgccgcggaatcgcagctgaagcgtctgaactccgcctcccagcgcatcgacgatgtggaaacgctcgtcgaactcggccacgaggagggcgatcaggactctctggacgaggcgcaaagcgaaatcggcgagatccagaaggatctcgaccagatggagattcagaccctgcttgacggcgaatatgacgaacgttccgccgtggtgaccatccgctccggtgccggcggcgtcgacgcggccgacttcgcgcagatgctgctgcgcatgtacctgcgctactgcgagcgtaacggcttcaaggccaaggtcatggacacctcctacgccgaagaggcgggcatcaagtccgccaccttccaggtggacgccccctacgcttacggccgactgtccgtggaaggcggcacccaccgtctggtgcgcatctccccgttcgacaaccagggtcgccgccagaccagcttcgccgccgtggaagtggtgccgctggtcgaggccaccgatcacatcgacattccggatacggacatccgcgtggacacctactgctcctccggccccggcggccagggcgtgaacaccacgtactcggccgtgcgcatcacccaccttcccaccggcatcgtggtgaccatgcaggatgagcgttcgcagattcagaaccgcgcctccgccatggccgtgctccagtcccgactgctcgtgctgcgccacgaggaggaggccaagaagaagaaggagctcgccggcgatatcaaggccagctggggcgatcagatgcgctcctacgtgctgcacccctaccagatggtcaaggatttgcgcaccggctacgaaaccagccagacccaggccgtgttcgacggcgacatcaacgcgttcatcgaggccggcatccgctggcgccacgaacagcgccgcgccgccgaaaccgaggagtaagcagcattatggcgctgatctcactggacaatgtgtccaagatctatcccaaaggcacccgaccggcgcttgacgacatcaacctcgatatcgaacgcggtgatttcgtgttccttgtgggtgcgtccggctccggcaagaccacgctcttgagcctgctgttgcgcgaggaagaggccaccaacggcgagattcgcgtggccggcaacgatctgcggcgcatcaccaaccgtcaagtgccgcagtaccgccgttcgctgggcttcgtgttccaggattacaagctgctcaataacaaaaccgtgtgggagaacgtggcgttcgcccttgaggtgatcggcacacggcggtccaccatcaaatcgttggtgcccaaggtgctggataccgtggggctcaccggcaaggaaaagaactacccgcatgagctctccggtggcgagcagcagcgtgtggccatcgcccgcgcctacgtgaaccacccgcagattctgctggccgacgagcccaccggcaacctcgacccgaccacttcgctgggcatcatggaagtgctggacgccatcaaccgcaccggcaccaccatcgtcatggccacgcataacgaagagatcgtcaactcgatgcgcaagcgcgtggtcgaactgcacaacggcaagatcgtgcgtgacgaggctcatggctcctatgattccgccctgttcttcccggatgccgaagtcgaagccaagtccgacgccgcccatcatgtgctggcggcggcgaccaaggccatcgagggcagtgacgagccgtccgaaggcatcgcccgtctggccaactccgtgcattccggccgcaccggccgctatggcgagacgttcgcgccgctggaagacacgctgacctggggcaagggcatcccgttggacgagcaggccgccgccctggaaagcacccaggcgttcgacccgttcaatgacgagtccggcgagaccgccgcggttgccgatacgtccgtgtcatccgccgccgagccgccggccccgccggaaccgcccgagccgccgaccccgccggaaccgcccgtaccgcctgtcggcgagcagtccgccgcagaccaaacatccgacgatcaacccgctgagggcgcgaaggagtaagggggatcatatgcgagcacgattcattctgtccgaaacgtgggccaacctcacccgtaacctgtcgatgctgctgtcgctgacgctggtcaccttcatctcattcctgttcatcggcgcttcggtgcttactcaggcgcagatcaccaaagccaagggcgactggtacgacaaggtcgaggtcgtggtgtggctatgccccgacggcaccagccaatccgcgaactgcgcttccggcaaatcgccctcagccaatgagatcacggcactgcagaaaaccattcgcgacgaactcaacgacgtggtctccaacattgactacgtcagcaagcaggacttctacgacagcacattcaccaagcagtacccgaatggcgaattccaaggccgtacgctgaccgcggacgatatgcaggactctctctggctcaagctgaaggatccgaccaaatatcaggtggtctccgaagtgctctccggcaaggagggcgtggaagacgtcaccgaccagcgccagatcttcgacccggtgttcgccgtgctcaaccgagccacggcggttacggccgtgctcgccggcgtgatggtggtggtcgccatcctgctgaccggaaccaccattcgcatgtccgccgcgtccagacgaaccgaaaccgaaatcatgagatacgtgggtgcctcgaactggacgattcgtctgccgttcattctggagggcgccatcgcctcactgatcggctcggtgctctcgtgcctgatgctttcggccattgtgaacgtgttcatcaccggctggctggcgaaatccattacatggattccttatgtgaatcagctcacggtactggtgatatcgccgttcctggttgtgggcgcgatactgctgtccatcatcgcttcaaccatttcgttgcggcgttatttgagggcgtaacgcgaccggcttacccgcgagaaatgtgatgacatcgtgtgcaagcctctcaggttcgcatgttatggtattggcttaagtgagcgaaaggaccattcacatatgacgaatgtacgtgtgatcaagcccgcactggcggcattggtggccgccgcagcctgtgtgggaggtctggcgttcggctcgtcccaacctgcccaggcagacacctattccgacctgatcaatgcgcagaaccagcacgccgcgtcggtacagcgcgaggccgaactcaagcagcagttggccggtgtcaaccaggaactggcggataaggtacttgagctggatgatttgacgaacaacaagattgtcgccgcccagaacaaggtcacgcaggccaacgaggatgccgccaccgctcaggacgaggccgacgccgcatccgaacgtctttccgccgcacagaaagacaaggagacgctcgaggagcagatcaagcagaccggcaaggactacgatgacgcgcacgccgccgtggcccagctggcccgtgacgagatgcacggctcgaatgcttccgacgtgatgagcgtggtcacgggtgccaccagcacacaggacttcgtcaactccatgcagtcccgggacgcgttgtcccgcaacgaggcgaatgcggcttcctccgccgcgaactcgctgagcacgtcgaagaaccgtggcgaacgtctgtcggccatcgaaaagcagatcgctgtgctcaagacccaggccgatgagaaggccgcttccgcgcagaccgccgccgaaaccgcgcaaagcgaacgtgacgctttggacaagctacgtcaggaaggcgaagcaaggcgtaacgaactgtcttccatgatcgacagtctggattcccaatccgccaagcaggcggcccagaccgtactgatcgcctcccaggtcgattcctacaatcgtcagtaccagaaggagcagcaggacgccgccaaccgggtggacaccggtaaccagggcggtacgccgaccactccggtgactcctactcccactcccacaccgacgccggcccccaccccgacggttcccagcggtggcggcaacagcagcggccaaggtacatcgaacggtgattacggcaacgcctatgccaccggccagtgcacgtattgggcgtatgaacgccgtaagcagatgggcattggcacgccgtcctatctcggcaatggcggttactggtggcgcagcgccccctcgtacggcttgcgcgtggaccacaaccctcaggtcggtgcggcgctctccttcttgcctggtcaggacggtgccgatggtacctatggccatgttgccgtggtcgaagccgtgtatggcgacggcacattccagatttctgaaatgaactggggtggtccgtggatcatgcactaccgcaccttgaccaatttgggtcagtactggttcgtccactgatcggttggttcggccgatatatacggttgaagggttcctcttgaagaggaaccctttttcgtattcgaggccggtccgtgatatcgtcggatgttgcgttgctacccacgaaaggaggagacatgcccaaggaaaccggtgagaaactcatcgtacagaacaagaaggcccggcatgactatgccatcgaagacaagtacgaggcagggctggccctgaccggcaccgaggtcaagtcgttgcgcgaaggccgcgcatcgctgtccgaggcgttcatctccatcgaccgccgcggcgagatgtggctggagggcgcgaacatccccgaatacctgaacggcacatggaacaaccatgcgcccaagcgcaagcgcaagctgctgctgcaccgactgcagatcaccaagctcgcccgcggcatcgaggccaagggatacacgattgtgccgctgagcctgtacttcaaggacggtcgcgtcaaggcggagatcgcactggcccgaggcaagaaggaattcgacaaacgtcaggccctgcgcgaagagcaggacaagcgcgaagccctacgcgccatgcgctacgccaacatgcgccactaatcccgtcccttggctcccctccggaggggagccaagagtaggatgtccacgttgtgggccatttcgcccacgattaacgcttccgtagcattgcactcctacgctctggaaccatctgggaaacatacccgcccagctgactatccggagagaggaaatccaatgtctctaagcaagggaatacaatccgctgcggccgccgccctgagcgcggccatgctgatcgccttggcagcctgtggcacgactgacagcaccgacaccgcagccaagagcggcgattcatccaaggactcgtccagcacttcgattcaaggcttcgacaccagcagcatccagaaggacgacgagatagccgcactgctgcctgattccgtcaccagcgacggcacgctgaccgtcggcaccgatacctcttacgctccggccgaattcctggccgaagacggcaagaccccggtcggcttcgacgtcgacctgtccaaggccatcgccgccgtattcggcctgaaggaagaaaccatctcctctaccttcgactccatcattccgtccgtgggctccaagtacgaccttggcatctcctccttcaccgtgaccaaagagcgcatgcaggccgtcgacttcgtcacctacttcaaggccggttccacctacgtggtgcagaagggcaacccgaacaaggtcgactcctcgaacctgtgcggcgtgaaggtggccgtgcagaccggtaccacccaggaagaggaagtcaacaaggccaacgagcagtgcaaggcggacggcaaggatgccatcgacatccagtcctccaagctgcagaccgatgtgaccaccgccgtggcttccggcaaggcctccatcttctacgccgattccacggtgtccgcctacgccatcaagcagaccggcgacaccttggagacgctcggtgaagacgccggcggggtgcccgaggccgtggccatcaagaagggcgataccaagaccgccgaagccgtgcagaaggccatccagaagctgatggacgacggcacctacaagaagatcctcgacacttggggtgttggttccggtgccatcgacaaggctgagatcaacccggccgacgccgcctgattgccaggtgtccctgttcgttcccgctggcgggagctgtcgccgaaggcgactgagggtggtctgtagcataacagccaccagcagttgtattcttatgcggcggcctcccagcgggagcatttgtatatgtatacgctataatgtatatttatacctgattgttgatagtcgctatagggcggctccacagagaagaagagagagatcatgcagttcaacaagctgaagaccattgcggccgccgccttgagcgtggccatgctgttctccgccgcggcttgcggcacctccgacaaggcgggtgactccggttccgataagggcggttcctccaagtcggtcaccatcaccagctacgacgtgagctccgtgaagaaggacgatgcaatcgccgcactgctgcctgaatccgtgaccaaggacggcaagctcaccatcggcaccaacccctcctacgccccggccgaattcctcgacgccgacggcaagacccagatcggctacgacatggatcttgcccgcgccatgggcaacatcttcggtctcgataccgaaatcgtctcctccaacttcgatacgatcattccggccatcggctccaagtacgatctgggcatcgctgccttcaccatcaccaaggagcgcatggaatccgtcgacttcgtctcctacttcaccgcaggcatgggctatgcagtggccgcaggcaaccccaagaacgtcgatgagaacgacctgtgcggtctgaacgttgccgtcgagaccggcaccgtcgaggaagaggccatcaacaagaccgccaagcagtgcaaggcggacggcaagaaagacatcaccatccagtcctccaagcagcagaccgacgccaccaccgctgtggtgaccggcaaggccgacgtcttcttcgccgattccccggttgtcggctacgccattgcccagaccgatggtcagctggaacagctcggcaaggacttcgatgaagtgccgaacgccatcgccatcaaaaagggcgattcccagaccaccgaagccgtgcagaaggccatgcaaaagcttatggacgacggcacctacaccaagatcctccagcactggggcgtcgaatccggcgcactggacaaggccgaaatcaacccggccgtcgaatagccgacaagctgtcgcgaaaattcgaatggggcgcactgtttgtaacacagtcgccccattcgtacactaaggttcaacgctagttgcaacttgcagttcaggctgcccaacacgtccaaggaaccaaattatggcgaagaaagaagtcgacggtgagggagtgaacatccccaaccgcatcaaggcgctgccggtcaagcgccccggcccgattgtggccgcagtgatcgtggtgctgctcgccgcgatgctcattcaaggcttgattaccaatccgcgactggattggcccaccgtctggaagtacctgttcaacgagaacgtgcttgaaggcattcgctataccttggagctcaccgtgatctccatggtcgtggcgatcatcctgtcggtgattctcgccatcatgcgcaaatccatcaatccggtgctgcgcggcgtcagctggttcttcatctggttcttccgcggcacgcctgtgtacacgcagctcattttctggggtctgttcgccgtgctgattcccaagattagcctcggcattccgttcacctcggtggagttctggagcatcgactccaacgtggtggtcaccgcattcaacgccgcatggattggtttggctctgaacgaggccgcctacctgtccgaaatcgtgcgtgccggccttgaagccgtggaccccggccagaccgaggcggccaaggcattgggcatgaaccgcacgctcatcatgcgccgcatcgtgctgccgcaggctatgcgcatcatcatcccgcccaccggcaacgagaccatcggcatgctgaagaccacctcgctggtcaccgccgtgccgttcaccctcgaactgcagttcgccaccaacgccatcgccaaccgtatctacaagccgattccgctgcttctcgtggcctgcttctggtacctgctgatcacctccattctgatggttgtgcagtcccgccttgaggcgcacttcggcaagggcttcaacgcccgcccggtgggcaccaagggcaagcagccgccattgccgggtaagaccgacggtgaaccgaaggatgacgtggacaagctcaaccagaccacatttgtcggattgaatgcataaggcgggagcgcgattatgactacgaatgacatcaccagtgttgccccggtcgtgcgcaaggcggctgacggttccgtgattcctgctgtcaaggccgtgcaggtgcacaaggcgtttgggccgctgcatgtgctcaagggcatcgatctaaccgttatgcccggtactgtgaccgtgattctggggccctccggttccggcaagtccacgttcctgcgtctgatcaaccagctggaaaccctgaccggcggttccatcgaggtggacggcgaactcatcggctacaagcacgtgaccaaaaacggccaggacatgctgcagaccctggacgataaggagatcgccgcacagcgttctcgcctcggcatggtgttccagcgcttcaacctgttcccgcacatgaccgcgctggaaaacgtgatggaagccccgattcacgtgcagcaccagtccaagaaagccgcccgtgacctggccgtggccgagcttcagcgcgtcggtctgggcgatcgcatggactattacccctcccagctgtcaggtggtcagcagcagcgtgtggccattgcccgtgctctggccatgaagccggagatcatgcttttcgatgagccgacctccgcccttgaccccgaactggtgggtgaagtgctcaacgtcatgcgttccttggccaaggaaggcatgaccatggtgtgcgtgacccacgaaatcggcttcgcccgcgaagtcgccgaccagatcgtgttcatggacggcggcgtagtcgtagaaaagggcggccccgacatcatcgaccaccccaccgagcctaggtttaaggacttcttgcagcacgtgctgtaggaaggctcgttgttgcagctccaaaaacgtacgctgatgaactcagcgtacgtttttttgcgacgcctaatcgcacccccatctcgtgaagaacgtacgctgagtggtagtcagtgtacggttttcacgaaggggcatgttccaatcctgcaaaggcggcgggttggattcgctttgcgcaataatcgtccgctaggctggtgagccatgtgtggaatcgttggatacgcgggaaatattgaaacggcatgcggcaagcctttggaggtctgcctgcaaggcctggaacgtctggaataccgaggctatgactcggccggtgtggcgctgaccgcgcccggcatggataaggtggtcgtgcgcaagaaggccggccgtttgaagaacctggtcgaagacatcgagcgtaagccgatgccgcttgccacggtgggcatcggccacacgcgctgggccaccaatggcgagccgagcgacgtgaacgcccacccgcacaccagcatggacggcaaggtggccatcatccataacggcatcatcgaaaacgcctctcagctgcgtctcgacctgcaagccgaaggctaccgattcgcctctgccaccgacactgaggtggccgctaagctgctcggcaagatcgtggacaagattatcgcggacgaaggcaagccagacctgttcaaggctgtgcgccgcatggcccgcatgcttgaaggcgcgttcaccattctggccaccgactgccgccagccggacatcgtggtcggagcccgccatgattcgccgctggtcgtgggccttggcgagggggagaacttcctcggttccgacgtcgccgcattcgtggcctacaccaagcgcgccatggaagtcgaccaggatcaggccgtatgcgtgtccgccgacaaggtcatcgtcaccgatttcgacggcaacgtggtcgaaaacccgaagacctacaccgtggattgggatgcttcggccgccgaaaagggcggctgggattcctttatggacaaggagatccacgaagaccctgccgcagtgcagcgcaccctgcttggccgcttcgatgcgaatggcggcatcacccttgatgaagtgcgtatcgacgaacacgacttcaaggccatcgacaaaatcatcgtcgtggcctgcggcaccgccagctacgccggccaggtagccaagtacgccatcgaacactgggtgcgtatccccgtggaaatcgaactcgcgcacgaattccgttaccgtgacccgattctgaccccgcgtacgctcgtggtggccatttctcagtccggcgaaaccatggatactctgatggccctgcgccacgcgcgcgaacaggggtccaaggtgctggccatctgcaacacgcagggtgcctccattccgcgcgaatccgacgccgtgctctacacacacgccggcccggaagttgccgtggcatccaccaaggcgtttgtggcgcagatcaccgccgcctacctgctgggcctgtatctggcgcaggtcaagggcgcgatgttccgcgatgagattcatcaggtgcttgactccctgaaagacatgccgcgcaagattcagtgggtgctcgacacccagcccaagaccatccaggcggccgccgagcgcatggtgaacgccaactccttcttgttcctcggccgtcacgtgggctacccggtggcgcttgagggtgcactgaagctcaaggagatcgcctacacgttcaccgagggcttcgcggccggcgagctcaagcatggaccgatcgcgctggtggacgagggtgagcccgtggtgttcatcgtgccgccgcagcgcggccgcaatgtgttgcacgccaaggtgatctctggtatcgaggaggtcaaggctcgtggcgcgtacatcatcgccgtggccgagcagggcgacccggatgtggaacggtacgctgacgtggtgttctggcgccccgcctgcccaacgctgatgagcccgctggttgacgtggtgccgctgcagctgttcgccatggacatggcaaagctcaagggctacgacgtggacaagccccgcaacctcgccaagtccgtgaccgttgagtaagccacatcggtatgtgattgacgagcctcatattccgtttgagatggacgtgctgtatgaggacgagcggatcatcgtggtggacaagccgcattttctggccaccatgccgcgcggcatgtggtatcggcagaccgcgctgatccgattgcgtgagcggctgggggagccggacatcacgccagcgcaccgattggaccgcatgaccgccggcgtattggtgttcgtgcgggatccggcctgccgcggcgcgtatcagatgctgttccagaaccggcaggccgtcaaggtctatgaatgcctggcgccctgccggccgatcagccgcccgcgattcggcacgatcatgcaggtcgagccgccacgcccgttcccattgctgcgccgatcgcacatcaccaaggaacacggcacgatggccgcattcgaggaaccgggtttggccaacgccgaaaccctcatcgagcgcggcgacctctgtttccctcccgctgacgggaggtggcgcgaagcgccggagggtggtccccatccggggaatcaccccatctgccgctacacactccacccgcgcaccggcaaaacccaccaattgcgcgtccacatgaattcgctcggcctgcccatcgtgggcgacgacttctacccgcgcatccagacgcgcccctacgacgatttcagccaaccattgcagttggtagcacgcatgctgcgattcaccgatccaataacaggcgagaagcgcgaattcgtttcccgtgtgccgcttaagatctgatttcttatgcattgagagtgttttcgctcatggtgtcaccattcatagagttcggcgggctgcggggttttgcggacatccagcgacaagccaagctcagtcagggcgctgagaatggtggagaattcgggattggggactcgggcgtgttcaaattcgatcagccagcgacgtggcacgcccagccgttgggccatgtcggtctgactaatgccctggcgttgcctatgaatcactggcaggtggatcactggcaggtaccagtggatgccagcgcatgccgctcgtcagctgatgtcgagcacggaaccgcgttcaatcagttccggcgggattacggttttgacgccgaccggtatcttctcgccttcgcattgacggcggaccatggagaaggcggtggcgccaatgtcgtcaaagcgcagcttcatggtcgtcaggttcaagcgcgggaccatatcgaccagcgaatcatcgacgcccacgatgctgacatcctcgggcacacgcttgcccactgactgcaacccgagcattgcgccgtacgccatctggtcgttggcggcgtagatggccgtgcagtcggggtcgtgggccaacgccacgccggcctggtagcctgaatccgcgcaccaatcgccgatatacatgctcggtacgcgtgctcccatttgttccaacgcttctcgccaaccgcgggcgcggctttcggcggcacgcgaggtggacggtccggcaatgtggtagacggtcttgtgtcccttgctcatcaggtaatcgacgatagcgatcgagcagccatactggtcggcgtcaacagtggggcagtggtcggcggcggattcgcagatgagcacgactggaagttctcgcggaggcttgtatccgacgaaatcggagatgcgttcctccagcactacgatgacaccatccaccggctgacgctgcatgcgatcgatggcggcggaaagcgtgcgttccgcaccgtggcgcatggtctggatggtgactgaataatcgtcatcggccgcgttggccacaatagaatcaaggatgcgggcgttgccgaacgtggcggtgttgaacatcaccacgccgatatcctggaagcggccgtgctttagggctcgggccgcataattcggacgatacccaaggcgtctcattgcagcttcgacacgctggcgtgtttcgggtttcaccgcatcgctgccattcgccacgcgggacactgtctgtggcgaaacgccggcggctttcgctatgtcttgcatggacacctgtgttggcctcgacatttcaccctcgcttgactcattaatgtcggtgtttcgtttgcaacgcttatcttagggccgcttacggtaacgataacatcgttgtcttcgtgaccattgtagcagagtgactgagaaacccttaattcaacacggtactcaacacgattggacaatgttacaaatggtgttatgatgataacgcaaacattttggtcaaccttcgaaggagaggggttgggaatggcttcagccgatatcgcagctgcgcccgtgcattcgggcaaggctcgtgtgaataagcacaaggccgattggcgtggatggaaattcatgtggccttttgcggtggtgttcgtgttcgtgttcatcgtgccgatcgtgtacgccgtttatatttcgttcttcaagaagcagatgatcggcggcaccaagttcgtcggcttcgagaactacgcgcgcctgttgggtgatggccagttctggagcagtgttggtcgtgtggccctgttcacgtgcgtgcaggtgccgatcatgctgtgcctgtcggctttgatggccctggcgttggattcgatgaagctgcatggcacgaggttcttccgtatctcgacgttcctgccctacgcggtgccggcggtggtgtcgacgttgatctggggtttcgtgtatggcgcgaagtacggcctggtgggttcgttgaacgatttcctgggcacggacatcgacgtgctcgcccccagcgtgttgttggccagtatcgggaacatcgtgacgtgggagttcacgggctacaacatgctcatcttctacagctcgctgtcgaccatcccgcattccctgtacgaggcggccagcatcgacggcgcgtcggagtggcagatcgtgaagagcatcaagcttcccgaattgcgcggcagcctggcgatcacggtgatcttcagcatcatcggctcgttccagctgttcaacgagccgagcattttgcagaacatggttcctggtaatgcgatcacgacgtattacacgccgaacatgtacgcgtacaacctgagcttctccggcaaccagtcgaactacgcggccgcgttggcgatcgtgatggccgtgatcaccatggccatcgcctacatcgtccagctcaacagcctcaaggagcagatgaagtgacgacgactactgctgttcgtgttgaggaatcgatgatgatcgtgaaggagcgtatgtgatgagtgcagcaacgacttcggccgccggtcgcctgaccgacgccgagctcaaggcccaggagaaggccgccaggaaggcggagaaggcccgccagaagaggatcgccgccgacgaggccgccgaacgcaggcgcagcgcgaaggccgggttcgcgaacgtgaacaacccgaggcgttccacgttgttgaccgtcctgtgcgcggtcttcgccgtgtactgcctgttcccgttcgtctaccttttgatcaacgcgacgaagacgcaggccgacttcaccagtacgttcggcctgggcttcggcaagacgttcgccctgttcgacaacatcgcgacggtgttctcctatcaggacggtatcttcgcgcgctggctgttcaacacgatcctgtacgtggtggtcggcgccggcggcgcgaccctgctggcgatcatgggcggctacgctctggccaagttccgcttcccggggcgcaaagcggtgttcgtggtcatcatcggcgcgatcagcgtgccgggcatcgctttggcggttccccagttcctcctgttcgccaaattgggcctgacgaacaccccgtgggccatgatcatcccgtcgctgatcagcccgttcggtttgtacctgatgtggatcttcagcgagcaggccgtgccccaggagctgctggaggccgcccgcgtggacggtgcctccgagttccgcacgttctggcagatcagcctcccgttgttggctccgggcatcgtgacgacggccctgttcacgatcgtggcgacgtggaacaactacttcctgccgttgatcatgctcaaggacgcggactggtacccgctgaccatcggcctgaaccagtggaaggaccaggcgagcacggccggcggccaggcgatccagaacctggtgatcacgggctccctgatcacgatcatccccttggtcatcgcgttcttgtgcctgcagaagtactggcagtccggcctggccgcaggcgccgtcaaggagtgagcgtactttggctcccttctggtggagggagccgagataaaggcgcataaccactaacagaaggaggcacctatgcagatattcgcattgttgagaattgtgcaggtgcctccttgtgtgtctgtgcaacgtgaggaatttattcccgtagacgcagattatcgataaaattcaataaaggaactgaatcatcatggaacgtaaagagttcaagtggccgcagcctcttgcgggcaacgagccccgcatctggtacggcggcgactacaaccccgaccagtggccggaggaagtctgggacgaagacatcgagcttatgcagcaggccggcgtcaacctcgtctccgtagccatcttctcctgggccaagcttgagcccgaagaaggcgtgtacgacttcgattggctcgatcgcgtcatcgacaagctcggcaaggccggcatcgccgtcgatctcgcctccggcaccgcatccccgccgatgtggatgacccaggcccacccggagatcctctgggtcgactaccgcggcgacgtctgccagcccggtgcccgccagcactggcgcgccaccagcccggtcttccttgactacgcgctcaacctgtgccgcaagatggccgagcactacaaggacaacccctatgtggtctcttggcatgtgagcaacgagtacggctgccacaaccgcttcgactattccgaagacgccgagcgcgccttccagaagtggtgcgagaagaagtacggcaccatcgacgctgtcaacgacgcttggggaaccgcattctgggcgcagcgcatgaacaatttttccgagatcatcccgccgcgcttcatcggcgacggcaacttcatgaacccgggcaagctgcttgactggaagcgcttcagctccgacgccctgctcgacttttacaaggccgagcgcgacgccctgctcgagatcgcccccaagccgcagaccaccaacttcatggtctccgccggcggtgccggcatcgattacgacaagtggggttacgacgtggacttcgtgtccaacgatcactacttcacgcctggcgaagctcacttcgacgagctggcttactcggcctccctatgtgacggcatcgcccgcaagaatccgtggttcctcatggagcactccagctccgccgtcaattggcgcccgatcaactatcgcgtcgagcccggcgaattggtgcgcgactccctggcccacttggccatgggctccgacgccatctgctacttccagtggcgccagtccaaggccggtgccgagaagtggcactcttcgatggttcctcacgcgggccccgactcccagatcttccgcgatgtgtgcgagctgggtgccgacctcaacaagcttgctgacgagggcctgctgagcaccaagctggtcaagtccaaggtcgccgtcgtcttcgattacgagtcccagtgggctacggaacacaccgccacgcctactcaggaggtacgccattggaccgagccgctcgcgtggttccgcgcgctggcggacaacggtctgactgcagacgtggtgccggttcgcggcccttgggacgagtacgaagccgtcgtgctgccgagcctgaccatcctgtccgaagagaccacgcgccgcgtgcgcgagtatgtggcgaacggcggcaagctgttcgtgacctactacaccggtctggtggacgacaaggatcacgtctggctgggtggctaccccggttccatccgtgacgtggtgggtgtgcgcgttgaggaattcgccccgatgggcaacgacttccccggtgccatggaccaccttgacttggacaacggaaccgtggcgcacgatttcgccgacgtgatcacctccgtggccgataccgctcacgtggtcgcctccttcaaggcagataagtggaccggtttcgacggcgctcccgccatcaccgtcaacgacttcggcgacggcaaggccgcatacgtcggtgcccgtctcggccgtgagggtttggccaagagcctgcccgtgctgctggaggaactcggcatcgagacttcggctgaggacgatcgcggtgaagtgctgcgcgtcgagcgtgcggacgaaactggcgagaaccacttcgtgttcctgttcaaccgcacccacgatgttgcggtcgtggacgtggaaggcgaaccgctggtcgcctcgctggcccaggtcaacgagtccgagcacacggccgccatccagcccaacggcgtactcgtcgtcaagctgtaaaaccgcgcatagcgcctaattaccgaaaggctcccctgctgctcatcgtagcaggggagtcgttttcgtatctccagcaaagtcgggtagggtggtcaccgtgcgaggcaaaaacagagtgacgatggcggacgtggcccatgaggccggtgtttcggtagcctcggtgtctaattttctgaacaaacagccatatatgagcgaggcgatggccgcgcgtattgcggaagccatcgacaggctcggatacaaagtcaactcgtcggccagaaacctgcgttccgggcgtacccggttgctcaagctggtcattcccgatctgcggcaggtgtacttctccgaactcgccgaggatattctggccgaggcccggcaacatggctacggcgtcatcgtggaatccaccaccaacaatcgtgcccgcgagctggaaagcatcgcatcgatgggcacgcacagcgcggacgggctcatcttaagccctctgatgatgacggttgacgatatcgcggctttggatggcgattacccgctcgtgctgttgggtgaacgtttgttcggcgtcaacgcgccgcacgtagtgattcgcaatcgcgaaggggccgccgccgcgacttatcacctgcttgatgccggttgccgccgcatcgccgtagtcggtgccgtgccccaccccgagcacgatttctcgtcgggctccatccgcacccacggatatcgtgaggcgctggccgcgcgcgacatcccctgtgatgacagtctgcttatcgaaacccaaggctgggggagcgccgacggtttggccgcggtggacaccatgctggagagtggcctgcaattcgatgccgtgttcgctttgaatgacttgctggcgtggggcgtgctgcgtgaactgcgcgaacgcggcgttgccgtgccggatgatgttcgcgtcatcggcttcgatgacgtggaggaatcggcctacatggtgccgtctctttccaccgttaaccccggcagggaagccatcgcccgactggccgtcgaatccatcatccaacaggtcgaatccggcagtcgcgctcctgcccaaaccatcgaggccccctatagcctctccctgcgcgagtcctcgccggcgttggcctgcgcctgatgaatccatggttcgaaatatccgaagtgaatgacaaggcccgtcaatcgtatggtgattgacgggccctggtcgtattggacttgactgtacttggtacgggcgtgactctccgtcttttagccgtggaattccacgctgatccaggagatggcgggaagcgttgccgtgcaggtgccggtggcgttcatcgcaatgtcgagcggttgcggcgtgacggcttcgggcgcttcggcggtgttggtgcggtacggatcgtcctcatgcaacagttgcgccttgccgagcgcgagcgtgccgagaccgggcaggccgggcagcccggaaaggtcgatggtgagcgtgtgcggggtgttggcgtcgcggttgacggcaagcagcagaccggtgcgggcctgttcatcccacgtgactaccgcgtcgatggccggcacgtcgccgtatgcctcggtatggatggtgggggagctgatggccggagcgtaggcctggccgcgcgcgtgaagggcggcttcggcgaacgggtagaacgtggtctgccgccatgccgggccgtgttcctcggccatgatgggggcgatgacgttgaccagctgggcgcgcgaggcggaacgcacgcgatcgcagtgcttgagcagggtgatcatcagggaaccttcgaccaccgcgtcggccgcggtgtagatgtcttccagcaaatgtggagacttgggccatggctcgtggtgcaaaccctgcgcggcctccgccttccactggtcttcctgctcgttccacttgtccgaataccatacgccccattcgtcgaaggacagggcgatgtctttggtgccgttattggcttcgcgcgcctgatcggccgcgtccgagacggtggcgatgaacttggtcatgtcttcggaagaggccaggaagtcctgcatggaggcggcggcccgggttttatggccgcggtcgaagtagtaggcatggcaggagacgaagtcgagattctcgtaagccttggtgagcacggtcttctcccacgtgccgaaggtcggcatataggcacccgaggaaccgcaggccacgagttcgagaccggactcggcgagcttcatggcgtgggccaccttatccaccgcgccggcatattcttccgggctcatgtggcccacctgccacgggccgtccatttcgttgccgatgcaccacatcttgatatccatcggctcctcgatgccgttggccacgcgctgatccgcccaagcggtgccgggcgcgccgttgacatactcgagctcgtcgagcgcggctttcagcccccgggtgcccatgttgacggcaagcatgatttcggtgccggctttctggctccagcggtagaagtcgtcgatgcccatctcgttggtttcggtgcaatgccaggccaggtcgcggcgcatggggcgattctcgcgtggaccgatgccgtcttcccagttgtagttggatacgaaattgccgccggggtagcgcacgcaggtgacgcccagctccttgaccaggtcaagcacgtcttggcggaagccgttttcgtcggcggtgggatggctgggctcgtagatgccgccgtagacgcagcggcccagatgttctacgaatgagccgaacagacgcgggggaacgtcggctaccggagtggcgtcggcgttgagggcgatgctggcgtccggcgtggttgcgttgccagttgtggagacgttactggccgtggtgccggcggcggtcggcgccgggctgctttcctgcttgtcgggatgggtggtttcggcggaatactggctgttgtgagtggtcatgagcgggatgcatctccttcggtttgcggttagtcaccatggtgcgacgtgtcgtgtttgcgtaaacataaaacatgtggtaccgtttcttaaaacgatacaagacttggaacaaaacgccaagtcccgtcgtttccaataacaaggaaggaaagaacgatgaagttcggcaagaagacaattgccctgattggtgctgtggccatgctctcctctgtagctgcctgcggttccacttctgccggggatggcggaagcaccggctcctctgataagaaggtcgagctgaccgtgtggtcctgggattccacactgcctcgtacggtcaagggattcgaggccaagaacccgaacattaaggtgaaggtgaccaacgccggcaccaacaaggacgagtacaacgcactgtccaatgccatcgaggcaggctccggtgctccggacatcgcccagatcgaatactacgcactgcccgaatacgtgattcgcggccacctcgagaacctttccgatctcggtgcctccgatttcaaggacttctacaccccgggcacgtggtcctcggtgaacatcaatgacggcgtctacgccctgccgatggattccggcccgatggcctggttctacaacaagggcgtcttcgacaaggccggcgtcgatccgactcaggtgcgcacgtgggacgacttctacgaggccgccaagaagattcgcgccgtggactcctacatcacctccgattccggtgacgccggcttcttcgactccatgacctggctggccggcgcgaccccgttcgagacctccaaggacggcgggaccgtgaccatcaacctgaccggtgacaagaacgtcaagaccttcaccgacttctggcagaagatgatcgacgaagatctcatcgacaccaagaccgtcggctggaccgacgattggaacaagggtctggatgacggctccatcgcatccctgctgaccggcgcttggatgccgtacaacctgctttccggcgctccgaacggtgacggcaagtggcgcatcgcccagatgccgaccgcagacggctccgagaccaactccgagaacggtggttcctcgctggccatcgtgaagtccgacgacaaggacaaggtcgccgccgcctacaagttcatggaatacgcctgccacgacgccgagggcattaagacccgtgttgacggcggtgccttcccggccgacaacgacaccctcaagtccaacgacttcctcaacatgacctccctgaccgactccgacggcaaggcccacgagtacttcggcggtcagaagttcaacgaggagctggccaaggccgcagccaatgtgtccaccggctacaagttcctgcccttcgaggtctacgctcgcggcaagttcggcgactacgccggcgatgcctacaccggcaagaccacgctctccgatgccgtggcttcctggcagaaggacctgcaagattacgccaagcagcagggctaccaggtgaagtaacggcaatcacagcagacttcctcctgtggtttctgtagcgggaggttgcgataacagggtcgggcactcttcggagcgcccgattttcttatgccatgggagcagtggcgcgcggattgcgataccaagatggcgtgttgccgaagaatgtgtataataaaagatgttatcgcaaccatagctacaaagtggcgaaacaaagccgttttgtgactactgaaccatagagtgatggttcacgatagcatgacgacgaggagagttgccatgctgttgtggtgacaatcactgcagaccgccgaaaggcgatccaaggaaggagaacagaacgatgaagttcaccgttgctaagaaggccattgcacttaccggtgcggttgccatgctgggttccgttgccgcctgcggttccgacaccgccagtggcaagccggctcaagataaggacgttaccgaaatcaccgtgtgggcttgggagcccacgctgacccaggttgccaaggacttcaccaagaagaccggcatcaaggtcgatctcaagaacgtcggcaccaacaccaaggaatacacccagcttgataacgccatcgaggctggctccggtgctccggacgtcgctcaggttgagtactacgccatcccgcagtacgccatcaagggcaacctgctggacatcaccgacaagacctccggctactccgacttctacacccctggcccgtgggcttccgtgcagttcgccggcaaggtctacggcctgccgatggattccggcccaatggccttcttctacaacaaggaggtcttcgacaaggccggtgttgacgccgagcagatcaagacctgggatcagtactacgacgccgccaagaagattcacgctctgggcgacaactactacatcacctccgacaccggtgacgccggcttcttcgactccatgacctggctggccggtgcaaagccgttccagacctcttccgatggttccgaagtcaccgtcaacctgaccgaggacaagggcgtcaagaccttcaccgacttctggcagaagctgctggacgagggcctgctcgacaccaagaccgctggctggtctgaggactggttcaagggcatggtcgacggcaccatcgcctccctgttcactggcgcttggatgcctgccaacctggccaactccgctgctgacggcgctggcaagtggcgtgtgacccagatgccgaccgctgacggctccaccaccaactccgagaacggtggttcttcgctggctgtgctcgcctccaccaagaaggctgacgctgcttaccagttcatcgagtacgccaaccacggcgacggcgtggccacccgtgtggccggcggtgcattcccggctgacaaggcctccatggagtccgactccttcaagaacaccaccactgtgaagaacgccgatggcgaggacgttgactacttcggtggtcagaagtacaacgaggttctggctcaggctgctgagaacgtgtcctccgactaccagttcctgccctacgaggtcaaggcccgcaccatcttcggcgactaccttggcaagtcctacaccggcgaccagaagctgactgacggtatcgccgcttggcagaaggcactgcaggattacggcaaggatcagggcttcaccgtgaagtaagccttgaaccctcgctgagactgcctagctaatctcacctgatacacaaagcctcgtgacgaatcccgtcacggggcttctaccgttttaagccccgcctagtacactcgtcaccatgcgagtgatcggacagcgaatcaaaagaatggcaaccatagcagtgactgccatcctttccgtatccttggcctcgtgcgggcagtccaccaccgataaccgcacggaaatcagcgtatggagctgggaaccgagcatgggcgaggtcatccgccgtttcgaaaaagccaatccggacatccgcgtgaaatggaccaacatctccggctatggcaatctcaacaccgccattcaggacggttacggcacgccggacgtggctcaaatcgaatactatgcactgttgcagtacgcggtctccggccaattgcttgatctgaccgacaaaatcggctcggattattccaacttctttaccctcggcacatggtcgtccgtgcagctcgccggccgtacctacgggctgcccatggattcgggcccgatgggcttcttctacaacgaagacgtgttccgccaagccggcgtggacgccaccaagatcaagacttgggatgactactatgaggctgccaaaaagctcaaggagattggcgtgtacatcgccgccgactcgggcgatggcagcttttacgatgccatggtctggctcgccggcggccagccgttccacacgtcggccgacggcaaaaccgtgaccatcgatttggatgaggacgccggcacccaacggttcaccgaattctggcagaaaatgatcgatgaggggcttgttgacaccacctccgccacatggtccgaccgatggaagcgccgtgtgggcaccggtaccatcgcctccgtattctccggagcctggatgccgtcgctgctgctgtccaatgtgccgggcgcggccggtctgtggcgcgtggctcccatgcccacctatgatggccagcccaccaacgccgaaagcggcgggtcggcactgaccgtactgcaattgacccgtaagccggatgcggcttatcgtttcgtggactttgtggcgcatgacgcccaaggcattagcgcgcgtgtggatggcggtgctttcccggccgattatgccaccctgaattccgctgattttttggataaaaccacgattaccaatgaccggggcattgaaatcccgtatttcggcgggcagaagttcaaccgtgtactgtcggaggccgccgaggatgtgtcggtcggataccagtatctgccgttcgaagtgtatgcgcgcagtgacttcaaatcgacggtgggccaggcatacgagtggtccggcagtttccacgcctatcagcagcgacaggaagccattgagatgggtatgaaggacaaggaaggcaacccgctcgaaccattggagaagcccggcaagagagtcagtctctccgacggcctggcccaatggcagaaagacctccgagaatacggcctcaatcagggctttacgattaagtagggattcggggttggatcggaatcgaccgcgctatacgcggccgattcctgcatactacgtcacttcacattgcgcgagtagatgtgcgccatgcccttgaaaatcaaatccgggtcatacacgtcaatcagctcggtgtcattctcaaacactcgaccgaggccaccggtggtgatcaccttgaaatcctcgcctccgagctctttgcggaactgacgaatcgtgcgctccacaccgcccaagaacgtgtaatacaaaccggcctgcatgcaggtcttggtgttggtgcccagaatcgtatctggtcgcgtaatttccacttccggcagctgggccgtatctccccacagagcggccgcaccggcacggatgccggtggtgatgacgccggaatcgaccacgcccttgtcgctcacgtgtgtgaacgtggtggcggtgccgaaatcagccaccagcactgggccgccatactcgtaataggcaccggcgcagtcggccagaatatccgcacccagcgatttcggatcgtcaacgcgcacgttcataccggtcttgatgcccggtcccaccaccatcggatcaatgtcgaggaatttgacgatggacgaacggaaggagtgcatcactttcggcaccaccgaacagatgatcacatcgtccacatcggatggctgaaaaccgctcattctcaggaattcagtcagaaacagcccatactcatcagacgtatggttggctttggtggtgatgcggtaggtgccggcgatggtatcgccatccaaaaagcccagcacgatgttcgtattgccgatatcaacggcgaccagcatgataaccctccagattcaagatggatttcatgcgcaattctacagtcccatggctatgatggcctgcggtggtcgacccagcgtggcggccaaccgtagaacacaacatatacagaggaagaaccatgtctcaagacaatggtgcgcacatcgaagacggcgcaaccacagatgcgagccttgcctcgcgtgcaaagaatccgaaaaaaaacggcccgaagtggtggctgatctcactgattgccgtcatcgtggcagtggcggtcgtcatcggcgtcacgctcgctttcggcggtaagaaagatgacaagtcggcctcgtccagcaaccaatatgccgacaccgtgaccatcggcctcaaactggcccccaccaatctggacatccgcaacaccgccggctccgcgcttgaccagatcctgattggcaacgtatacgaaggcatcgtggcacgtgactccaagaaccaggtcgctcccgccatcgcctccagctgggagacgtccaaggacggcctgacctacaccttccacctcaataagaacatgaccttctccaatggcgacaaacttgacgccgaggacgtggcctggtccatcaacgagctgatcgctaagggctaccacgacgccgacgcgctcgccgccgtcagcaaggtggaggccaaggacgccgacaccgcggtgatcacgctcaagacgccgaactccaacctgttgtggaccctgaccggtcgcgcagggctcgtgttcgacaaggatgccaagtatgacctgaagacgcaggccgtcggctccggcccctacaccgttgccaagttcgtggaaaacagctcgatcacgctgaaggccaatgagaagtactggggcaagaacaaggccaagacgcccactgtggtcgtcaagtatctggccgacgacaacgccgcggtcaatgcgctgaagtccggtgacgtgcaggtgctcgccccgattaccgagaacctcgccgaaccgttcaagtccgattccgccaagtacacggtcaaagccggcaacggcaccgacaagttcgtgctcggcttcaacaacgcttccggttccaaactggctgacaagcgcattcgtcaggccatccgttacgccatcaaccacaaggagctcatcgcctctcgcggcggtgcggacaaggcgctcggcggcccgatcccgtctctcgaccccggctacgaggatctgacgaatctgtacccgtatgatcagaacaaggccaagtcgctcatggctgaagccggctattccaccgacaagccgcttcaacttacgctgacctacgccaacatctacggcaccgagctcggagaccagctgcgctcccagctcaagcccctcggcatcgacctgaaggtgaatgtggtggagttctccacgtggctgcaggatgtgtacaccaaccacaccttcgatatttcgctggtggaccacaacgaaagccacgacttcgcatcgtggaccgatccgacatactatttcggttacgacaacaagaatgtgaccaagctgtacaacgagggtgttgccgccacctccgacaaggagcgtgatgccaagttcgccgcggccgccaagcttgtctccgaggatgcgccggccgactggctgttcaactaccgcatcaccaccgccacggccaagggcgttgaaggattccccttcgacctcaaccagaccgttctgcccctctacaacgtgacctacacgaagtagttcgttacagcaatgagctccctcagtgagggggctcattgttaatccaagtaaagtaggcattatgcgattcgtgttgaaacggctggcgttattcgtggtggcgttgttcggcctgtccgtggtggtttttgcagcattgcgcattctgcctggcgatgtggcctccgtgatggccggcgtcaactcgccgcctgagcgtgtgacccagctacgcgaacaactcggtctgaatcggccattgattgcacaatacttcgattggatgagtgcgctggcccgtggtgacttcggcacttcaatcctgactggtcgctccgtaacctccttggtaggcgcacgtgcgtccatcacctttcccctgattattcttgccctgctcatcgccttggtcatcggcttgccgctgggctgtgcggcggtactggcccgcagcgcaacggtgcgtgcggtgtttcatgtactggctattgtcggcggtgccgtacctgcgttgtggggcggtctgctgctgattctgttgttcgggcgcggcgtaggattgcttgatgtgtttccctcgcaagggttcccgctggatggttggggcgcacccggttcggcgatatcagcgttggtattgccggctgtatcggtcggcatcatcgtgggagcatcgcttatgcgatacacgcgcgcggccttaggggatttagccagttccggctacatcgatatggcacgctcgtgtggcatgacgcgcactcaggcggtgttgcgtgtgggattgcggttggcaaccccgcagctggtgtctgttatcgggctgaccttcgcttcgatggtcactggcgtgatggtcatcgaaaacctgtttgcgttaccgggcatcggcaacggtcttgtgaccgacgtgggcaaccgcgacctgattgccgtgcaaagcgagctgttcctgctggccgcgttctttttgactgtcggcctcgtggtcgatttgttccaccgcgtgctcgacccgcgtctgaaaaccgctaccgccattacggaggtgaccgcatgagcaatgttcgtcgtgcgacgactggtggtcgacgggctgccttcgtcatcgtcctgcactctatgtggcgtcgtgccgagggcaaattcgcacttatcgtgctcgctctgtggttgctcattgccatcgtttccctgttctggaccccgcaatcgctgtgggccactgatggctaccatgtatgggccaagccgtccgccgagcactggctcggcactgacggcaccggcgcggacgtgttcagctggctgctggccggctcacataccaatcttgtgatcgtgctgctgaccgtagtggcatctatggcttgggggctgctgctcatcgcggccatggtggcacgcaatgcggcgctcgccagttcttcggtagtggtagttgatgcgttgatttccgttcccaccgtgttgattgcgttgattctggctgtgccgttgggagcgtcaatcgcggtgattgtgatcgcctgcggcttcggatatgggttgaatctggctcgtgtggctcgccccgcagcgttgctggcggcccgctcgtcgtatgtggaatcggccttggccaatggtgccagcgggtggcgtgtgctcataagccatgttatgccgaatattctgccggtattggctgtgcaactgtcattgtcggcgggcacggcggtgttggctgagtcggggctcacttatctcggtatcggtgtgccgtccggtgtgccgagctgggggcattctctggccacttcggtcaaactcatcaacgtgttcccattaaccgtggtgtggcccggcctgatcgtcacggttgtggttgtggcgctgaatatttttggtgatgtgctgcgcgatgccatcgatccggtcaccaaccccgcattacgtgaaataggaggcgaacgatgagcgtcgatgttcgcgggttgaaaatcacgattggcggcaaaccaatcgtctctgatgcggatatgaccattgccgacggtgaacgagtcggcttgatcggttcttcaggctccggaaaatctatgattgccaaggcgatgctggggttgctgcccctgaccgctgtgactaatgggtcgattgatatgggcagcacggaaattatcggagcttccgaacgtgcgcttgccgacctgcgcggccggtatgtgggtgcggtgttccagaatccggctgcctcgctgaacccggtgatgaccgtggcgcagcagatcgccttgccattgcggttgcactatgatctgaccaaggtcgaacgagccgaccgagtgaatgccttgttgagcaaggtcgggctggatctcgatatggccggcaaatacccgcacgaactgtccggcggccaacagcagcgcgtgggcatcgccacggcgctgatcacctcaccgcgattcatcatcgcggacgaacccaccaccgcactcgactccatcacgcaacgccagatcgtggacctgctgacctcgctggtggacgacgccggtgcctccatgctgttcatcacccacgatttctccgtactcgcgcgtgccaccacccgctgctacgtgctggacgccggccgcatcgtcgaatccggacccaccgccgacctgctcgccgcgccgaccacaccacaagcccagcgcctggtcgccgccgcccaaaccctcaccctccacaccccaaggaggattcgcatgagtaacagcagtgtgccgctcctctccgcccactccatcaccaaatccttcggcccgcgcaccgcacgccaccaagtcctcttcgacgtctccgccgacgtccacgccggcgaatgtctggccgtgatcggcggctccggatccggcaaatccacgctgacccgcattatgctgggcttggaatccgcggactccggcagcgtggaatacgagagccaatccattgtcggcggccgaaaatcgccgggattcgcggccctgcgccgcgaatcgggactggtgttccaggacccgttctcctcgctcgacccacgttggcgagtcgccaaatcagtggctgaaccgctgagtctgcaacggcgtgacctgaacaacaccgatatcgacgagcgagtggccgcggctctgaccatggcaggccttgaaccggcagacttcctgaaccggtacccaatcgacctgtccggcggccaggcgcagcgcgtggtcatcgcccgcgctatcatcaacgagcccaaagtgatcctcgccgatgagccgatgagcgccatcgacgtggccgcgcgcattcagatcctcgacaccttcgccgccatccgcgcggcccggccgagcaccgccatcatcatggtctcccacgatctcggcgtggtacagcacatcgccgaccgcatcctcgtgctccatgacgggcgtctcgaagagacgggttccaccgctgaagtgctcggcaacccccaatccgattacacccgtcagctcatcgaggcagcctcgttatagaccttttttggctccctctctgaggggagctgtcgaacgcagtgaggctgaggggagttacgggtgccgtcgtattcccctcagtccgcttcgcggccagctcccctcagggaggggagccgaggccgccggcgacacgcgcttgtcgcgggttgtgctatggtgtgagacatgcagattatctcatgttgttgtcgctaaccgacgcccctgggcgagcggtcagtgacgcataacttgagatagagcattcgaatcgcggcaaatctgtcgcatgaattttcatgaaatcgatggcacgagtgtaaccgtgtaacgcgcgagtcgtggttaacatgaaaaaccgattcactttccggcttcaccgtacagtgagcggggatactcgatttcaaactaaagccacagtccattcgtctgggaacgtcggttcacgaacgcaacgcagcaaaaccccacaaccccagcaacgaaggacttcacatgaccatccacaacagcctcgcagaactcatcggcaacaccccgctcgtcaagctcaaccacattccgcaggcggccggcgtcaaagccaccatcgccgtcaaagtcgaatacttcaaccccggtggatcttccaaggaccgcattgccgaacgcatcatcgacgccgccgaacagtccggccaactgaagcccggcggcgtgatcgtcgaacccacctccggcaacaccggcgtcggcctggccctggtcgcccagcagcgcggctaccgcacgattttcaccctgccggacaaggtctccgaatccaagcgcgcggtgctgcgcgcctacggtgccgaagtcatcgtcacgccaaccgacgccggcccggacgacccgcgctcctactatcaggtcgccgaacgactggccaatacgattcccggcggcttccgcccgaaccagtacgacaatccgaacggcccgctgagccactactacaccaccggacctgagatctgggaggccacggaccacaaggtcacgcacttcgtggccggcatcggcaccggcggcaccatctccggcaccggcaagtacctcaaggaagcctccaacggcgcggtcaaggtcatcggctccgacccggaaggctccatctactccgcttcctcacgcgacgaagtccaccagtacgatatcgagggcgtaggggaggacttctatcccaaggccttcgaccggaacatcaccgacgacatcgtgcgcgtgtccgacgccgaagcctttgaaatgacccgccgtctggccggcgaggaggcgctgctggtcggcggctcgtccggcatggccgtggtcagcgccatcaagtacgcgcttgccaatgatttggacgagaaccagatcgtggtggtgctcgcccctgattccggccgcagctacttggagaagatcttcaacgacgactggatgcgtgccaacggctacggcgacatcgtggagcgcaccagcaagccctccctcgccgagcagtaccttaacggagctccctctgatgagggagctggggacggactccataactagctatcaaaagaatcaataccaacatccgcactaaccaaccgcacctgttctaccttcgaatacggaacgatcccgaaaggaacccaatatcatgtccgctgaatacaacgccaagttcgccaacaccgacatcgccactcgcgccatccacgccggccaggagcccgacccgaccaccggtgcggtcgtcacgccgatcttcgccacctccactttcaagcaggatggcgtgttgggcctcaggggaggccacgactactcccgctccatcaaccccactcgcaccagcttcgacgagcagctcgccgccgtggaaggcggcaagtacgcgctgagcttctcctcgggcttggccgccatcgacgtgctgctgcgctccaccatcaagcccggcgacaacatcctgctcggcaacgatgtgtacggcggcacctaccgcctgctctccaaggtgttcgtgccgtggggtgtgggcctcgacgtggtgaacatcaccgatctgaaagccgtggaaaccgcattggcctccaagcactaccagtatgtgtgggtcgagaccccgtccaacccgctgctcaacatcaccgacatcgcggccaccaccgaagtcgcccacaagtacggcaccaaggtcgctgtcgacaacaccttcgcctcgcccgcccttcagcacccgctggccgatggcgccgatgtggtggtctactccaccaccaagtacatcggcggccactccgacgtggtcggcggtgccgtggtggtcaacgatgaggagacccgcgagaaggtcgccttcctgcagaacgccgccggcgcagtgccctccccgttcgactcctggctggacatccgcggcctgaagaccctggatctgcgcgtcaagcgccacagtgccaacgccctgaaggtggccgaatggctcgaatcccagccctctgatgtgattgagcgcgtctggtacccgggcctcgagtcccacccgggtcatgaaatcgccgcccgccagatgcacggcggcttcggcggcatcgtctccgtgcagctcgcggccggcgccgaggcggccaagcacttcgtggaccacacgcagatcttcacactggccgaatcgctcggcggtgtggaaagcctcatcgaggtgcccgccgccatgacccacgcctccgtggccggcaccaccctgcaggtgcccgccaacctggtgcgcatttcggtcggtatcgagaacgccgacgaccttatcgccgatctcaagcaggcgttggatcgtatctgaccgtactgacggtactggtggcaccgtattgacggtgccaccacgcttatcggcggactcgctatcgattggtacctacaaaaaatccccggcccacaagggtcggggattttccgttatcgattaaacatattgaatcagctggcgttgccgccctgccatccagtggcatccgcaccagccgggcgcaacgtctgaccggaagtcggtgtggtgccatcaacgaccacacgagtgccgatggtggcaaagtcgtacatccacttggcatcggccacctgcatgttgatgcagccgtgcgagcctgggataccctgctgcacatagatggggtgctcgccccacatgtatgcaggaacaccgtgcagagcctcgccgccgttatagtaggaaacccacggcgtgcctggctggttgtagccttcgccaaccatggtctgcgattcgtacttgagatacacgtagaacgtgccggtatcggacagcatggaaccatcggcggtgggcttgccagaagcgatgttgaacttcttgaccaccgtggtgccctgatatgcagtggcagtctggttcgtcagatcaacatgaacccacttatcgccatttgccgtatcgaagttatgaggcacctcgacctgcttgacatcatacgggctgtctttcacagccacagtggaatcagtggactggttctgctcgatggcggtagccagacgttcgggggcgtccccggcgccagtcacttcaataccatccacgccgagtgtcttatcggcaccaatttccacgccgccttcgtctttcggcgtgatgtagacctcgcgtgtcaccttgggaacagtcagttctttggttacgctgtcactggtgacgtacttggtgatggcatcgcggtcgactaccagactcatggtgccttccgccttattcaccgtgggcttgaggaatgaggcaatggtatcggccgggatggtgacgctcttgttcacgccgttgtctacggtcagtttgaggccaagcctggcattggcgtcaaactgtgtttgctgtgcgctcgcgtcatcaatcggattctttgcggtctgtagcttgaccggcaccgtcgcattttcgcccggggtcgcgacggcctccttgactgcagcattgacaacattggtatccgggcccttgccgtcctgacccgcggtgtagtcgaactgtttggtgctcttgttgtagacaacggtggcaatctgcgctcggtcggcctcatcgaccaggccggcggtgacgaattgttcggcagtctctttgtccgtggtggcggtcagagcgatatgcggctgatcgaaaatattgagcttggccacgtcgccggtcttcgcgttcaacagcgcatctacggttttatccgtgtcgacggtgacgccaaggtccttcagcgaggctttgacgctgttgccttcggcggtgaacgtcactgtggtgttattcagctgctgcttcacagtattcgcaagttcttcgcgggtctggcccatgacagagacattgcccaaatgaacaccgggcgcagccttgtcttggaagtaccaacgtccgacgaagaaataggctattaatgcggcaagcaacactgcaaatatggttatgatggcaatccgtgcggccttgccatgtgatttagcggtggtagatgccataacatgttcacccacataggctgtattatcggcatggttattggtgccattgtcactttgctgtggtgtggcggtacctgaatccgcggctgcgaacagcccatcggtggccacaggctgcagcaccgccgtctcctgatcgtcaggagaggagaaggaaaatgtatcgttggccatcaaaatgccccgtcttagttctctcaaagcggcatatcgtgcgatatgccgggaataacgttccttgacgcataataatacggaagggctacgtacatcgttgcgaggtattccgttatacgctgaaatccagccgcggtcggcctacactggtcgtttatgacagcacatcaggcggcgctggaggcgctcacacgatacttcggctatgactcgtttaggcccggacagcaaggaattgtcgaggctttgcttgccggacgcgatgtcttgggcgtgatgcccaccggcgcaggcaagtccgtgtgctaccagattcccgccgcgctcagcccgggtatgactttggtcatatctcccttgatttccctgatgcgcgaccaggtcgatgcgctgaacgacctcggtctgccggccgcgttcatcaataccactcaaactcccgacgagcaggcgatggtgttcgcccaagccgccgccgggcagatcaaactgctgtacgtggccccggaacgcttggaaaccgggcgattccgcgactttgccgcccgtacgccgatctcgctgatcgccgtggacgaagcccactgcgtctcccagtggggtcaggacttccgctcgtcgtacttaggtatcggcgatttcatcgccgggctgccgcagcgtccaccggtgggtgcgttcaccgccaccgccaccgaacgggtgcgccgggacatcgtgggactgctgggattgcggaatccggccgtcaccgttaccggattcgaccggccgaacctgtattttgatgtggtcaaactggaaaccaaatacaaggccgcatgggtggcgcggtatgtggccgaccatccggacgaatccggcatcgtctactgcgccacccgcaagaccaccgaagcgctcgccgacacgctgaaccagatggggcatccggctgtcgcctaccatggcggcatgtcgccggacgcgcgtgaggtggcccagcgcgacttcatcaccgacaaggtgccggtggtcgtggccaccaacgctttcggcatgggcatcgataagtccaacgtgcgttacgtcatccaccacaatctgcccgaatccattgaggcctactatcaggaggccggccgcgcgggccgtgacggcgagcccagccgatgcacgctgctgtggaatgagtcagacatcgtcacccggcgtcggttgctggataacgattatgagaacgaacgattgactcccgaagagcaggagatcgttcgccagtccaagcgccggctgctggacggtatggtcggctactgccgcaccaccgactgcctgcaccggtatatgacccggtatttcggtcaggaattgtcgccgaatgctggttccacggcgggtgaagacattgcggcggactcttcgcagtccggcagatgcggtgcctgctcgaactgcgaaagcacgttcgagaccatcgacgtgacccgcgtggcgcaggcgatcagccgttgcgtgcatgacgtggggcagcgcgtcggttccggcaagatcgtcaagatcctgcgcggttcgcgggcacaggatctggcatggctgaacccggagcggatgcccaccttcggcatgctcaaggacgtgaacgaggctcgcgtgcgcgacgtgttgagccagatggccacggacgggtacctgtcaattgccgaagggcgtatgccaatcgtcatgttcggtgcgcgggcggccgaaaccgccgctcccgacttccactatgagatcaaacgggtggaacgcaagtcggaggcggccggttccggtcggagcgggggagtggctgatactgccgattccgccaatgttcccggcgatgcgctgggctcgtatatcccggacgatgacgaggaatcgctgttccagaagctacgcgaactgcgacgcaccatcgcccaggaaatcggcaagccgccgtacatcgtgttctccgacaagaccttgcgcgacatggcccgcatcaagccggttaccaacgcgcaatttctggcggtcaacggcgtcggtcaacacaagctcgacctctacggccagcgcttcatgcaagccgtcgcctcgttcaatgccgggagtgcgtcataacaatctcctatagcgaactgcggagtatttgcgggcgttcttgggctggctcgactacgatgactgttcgatgcttcatgaccgaacactcggcaagtagaaaggcaacagcatggcagaagaaacggccgaaaagcccgtcgtcgaatcattccagcttgatcacaccaaggtcaaggcgccgtacgtgcgttacatcgacaccgaaacgggccctcacggcgacgtgatctccaactatgatctgcgcctgacccagccgaacaagcaggccatccccaccggcggcctgcacaccatcgaacacaccatcgccgtgctgctgcgcgaacgtatcccgggctacatcgactgctcgccgttcggctgccgcaccggcttccacctgctgacctggggcacccaccccaccgaggaagtggccaaggccctgaaggaatcgttggagttcatcgcgtacaaggccacgtgggatgacgtgcccgccaccaccgagaagagctgcggcaactatcgcgaccacagcctgttcaccgccaaggaatgggccaagcagatccttgaggaaggcatcagctccgacccgttcgagcgcaaggtcgtctgatcgcaagccaatcggcatggaagaaccccgcccccgcataccacgcggacggggtttctttgtgcctatgtttgtgcctatggcatggtaggtttgccgtcagttaatcgttggccgctgcacatcggtagcttggcatgttggagaggtggaagtgactcagtcgaacgctgcaaacaaggcgacaggccgccgtttccgccacgccaccatgcgcgatctgccgcagatgcagaaaatctacgcacgcgcacgcgcgttgatggccgccaacggcaaccccacccagtggggcaacgaatttccgcgtgaatcgatgattgaggacgacatcgccaaccagcgtacgatgctgctggtcgacacctgcaatggccacgaacgcattctggcccagttcgccctgtgcccgggcgaggatccgacctacgccaaaatcgacggcgcctggctggacaacgacgcctatgtgaccatccaccgcatcgccgcatccggtctggtgcgccacgcggcccgcgactgtatcaggtgggccctgaagcactacggcaacgtgcgcgccgacacccaccccaataacaaggccatgcagcacgtgctcgaaagctccggcttcgcccgttgcggcctgatccagctgctcgaccggccggtcgacaccaccagaatcgcctatcagcgccacgagtggtgagtgtggctgccggctgatgtgctcgtttctgcaccgtcatcggtttctgacggtagaatcagtgtgtgagaagaacacgttgggtcgggggcgtcgtgacggtgcttgcggctgtcatgctgtcgtcgtgcggcggcgtccagtcgaatcccgggtaacacaccgttgccaatccattcaccgcgcaggtgaatggagaagacatggcgatgcctgtcggccgatggagccccatcggccgacaggcatcgaggaagtcaccgtggccggcggaacgcgcggtcgccgattggggcgaatggcttgtgtggttcgctttggtaccagtaggcgaccgtggccacgtcgtcctgtcgttcgaagttgccggcttcctcggtgccgatctgctgccattcgacgcgcaggtctcgctcgaagtagatcgggtcggggatgtgccaacggtataggccgcgggtcacgggggtggcagtgtcccagtaggcgctttcgcgtccggcgaggttctgcgagtagaacgggaagccgaggtatgggccggtgaaggtgcgctcgtgcatgcggccgtgttcgtcgaattcggcgaagctccaggcaccgccgaagtagtcctcggcgccggtgctgcaccaggtggggtatttgccgtcgccgtcgatgtagaacttgaattcgccttcgccccaccagcggctttcgagcgcggtgagcgccaggtaggtgccgacgtaggtgccgtgtccttcgacgccatcgagcaccacgtagtcgtgggcgagttcggtgacgcgttggcggcgccactgcgcgtggaagcgcatcgtgtcggccggcagctggtcgtattcggtgtagtcgatttggtagaagaacgcgggcacgtcctcgttgtggtcgttgcgcagcacgatgcgcgcgtgttcgaacggcatggcgaagtagcagttgaagccccggttcgggttgaccatgacgggaattgagttgatggtgcaggactgggcgtgtccgcagcagaagaagtcgccgatcgggcattgcaccgagggggagtcctcgccgtcccagtagaattccaggatcaggttgcgtagcacgtcggggccggtgggggaggtgcggtcggttaccgtcatccagatgtgacgaatcacgccggggtcctcgacgtccatcaatgtcaccgattccccggacctcaccgtgctgatgcaggggcttcccttgcgggaggggcccaacgcgctggccgccatggccgcgcggcccttgccgccgtccgggttttcggcgttgatgcagcgggtgcggccgggggtcctcatggccacggcatccaaggcgccttgtccgagccccggcgcggggttcgctgtggtgaatgcgtcgagcatgatgcttacttcctttcctgtcgcaggcccgtcccgccacggcgttttgtctgggggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgccgggtgagccgggctgctgggggggtatttcacggcaccggcggtgatgccctgggagagcttgcgctggggtagtgcccgatatcttgcgcactttggtcttcgcccgtccctgtggcgatgatcggttcgcttcccgtacagtctcaccgagtcttgacatgtcgaggtagcggcgcgtcgaccactcgttcgacgtgacatagcgcacgcgtgcgcagacgagcatcaacgcgctgcgttcgtcggggaagctgccgaccatgcgcgtgcgccgtctgacctcgcggttgcgggggtgaccctggcgaggacgttgcgttcgaagtgcaccatgcaccgctggtagcgggcatcgcgttcaaggtctccttgacgctcttgcggaccatacggtccagggtggtctccgacatggcctcatatcgcaaaaaccgtacgctgaaagtaactcagcgtacggttttcacgaaagcagccatcggctatcggtcagccgatagacctcagtcctcagtcctcagtcgcagcgaccttggcgtcagccccggccttctgctcaaggccgagcttggagcgcttgcggctgtagccgaagtacacgatcaggcccagaccgaaccagacggcgaaacgcacccaggtctcccagttgagaccggcgatgagcacgaagcagaatacgatggccagaatcggggtgaccggcacgcccggcgcgcggaagccgcggggcgcattcggctgggtcttgcgcatccatagaataccggccgacacgatgatgaacgcggacagcgtaccgatgttcaccagctcgaacagcacgttgatgttgatgaagccgccggcgaacgcggtcagcagaccgaagaaccaggtgcccttgaacggggtacggtacttctcgtgcacgtggccgaagaacttcgggaacaggccgtcacggctcatggcgtagcagatacgggattggccgtacagctgcacgagcatcaccgtggtcatgccgatgagggcgcccaggttcacgatcaccgcgagccagttcatgccggtctccagaatcacgccggccaccggggcgtcgatgtacttggcgaactccttgtagggcaccacgccggtcatgatcagggtcatgatgacgtagagcacggtggaaacggccagggacagcagaatgccgcgcggcagcgtcttgttcgggttgatggtctcctcagcggaagaggacacggcatcgaagccgatgaagctgaagaacacgatggaagcggccggcacgatgccgtacggctgggtggagccgggctggaaagtgtagatgccgtacggggagaacggctgccagttggacggcttgacataccacacggcgcacacgatgaacagcacgatgatggcgagcttgatgagcaccatcacgtcattggtgcgcttggtctggttgatgccgatcgagagcacccacgtgatgatcagcacgatgacgaaaccgggcaggttgaagtaggtggtgacgtccgggttggtgccgtaggcggcggtcagttcgaccggcaaatgcaggccgaagccttccagcagcttgttgaagtagcccgaccagccggcggacacggtggccgcctgcagggcgtactccagaatcaggtcccagccgatgacgaaggcgatgagctcgccgaacgccagataggcataggagtaggccgagccggaaaccggcgccatggcggcgaactcggcgtagcacaggccggcaaaaccgcagcagacggcggccagcaggaacgatacggacagggccgggccggcggtcagcgcgcccttaccggtgagcacgaagataccagtgccgatgatcgcgccgatgccgagcatcgtcagatcgaaggtgcgcatcgtgcgcttcaggggagtggattcggcgacaagctgatccacgcttttcttacgaaacagatccatgttcttctctcatgaaatctaggattatggggctgaaccggacggatttccgggatcccggcacgcctcaacgccgggaatcaaaggcggcttccgagaaaccgcatatcggtcattagtgtacgactgccgggcgaaaacagacgattgcgactacacgtcacattctcgcgcaacaataggtgtctatgagcatgaacgcagcacctgaaatcgcattctcgtccgagcagggcaaggccaactatgcggccgcccgccgccaataccccgcacaggccatcgtggacctcaaaaccatgcgcgacaacatggcccacctggtctccgtggtcggcgggcccgcttccggcacggcggtgatgggtgtggtcaaggccgacgcctacggccacggactgctgcccgccgccctggccgcgctcgccggcggcgccacatggctcggcaccgcgcagtcgcacgaagcgttgctgctgcgcaagctcggcatcggccccgaccgttgccgcattctgacttgggtctacaacggcaccgaagtgccatttgatgagctgatcgccgccgacatcgacgtatcggtcggctccctgcccggcatcgacgcggtggccgccgccgcacgcaggctcggcaagcccgcccgcgtacacgtcaaggtcgattccggcttcggtcgcaacggtttcacgccggccggattcgacgccgcgctcgccaaactcgtgccgctcgccaaagggggcgtgttgcatattgtgggtcagtggagccatctcgccgtggccgattcgcccgatgtgcccgaattcgtgtcctccaccgaccgccagatcgaaacattcaaggacttcacgcgccgcatggaacaggccggcattccgccggagatccgtcacctggccaacacggcggccactttggaccgcccggagattcacttcgaacttacccgccccggcatcggcctgtacggctacgagcccgatcccgcgatgggcaccccgcgcgactggcatctgaccccggccatgcgcctgcaggcgcagctcggcacggtcaaggatgtggaggccggccatggcatctcttatggccgcacctacctgaccccggacaacacctcgaccgctattgtgccgctgggctacgccgatggcatccaccgctccgcttccggtttcgatatggaaggtgccaagcacgtggagaagccgggcggcccggtgcgcatcatgaccactgaaggtccgaagctctaccgcgtgtgcggccgcgtgtgcatggaccagttcatcgtggacctgcacggatccgccgccgaactcggcgttcacgagggcgacacggtcgaactgttcggcccgggccgcggcgaggattacgttgagcctaccgccgacgattgggcccgcgccgccgacaccatcagctacgagatcttcacctgcctgcgcaaccgcatcccgcgcctttacgagcatgccgccgaagtactgcccgccgccgacctcgccaaactcgaccccgcgacgctgctataaggtgcattaacgccatacggtggcaccccgtaatcccttcttcccgaatatgtgccactgatatgtgctgagcgtcacatattcgggaaatcggccccaatctcccgaatatgtgccgttgagttgacgtcagtggcacatattcgggaagtcgggattactgcggccgatatgtgtgcctatgcttggcatatggaaacgactttggatggggaacaggtgctgagcgacgagggctacagcgccttcgacgaggagcgatgggcacccgagccgcccaaatccaagtcacgcactgcgttcgagcgcgatcgcgcgcgactgattcattcgtccgctttgcggcgtttgggcgcgaaaagccagattctgattgccggtaccgacgatttcgctcgcactcgactgacgcatacgctggaagtcgcccagatcggtcgccaaatcggcgcattgctcggctgtgatccggacgtggtcgactgcgcctgtctggcccacgaccttggtcacccgccgttcgggcacaatggggagcgtgcgctcgccgacatcgccggcaatatcggcggcttcgagggcaacgcacagaccatgcgtatcctgacccggctcgaacccaagatctttcacccggacgggcgttcggccggcgtgaacctgacccgtgcggccttggatgcggccgtcaaatacccgtggaccttggccgaagccgaccgacacccgaaggggagcggtcgaagaaattctgcgtctacccggatgacgaaccggtgttccgctggctcaaaatcggcgcgccccaggccgccaaacccatggaatgccagatcatggacctttcggatgatatcgcctactccgtgcatgacgtcgaggattccatcgccaccggcgcgttcgatccgattgtgctcgccgatccgaagatgctggaccacatcatcgagcagacgcgcgcatggtatggggcgaagtgggatgccgacaagctgctggccgcgttcatgcgattgcgccgagagcatttgttccctgcacatttcaatggttcgcgcgaatcgttggcgcagcttaagaacattacgtccgatttgatcggccgcttctgctggtcggtggagaccgccacgcgcgacacgtatgggcccgggccgttgacccggtattcctcgaacatcgtgattcccgagaacacgaattacgagatcgtggcactgaagggcatcgccgtgtacttcgtcatggcgcctcgcgagcgcgagccattccatcaggaggagctcaagatcgtatcggatttggtcgatgtgcttatggccgattcgccgctcccatccgacgctttggaaagccagttcctggccgattggaatgaatccaccaatgacaacgagcgcctgcgcgtcgccatcgatcaggtcgcaagcctgaccgacaactccgctctggccctgcactccatcttgtgctgagggcgtgttggacgggtgcttccctcagtctcgctgcgcgagccagctcccctcgggtgaggggagctgtcgctgtaggcgactgaagggagtttcgcggaagaaatgataaccgacggtaaaaatttaccgtgtctcaggtgaggcggtactctagagacttatggtcggaatgattaagaaagaagatgtcgagaaggtgcgcgccgccgcggacctgtatgacattgtatctgcgaccgtaacgcttaagccctccggcaccggcaccttcgtgggcctgtgcccgttccacgacgagaaaaccggcagcttcaacgtgcgcccctcactcggcgtgtggcactgcttcggctgcggcttgggtggcgacgtattcaaatacgtcgaacaatccgaaaacatcgacttccgtgaagccgtggaactgctcgccgacaagtaccatatcgagctgcactacgagaacagcggcaacggcccgaaccgcgagaacaccggctccaagcgcacccgactgctggaagcctgcgaggaagcccaacgcttcttcgtctcccagatcctgaccaaggaagcactgcccgcccgcaagctgctcggaggccgcaacttctcccaagccgactgcgaacgtttcggttgcggctacgcgccccaaggttgggataatcttgtgcgccacttggcctccaaggggtttacgcagaaggaaatcctcgacgcgggcttggcccgccaaggccagcgcggcatctatgactatttccgcggccgcgtgacgtggcctatccgcgattcgaccggccgcacgctcggcttcggcgcgcgcaaactatacgaagacgatcagatcgccgccaaatacatcaacacgccggatacgcagctctaccgcaaaacccaggtgctttacggcatcgatttggcgaaatccgccatcgtcaagaagcggcaggtggtgatcgtcgaaggctatacggacgtgatggccatgcacttggccggcattgacaccgccatcgccacgtgcggtacggcgttcggcgccgagcacgccaagattgtgcgccgcctgatcgccgacgattcgctgggtgcggtccagctggtcgggccgttgaaggtcaaggaccagccgttgagctcgcgcatcgtgttcacgttcgatggtgacgccgccggccagaaagccgcgctgcatgccttcggccttgattcggccttcctctcccaaaccttcgtggccgtggccgacgacaatctcgacccgtgcgacctgcgcatcgagcgaggcaacgaagcagtgcgctcgctgatcgcccgcgccaaaccgttgtatgacttcgtgattgacgccgccatcagccggttcgatctgacctacacgcccggccaagtgggtgcgatgaaagccgtggccccgctggtggcgcagattcgcgaccgctccctgtgggacgcttacgtgcgcaagtccgcgggccgtatcggtgtggaccttgaggtgatgcgccgcgaggtgatgaacgcacgccggcagatgcatgtacgcgatgaggacgcctacgcgcccaaacgtcgattcgagcgtgacgagccgcgtgtggaacccggcaccaacccgtacgccaatccggccacgcgcaaggccttggagcgccgtgacgccgccgaacaggcatatttcaagatcgacgacgccgtattcatcgccgaacagcagttcatggccgtgctgattcaggtgccgcgcgccatcgaccgcaccatgttcgggcagctgaccatcgaccatttcatgacttcggtgttccgcaccctgttccaggcgatcgcggccgccggcggactgccatccgacgataccccgcaggggctgtggatgcacaaccttaccaaggccggcgggccgatgctcaatcaggtgatcaacgagctggctgtcatgcctctgcctctgcctggcgacgacagtggcaacggtgcgcagccggtgcaggccaacgtgtcgggaggaggtgttggcgtgaatggcggtgccgccgcagtacagctgcgtcctgccacgccggaggagcagcgctacgccactgagcttctcacccgattgttggacatgggcttcatgcgccagatcggtttggccaaacgccgcatggcccaactgcccgacggcgaagagaagataaccctcctcggccaaatcgcccgcatggaaaccgcccgcaaagacctccaagcccaaatctacggcaacaccatcggctaatacccccccactgattgcgcgcatcctcgaatacgtgccggatgcataagtccatacaaccggttgccggattggatgggtgcagaagttgcggattggccccatccaaattggactggtttgggtgggccaatccaatccgttcaataatgaagcgcgataccaagcagcgtcgaaacgaagggaaactcatgacgcagaatcgtgcggaactcaaccgtaatctggcccagatgctcaagggtggtgtgatcatggacgtcaccacgcccgaacaggcgaaaatcgcgcaggatgccggcgcatgcgcggtgatggcgctggagcgcatccccgctgacattcgtgccgccggcggcgtctcccgtatgagcgatccggccatgatcaagggcattcaggaagctgtctccattccggtcatggccaaggtgcgtatcggccacatcgccgaggcccgcattctgcaggccatcgaaatcgactacatcgacgaatccgaagtgctttccccggccgacgacgtgtaccacatcgacaagaaccagttcgacgtgccgttcgtgtgcggcgcgaagaacctgggcgaggcactgcgccgcatcgccgagggtgctgccatgattcgtaccaagggcgagcccggcaccggcgacgtgattcaggccgtgcgccacatgcgcaccatgaacaagcagattcgcgaactcgtcggcctgcgcgacgacgaggtctacgaggccgccaagcagctggccgtgccctacgatctggccaagtacgtgcacgacaacggccgtctgcccgtcgtgaacttcgccgccggtggcgtggccaccccggccgacgccgccctgatgatggagcttggtgccgaaggcgtgttcgtgggctccggcatcttcaagtccggcgacccggccaagcgcgccgccgccatcgtcaaggctaccgccaactggcaggacgccgatctgctcgccaagctgtccgaaaacctcggcgaagccatggtcggcatcaatgaggacgagattcagaccatcatggccgctcgcggcgagtgagtgcattaccttggctcccctctttgaggggagccaggaaagggtgacgctcccgccagcgggagtcaaggcccaaggagacaacatggttgtagctgttgaatatatttccaaagaagaatccgcggacgccaaaaacgccaagcacggcgtgaccggcatcctggccgtacaaggcgcattcgccgaacatgcggcggtgctggacaagctcggtgcgccgtggaaactgctgcgcgcagccgaggatttcgatgaatccatcgaccgcgtgattctgcccggcggcgaatccactacacagggcaagctcctgcattcgaccggactgttcgagccgatcgccgcccacatcaaggcaggcaaaccggtgtttggcacttgcgccggcatgattctgctggctaaaaagctcgacaatgacgacaacgtctactttggcgcgctcgacgccgtcgtacgccgcaacgcctatggtcgtcagctcggtagtttccaggctactgccgattttggtgcagcggatgatccgcagcgtatcacggacttcccactggtattcatccgcggaccgtacgtggtgtcggtcggacccgaagccacggtcgaaaccgaagtcgatggccacgtggtgggcttgcgtcaaggcaatatcctggccaccgccttccacccggaactcacggacgatacccgcatccacgagctcttcctgtcgctgtagtcgattcgtctgccgttagactggtatccgattgacgaatcaaggagacgatctgctatgcagcttgagttgaatcgacgcagcaaggtgccgatgtaccggcagctggccgccgagctgcgtgaacagatcgtctccggcgcgatggccgagggctaccgcctgcctcccgaacgcgagctgtcctcacgtctcgaagtcaatcgcaccacggtgttgcaggcgtatcagcagctcaaggacgaaggtcttatcgcctccaaagtcggcaaaggcacgttcgtgctgccggctgcctccgcaagccgaacatcgcacacgtcaaacagtgacttcgggaatgcaataacgcgaacaacacgatcgtcggcagaaatgggaacatcgcaagcctcctcttccggcgacgtagaacgtgctacctccactgatttcttgacgacagaccagggcagcagctctgcggcggtccatacgattcgtgaaagccgttcggttcagggcccggaaccaaccgtcgtgcgtccgccatggtcggtgttgttctctgattattccaaccggtttacctaccatgacatcgcctcggccgagcgggcgcagcgcggcgacaccattattgacttcgccaccggttcgccgaacccggcggatatcccggacgatctgctgcgcaaggtcagcatcgaagcattcgaatcgcgggaattcgacggccaaccggaatcacctatcgagggattcgaagagttgcgtgcgctgcttgccgaacatatgcgcgcacgaggcgtacaatgcggcgtccgcaacgtgatggtgctctccggctccgagcagggcattgacctcatcgtgcgtgcgttcatcaaccccggcgactgcgtgctggtcgaacaatccacgttcttcccggcattgcagaccttccgttcggcggatgcgcgcatcatcggcgttccagtggacgagcacggtatgcgtacagacctgttggatgggtattgcgcgcgattccggcccaagctcatttacaccgtcccgacattccaaaaccctaccggtaccacgctgccgcccgaacgacgcagcgaactcatcgacgtggcgcggcgctatcagtgtctgatcgtggaagacgatgcttacggcgatttgtggtacggcggggaatcgtctgacgcacatcgccccatactgctcaaaggcatggagaatgcgggatacgtgatgtatttgtcgacgttctcgaaaaccgtcacttcgggcctgcgcacgggatgggttgtggccgacccgcatgtgatcaaccggctggcggctctgcggcgcatggtcgaccagcatacgagcacgtcatcgcagcgcatctgtctggaactgcttaaagaaggccgcatcgccgaacatttgcgcggtttgatcaaggcttaccgcattcgacgagatgcagcaatcgcagcattggagcggtatgcgccggatgaagtgtattggaccgtgcctgcaggcggctactatatttgggtttccttaccggacggcgtgcgctctctggatgtattggaatcctgccgttcccaaggcgtcacgttcatgccgggcagcgtgttcgacgttgacgaaatggatgattcccatattcgtctcaactttgtgcgcccggatgctgctgacattgataccggcattcgaatcattggcgagacgatagcacagatgtagccaagtgactggctcattgcggttgtcgagttttttgatggctgcatacccacatcgatgggtgcattcgacgaatgaataagcgaggaagccatcatcagttcgctgtggcatgcgcatagcgttgtcgggcgaacggggcagaccacgtggtcgttgcgtgacctggccgatcgagccggcatcgcattgcccctggcgtagtggcgaggtggcgcagtaacgagtcacgccatcgcgagccgatgatgcgaaatgcggaaccggtcgcggccatcaacggctatcatacatgcggaagcaacgatacgttggcgtcagcacatccatctgactccagaaagggacacgatatgaccacatcctccgtttcgccggtgaccactgaactggcgggcagcgaaaccggcatcacgtttatcattcacgccggagcgggcagtcgtggcaagcacagcacgcctgaacgcatcgcccaggtcgaacttgatctgcagcgcgccctcgatgccggataccagttgttggaatccggagcaccggcgcatgaggctgtggtcgccgccatccacgtcatggaagacgctcccgaattcaacgccggccgtggtgccgccctgaccagcgatggcatcgcccagatggacgcctgcctgatgaccggcgatggcgaggtcggtgcggtcaccggcgtaagcaccgtgaagaacccgatcgatgcggcgcgtgccgtcaaagagcagaccaagcatgtgctgttcgcggacccgaccgatgccgagatcgccgattggggcgtcgcgaccgaaagcaacgagtacttcatcaccgaacagcgtcgtcagtccttggccgaggctcagtccggtggcgatgagtgggagaagcatggcaccatcggtgccgtggcgcgcgatgccgagggcaatatcgccgccggcacgtccactggcggcatcaccaaccagatgcacggtcgtgtgggtgattcgccgctgcctggttgcggcacgttcgccaaccagtccacggtggcggtgtcctgcaccggcatcggcgaggcgttcatcaaggtggtcgccgcccatcaggtgtcggatcgtgtgcgtttctccggcgagaacgtcgaggatgccgcgacggccactttggacgaagtcgccgcgcatcatggcgatggcggcatgatcgttctgccggcggtcggccgtggcgtggtcgcctacaacagcgagatgatgaacttcggataccgtagcgcgcaaggaggtaaggtgcagggctgattgccccctgtattgcggcatatatcataatggccggtgtgctgcggattcttggtaaggaatccgcagcacaccggccattcatgtatgcggcaagtgccgccgatcagtgcggcagtgcgcgctacttggtgatcgtgttgtacgtgggcatgttcgtgtaatcgaactgcacgttcttcacgttctgtgcagacacggcggcgaaacgtttgaccgggaatactggggtaatacgcaacttcatcgctcctcttcctcgaatgaaactgtgttccattgctatgagccagccacgtacggtattcgtgtctggcctgccacacaatgatgcagccgtatatacgggcacagcattgcgcggcagttcattgtatggaagacatgcaaactcaatgtttccttgtccaaataaaaaaacgagcgcggctgatgtgcggcaccggtccaaaaactcatgtccgccagcgcaacgcgactacgtaccttatgctggtctgcgcgtaaaatagaatggctgcgatattgggttattcacggaggaatggatgcgacgctggctgatcaatgtagccaaaaatgagacgattctcatcgtcgccgcaatactcgccctgatttcgtgtttcattgtgccgccggacgccgattacaaaagctacattcacgccagcaccatcagccagctcatctgcctgatgattgtggtgtgcggattccagcgtatcggcgtgttccgcatcatcggttcgcgattgctggagaaggtcagcaccatgcgcggactggtcattacgcttgtcgctttgacgttcttttccgcgatgttcatcaccaatgacgttgcgctggtcacgtttgtgccgttcgcggtggccgtgctcatcatggctgggcaagaggataagaccatcctcgtggtcacgctgatgaccattggcgcgaacgtgggcagtatgctcaccccgatcggcaacgcgcacaacctgtatctcaaagccctgaccggcatgccgaccatggaattcctcggcatcatggcaccgtattccggcacggcggccgtgttgctggtcatcgtgatttccgtggtgtttggcggcaaaccggtcggcgacctgggcgacctcgaaaccggcgtgctggctcccgagcgcaacaaacaccagcccgacgagattcgtatcaccggctacggcgccggttatggcggctggcgcaccatcgtctactcgctgctgttcatcgtctgcctactggccgtctccgacgtgattcccctgtgggtgatgtgcgtgatcgtggtcgtcgtgttcctgttcaccgatcggcgcgtattcaaatacgtggattggggactgccgctcaccttctgcatgttcttcatcttcatcggcaacatgaagcgcgtgcccgaattctacgaactggcgcgctcgctggtcggcggccatccgctggaggtggcggtcggctccagccaggtcatcagcaatgtgcccaccacgattctgctttccggcttctgcgaccaatggcgcgatctgatcattggcaccaatttgggcggcatgggtacgctcatcgcctcgatggcctcgcttatttcttacaagaacgtcgtgcgccaatacccgcacaagaaaggccggtatctggccgtctactccgccgtcaacgttctgtttttggccgtattgctgaccttgagctggatcatcgagccgagtctctgagccgccgttgtgggttgggccggtctaccgcgcgtatacggtgggggagccggtcagtcggctcatggccgactgcgggatgtcgtggatgcggccgatggtggcatccagcgtggatacgccggatacgccgtctgtgttggctgtgttggctgcagaggtgatgctggatacgccgactgcggacgatgatacggccgcaaccatcggctgacgataggcgttggagttgcgggccagccgggcgagcgcagggcgctgcctgcggaacagattgataaacataccgcatactccttcatcgttggccggcggtcttctggccgccgtggtttccatcctgccctcccgtgcttgtattcgctatggggatagcccctattattccctgaatctgcacgattccccctcatccttgagggtgattctaacggcaaaggaatcggcctaatggccgatgtcgatcagcgcgaagccaccagcgtgacgctgtacggcttgatcttcatcgccagcaatgaagacggcgacggcaatgtgtaagcccgacgttccggcacaatcgcccccgaagcctcgccgcggtatccgatagtggttttcgccgtcggactggcgcttaacgtcgtcacctccaaacgcaccggtcgcgatggcgaggcgcccagcccggccagtccgcgcgcgatttccaacgtcacatccaccggggaatcggaggtattgacgattttgatgtaacggcaggcgtcatccccgtcatgcccggtggcactgacatacagatgtttggcggggcgtgacgcggtctgctcgatggacacggcatatgtcgtgtcgcccagatgcgtggaaaacagccgctccacctcataattcaccgtggggttcacatgcgccggattgagttcgataagattctgcgcccaccccttagccgggatatgcgcgagcagcggtgcataggaggtcatgcgcaccacgtcggaattgcgctcgcaaccggtcaggaacgcggcctcgccgagtgccgacttccacgtgttcgcgccctgttcggtctgcggttggccggcaaaatagccgttggctgaatattcgccgaaatagacgccggcgccgcaacgcgggtaagcgtcgaatcgtgacgcttggtatgcaaaccattcggggagtggtaagaatgttcgtcgatgataatcgcgtcaccggtggcggaatcatgtgccccggaatcggttgcggccaacgctcgcgcatggtcccagctgcgcttcatcgccggctggaaggggaacagtccggcgctcatcacacacagcatatccgggtatcgttcatgaatggcctcgctgatcatgtcaaacttggccacgtagtcagccccgaagttttcgttgcccacgccgatcatgtccaagccgaacggctcaggatggcccatatcacgccggaccgcggcccacgagctggactccggatcgccattcgcgaattcgatgaggtccaggtagtcctgaatcacattgttgcggaaggtggccgaattgatatccatgtggcgcggatctcggccgggcgactggcatgcgatgccggcgaacagagtaggcagcggcttggccttgaggtcctcgcacaggcagaaatattcgtagaaaccgatctgatagctctgcgaatagctggaaccatccggcatcttgaacgaccacatcgaatactgttggcgtcgcgcggccagagagccgacggtatccttccagcgatactcattgccgggcgtcacaccttcgacgatgcagccgccggggaatcgcagaaacgctggatgcaacgcctgaatggtctccaccaaatcgcggcgcagcttgccgtaacgccatttcgggtcgcccgcgccccaatagtccgcatccatgaactgcaccagatccagatcgaacgtggtgcgttcgccggcgtcaatggtgatacgcagcttgccgtaatcggtgttcagtccggttacgtcggcgttgaaccggtaccagccgtcacggccgatgacgatggcaccatccgacgaatccggactgatcgaaacgccggaatcctgcgcatcggccccatcgtcctgcctcagaccggtctcttccgtatcgtcaagcggatcggagtccacgatatacgacaatcgagtgatactggtgagcggcaggccgtacctatcgaccacgccgacggacagctcggcccgcccatgaaccggacgtaccgcgagactgacggaataggtgtggtcggcgacgatggagaacgcgggctcgcccccgttgtcgccgcctccgttatagccgaggttttccagatatgcagggccggtttcggaaggaacatcggacgtgatgcgagcgtatcggctatgtgcgtgaattggcggggcggggcagtcggtggtcacccgctggccgtgaatcccgcgtatctcactgccaaggccggcggcggaacagttgatgaaatcccagaaacgcagggaatcagcctgcgtacgccaccgttcggcaccggccatacgccacgtgtgatggtcgagataaacgccgtcaaaactgtagttgttcaccatgttggcgttcagcccgccatccgcaccatggttgatgtcctcgaagaacacgccgtacagtcgcccgcttgtgtgatgggtggggcttcccacgctaatccgcaccatggtttcgattgtagagggaatggagcggaaaggtaaacggaagagttcgctcaccgttcatgttgcggtcaatccaagtcgactgttcgccggtatacagccggtaacctcgaaacaggaatggaaaatacggacgactaggagcgcggctgtgcaatcctcggtgggaatacgtgagcgcatcgaccacgtgtatccgtcgctgcgtccggcggagcgcgccgtagcccagtatattcggaatcatatcgaggaggcggccgacctgaccgtcggtcagatggccgacatcgcccacgtcagccagccgacggtgattcggttcgcccgcaagctcggcttcggcggttaccgtgaactgcggtacgtgttgcgcaacccggccgccgaacacaaagtgaccttcaatccgctggccggattcgatctgaatccgtgggatggcgaagatgagattcccggtaaagcggccgatggcgcgaaggcgctgatcgacgagctgcacagtgcgttggaccccaaggcctatcgcaaggcggtcgccctactcgccgaatcggagttcatcgacattttcggcgtggagaattcgttgacaccggcgatggatctgttcaccaagctcggctacctgggactgacatgccgtctcaataccgacgcttacctgcagcagatcggtgccgggcacctgccccacggcgctgtggccgtcgccttctcccattcgggcagttcggcggatacggtcaaagcgttgcgattggcgaagtcgcatggcgcgaaaaccatcgccataaccaatgccatcggcgcgccgctggccagctgggccgacgtgacgttgctgacgggtcgtgattcgcacacgatctatggcaatgcgattttctcgcgcgtggccgataccgcgctcgtggacatgctgtacatgggcgtgattctgtccgactatggccggttctccaccgcgctcgacgaatccggtcgcatgattcgcgaccgcgtattcgagaactgagctgctgctttatcgcgccttgggccgtattgctctggtcgttgctgcttgggttgttgacgatttggtcgttgtcgccctggtcgctaccgtcctgaggcatgtgccagcgaatacgtagtggacttggcgtgcgtatgacgttcgatcttgccgctcaactccagctggtccaagagctgcgtcatctgatccttgttcaggccaagcgctttctgcatggttttacggctgagcttcacaccgcggaacgcgaggaaattgagcgtgaactgttccaacgtttgaggcgacggttccagcgttgccgtatcaagcgggcgggtactggcctgatcgtcaccgtccgggcgttcgccgaatccactgccgagaatcagcgtctgcagtggcgcgcagccgatgatgcgtgcgccggccaaagcatctgcggcgttatccgtcatgcgctgaatcgtggggaatgagtacattttggcatgctgtgcttcgtcagtggtgctgggcgcggcggaagcatcggcatcggtccgatgcgaggacgcggcctcggccgatacagggataggcagtaccattgccaccgaagtggggcccacgcgcagttgcggactgaccgcgctctgcgcgtaggcgtccataatgcgttgaatgccggtaccgcagttctcgcagaggcccaaatcggcgaacaattcagccaaacgcggggtgcgtggctggcatacgccgttgagtagatcgttgatttccaaaccatcggtcaggccgccgagcgacacgatttccaagcgggaatcgaagatattgatcagtgtggggccggagtacgtgtaatcgcgatgttccagtgcgttgaccaatgcttcgcgcagggctatggccgggtattggccggattcgttgatgccgttcagcagggcgctggcttggtcgagctggcgcagcaccgagccggtgaatgtgtgacgttcgcgaatggcgtttttgccattgccctcgaaaatggtggccttgataacgaacgggcattggttggacagcagggtggcaagcgacgattcggtggtgctggtgaaggtgttgttggtgccggtgttggtgatgctgccggcggggacattaccggcatcggcagagacggatgcagccatgttggtcacaaccgggctttcccaatccttgccttcactggcaaaacgatcctgtgcgtatgtgaaagtgagctcaccgctatcgcctgcgacggtctggcccgatgcggcgtgatctacgttgctctccgttgtccccatatcgccgatggtaccggtgcaagccgacgttacgccgaggtgttttacacccctacggctagacttacacgagtttggccccgtagctcagctggatagagcatgtgacttctaatctcaaggtcgacggttcgagcccgtccggggtcacgatgtaataagcccttggtccctcatcgtttgtgaggggcaggggcttttgaatattatgccggtctgggtccgtctggagcctgaactgtcgaccttgagattagaagtcacatgctcatcaccaccatccgggaacacccttaaggggtgcgtctcctgcataacggctatactctgacttgagatgtgctgaataataaccagctatcgcgcgtccgccaatggcgacgaacgagggaagaaggcccgtgccacgagcaatcatcgaggtaagaaacctacgcaaggaataccccgtcgaggatgagacggtggtggcgcttgaccgtgtcaatctcagtatcccgcaaggccagatctgctgcattttcggcgaatccggctccggcaaatccacgctgctcaaccagttggccggcatggaaaaaccgacgcgcggcggcgtgagaatcggcggcgtacccgtcagcaaactcgacgagcgtgagctggcggccttccgccagaagcatcttggcttcgtattccagtcgtacaacctgctgcccaatctgaccgcgctcgaaaacgtggcaatgccgctgatgttccgcggcgtgcccaaggaacagcgcgaacgtgcggcgcgtggcgtgctcacaagggtcggtctgggacatcgtctcagccattacccgcgccagatgtcgggcggccaacagcagcgcgtcggcatcgcccgggcgtttgtgaccaagcccgaggtggtgttcgccgatgagccgaccggcaaccttgactccaaaaccaaaaccgaggtcatgacgatgatctgcgcattcgcccatgacttcaaccagaccatcgtgctggtcacacacgatccgcagatggcctcatacgccgaccgcattgtcaccttgctcgatggccgcatcaccagcgatcggctcaacaccgacctttcccgcccaactgttccgtccacgccgtccgcccaaagaacccaaggagttgaccgatgaagcacctctcccaccgcaccatcgccatcatcgtcgcgttgctctccacgctgtcactggcacttgccgtcatctcccttccgcaccaggcgtacgcagtcgacggcacagacggcacaagcggcacgaacagtacgtctcagggaagcgacggcgattccgcgccaatcgccggcccggtgccgaacatcatcgtcaccaacttcacctatggcggcgattccgtggccgccggcgccgatttcaacctcgacttcaccttccagaacatgggtcaggtggcggtgacgaacatggtcatcaccgtggacggcggcgagagcttcgccatcgcgggaggcacgaacacgttctacgtcgacgcgctgtggggcggttacgccatgacgcaaagcgtgccgatgcaggcgctcgcctccgcgaaaagcggtgcccagcccgtgaccgtgaacttccgatacgagtatgtggacgccagcgcccgctcctcaagccagtccgatgtcaagatttccgtgccgatcagtcagcctgaccggttcgaaatcagtgatcccgtagtgcccgaccaggtgatcgccggtcaggaaaacacggtcacgatggaatatgtgaacaagggcaaaggcgatatcgccaacgtcgaggccacgatggagggcgaaggtttcgatgccacgatgaaaacccagtacgtgggcaatgtggcttccggcgccaccggcacgattggttacgcctttacgccgcacgcgtcaggcgagctgaagaccacgctcaaagtcacgtacgaggattccgacgggcagaccaaaaccaaggaattcccgctcgccatacccgtaaccgatatgcagccggtggatgattccgacatggccgatccgaacatggaccagagcgccaatcagggattgccggtgctggtgtatgtggtcatcgtcgtgatcgccgtggtcattatcgtggtgattgtgctgctcgtgcgtcgccggcgcaagcagaaggccaagaagaacgatattgatgaggactgggatgattggtccgaaggcaaggatgataagaccgataccgacgtgacggatggtgctgcggcagacaccgctcctattgcaccagcctcaccagcctcaccggccggcccgtcccacaaggcctgaaaggcccgaccatgcgattcggcgacatactgcggctttgcagacaaaacctatggcggcgtaaatcccgtacgattctgaccgtgctgggcgttatcgtcggctgctgctcgattgtgctcatggtctctttgggccagggcattaacgagcagaacgagaagatgctcaaatcgatgggcgatctgtccatcgtcaccgtgtacaccaacggttatgccggtccgatgggcggtggcggttcgtccgagatgggcgataccaagctcgacgacaaggccgtggaatccttccgcgcgatgagcggcgtatccggcgtgacgccgatgatgaacttcccttataacgtgacggccagagccggcgcgggcggccgttacctctacgattacgtgcagatcatgggcatcgacatgacccagttcgaccagatgggctacaagctcgtcggtggcgagaagccggtcaaaaaggatcaggtgcttgccggcgaatggttcgcctatggtttcatggacaccctgaagaacggcgaacaacgcaccagcacacgcggcggtcagtattcctcatgcacgtttgaccagaccaccggccagtgcgaggaagaccaggacgaggatccgttcttcgatccgctcgccacgcaaatcagtctgaccaccggcaccaattatcagggcgaccagtacaccatgaacatgtacggcggcggtggcggcacaggcggtgcgggtggcaacaccgcgggtcagtcggaaaacgtcacctttgatgtgcgggcttccggcattgtggcgggcgactacaacaaaggctatgccacctccgacggtctggtcatggatttgcaggcgttgaaggaactggccgccaaagtcgatccagccgccgccaaaaaagccaccgcctataatcaggtgctggtcaaggccgccgacctcaagtccgtgcccgaagtcgaatcacagatcaaagcgttgggctacgagacctcctcctatgaagacatgcgtaagtcgttggaagaacagtcgcgcgcgattcagctgattctgggcggtatcggtgcggtttcgctgttggttgcggccatcggcatcgccaacacaatggttatgtccgtaaccgagcgcacgcgcgagatcggcattatgaaggcgcttggctgctacgttcgtgacattcgcgtcatgtttcttgcggaggccggcgcgatcggattcttcggcggattggtcggctgcgtgctgagcggactgatatcgctgggcatcaacgttgtcggcgcgttgtatgcgggcggcatgagcggcggcatgtctggcggtatggtcagcggtgcaggcgggggctccggcgacggtaccggtggcggaacatctatctggaccatactctggcaggcgatagttggtggcgagaatgtgacccgttattcggtgattccgtggtggctgttcctgttcgtcgtactgttttccacgctgatcggcttgctgttcggcttcggcccggccaataaagccgttaaaatcccggccctagacgccatcaaaaacaacgagtgatcgcctctgtcacctgctccaccgttagtccataacgttcgttcagttcgcccagcggcacgcggtcggtaaattccttggctgcgccgaagttcagcacatgaggattacggctgccgtccgagacatgatgattcgcataatatgcggtcactttctcgccccagccgccttcaagctgcccgtcttcaagggtgatgacctgctggtggccatcacgcaacgactccagtacgtctgaatccagcgacgtgcactggcgcgggtcgataaccgttgccgtgatgccataatcggcagacaatgcggcggccgtctgctccgccaacggatacgcattgcccagtccgataatcgcgacgtgcgagcccgtctgattgacccgccaatccagcatgtgacgcacaccggcacgctgagccgttacgctaacggtcccgcggactgttgcggcagatatgcccccgctggcggagctgacggagactggcagcgaagttgactgggggcggtcagcgatctgcccacccgtcaccggcagcagcgtcgcatcccgttccgccgccagaatcgcctcgcccggcactcgaatcaccgccggaccagcaggggcgtccgccgaaccggccggcgcggtagcccatgccagatcagccagatagtcgcgagccgaagtcggcaccagcatcgtaacccctggaatattggagaacatcgtcacgtcatatgcgccggaatgcgtattgtccgaaccggacaggccgcccagaaaatcaagtaccgtgacccgcgaacggttcaggctcatctcctggaagaactggtcgtacgcgcgctggaagaaggacgccgtggtggccaccaccggcgtgccacccgcccgtgcgatgccggcagcgtacgccacggcatgcgattcggtgatgcccgtgtccacgtaatgtgcgcccgcgcgctctcggaactcatgggtgatgccgttcgagcccggcgtggcgggggagatgaccacgagtcctggctcggcggcgaaacgcggttcgagcgcggccatcgccattttgccgtaatgcttgcgcggatcgtccggcttgccgattgcggcatccggattctgccaatgcgaggcctcgcactggccttcatgtggttcatggtcggacaggttgcagtgatccgaatgccacggctcgctgtggttcacgttatcggtggggtgcacgccggtgggggagtcgagtgagaccggtaaggtcgaggcgttttgttgattggcgtgagtctcctcactgtcatatcccgcgcccttcaacgtatgaatatggaccaccaccggatgatcgatgccgcgcacctcttcgaaggccgagaccagcgcggcgacgtcgttgccggattccacgtaccggtaatccaagccaaacgcgttgaacagattcggctgggcggtgccaccggacgcgcgcaggcgggcgagcggaccgtacatgccaccgaaatcgccggcaatcgacatctcattgtcgttgaacacaatgatgagattgccgccctgctcagccgcgttgttcagtccttcaaacgccacgcccgaactcagcgaaccatcgccgatcacggcgatcacattgccgatgccgctgttcgggccttccatatcgcgggttttcgccaaaccgcaagccaatgaaatcgaggtaccggtgtgaccgagcacgaactggtcgtgtttgctttcgtccggattggtgaagccggtcacctcgctgaaacggtccgggtccagataggcggcggcgcggcccgtgagcattttatgcacgtagctttggtgggatacatcgaacacgatgcggtcacgtggcgaatcgaatacgcggtgcagggccaccgtggcctccaccatgcccagattggagccgatatgaccgccgtgttggtggccatatgccagcagcgtggtgcgaatctcacggcagagttcggcgagctcgttgggggcaagggccttgacatcggccgggctggcaatgcggctcagcagatgggagtcgtcgccatgggaaggggtaatgctcgggggtatgtcgtgaaggcgtgcggtcctctcggcagcgccggagacggcgaaggaatcgcttgaatcaaatccgtttcctgacgcgctgcgcataccctcgaatctcccttcgctagtctttccgaagttgaatgctaacgcccggcattgtccgaggtccacatgacgaagcaatgcccccaacatctccgtaaatgggtgattcgttcgctgcgcgatgtgggacaatgaatgcggtaattccttttgataccaaggagcgcgcaatgaaggccgtatacgcatccaccgtcaaccatgccgatccgcttgccgcgttggcagtgggcgagcagcccgaaccccaggcccgcccgttctggtcgaccgtttcggtgcgcgcggtgaccgtaaaccatcacgacgtctggtcgctacagggtgtgggtctcgccgccgaacagacgccgatgatcctgggcaccgatgccgtgggcattctggacgaggacatccccggcaagcatgggctcaaggccggcagcgaagtggtgctgtacacgttcgtcggcaccgatggcgcgggcgtggccccgggcgagcgccgcacgatcctctccgagaaatatcccggcacgatggccgagaagacttccgtgccgtccgccaacgtgttcgccaagcccgcaagcctcaccacggctgaggcggccgcactcggcaccagctggctgaccgcctactcgctgttgttcgatgccgccggcatcaagccgggcgactccgtgctcattcagggcgcgggcggcggcgtgtccactgcggccatccagctcgcccatgccgccggtctggaggtgttcgtcacctcgcgcgacgcggacaagcgctccaaggcgctgaaacttggcgcgaacgccgcgctggagatcggtgcccgcctgccgcgcaaggtcgatgcggtgatcgagtccgtgggggcggccacatggggccattcggtgcggtcggtgcgtcccggcggcaccatcgccatctgcggcgccaccaccggcgaccagcccggtgcggagctcacgcgactgttcttccaggacattcgcgtgcagggctgcaccatgggttcgcgcgaggatttcgcccggctgctgcgcttcgtggagcacgccgacctgcatccggcgatcgactccgtggtcagcgggttggacgccgcccccgaggcgttcgccagaatgatcgccggcgacatgttcggcaagatcgttattgagctgtaagcctcacagaattatgtattgagaacgattcgctgcgtggcttaactccgctatcaggagtacagtgggccttattctcaataactagggagtaaatgataatggcaaatgaatccaagcccgaagtcgcagtggtcatgggatcggccagcgactgggagaccatgaagcgtgcctgcgatattctcgaccagttcggtgtcgtctaccacaagcaggtcatttccgcgcaccgcacgcccgagctcatggccgagttcgcgcacaatgcccgcgccaatggcctgaaggccattatcgccggtgccggcggtgccgcccacctgccgggcatgatcgccgcgcagaccacgctgcccgtaatcggcgtgcccgtgcgctcccacgccctgtccggctgggattcgctgctgtccatcgtgcagatgcctggcggcatcccggtggccaccaccgccgtcggcaactccggtgccaccaacgccggcctgctcgccgtgcagatgctctccgccttcgagccggaactggccgacaagcttgaggattaccgtaacgaactgaaggaaaaggtggccgaatccaatgcccagcttgtctgaagaaacgggcggccgcgtctccatgctgatgccgggctcgaccatcggcatcatcggcggcggccagctcggccgcatgatggctctgtccgcccgctacatgggcttccgcgtcggcgtgcttgacccaacgccgaactgcccgaccggtcaggtggccgacttccagatcaccgccgagtacgatgacaaaaccgccatccatgatctggccgtgcagtccgacgtgctcacctacgagttcgagaacgtggacgccggcgccatcgacgaggtgcgcggcatcaccgccaccccgcagggcaccgacttgctgcgcgtgacccagcaccgcgtgcgcgagaagcagttcatcaacgaccacggcaccgccaccgcaccgtggcgcgctgtcaacaacttcgatgagcttgacgccgcattgggtgatattcattatccggccgtgctgaagaccgtgtccggcggctacgacggccacggtcagctcgtgctgcgttccgacgccgacttggagaagatccgctcccgctccgaccgtggtggtggcttcccgccgagcatcctggaaggcttcgtcgacttcgcattcgaggcttcgattctggtctccggcaacggcaaggacttcgtcaccttcccgattgtgcgtaacgagcaccgcaacaacatcctgcatatgaccatcgcccccgccgaggtgtccgaacatgtggctcgcgaagcgcatgaactggcgattcgcctggccaagggcttcgaactggctggcacgctggccatcgaactgttcatcaccaaggacgatcaggtcatcgtcaacgagctcgccccgcgcccgcacaactccggccactacaccatcgaggcctgctcgatggaccagttcgacgcccacatccgcggcatcgccggctggcccctgcccaagcccaagctgctctcgccggccgtgatggtcaacgtacttggccagcatgtggaaccgacgcgcgcgctgatcgccacccacccggagtggaatgtgcacgactacggcaaggccgaagtgcgccacgaccgcaagatgggccacatcaccgtgctcaccgacgacccggccaagacggtcgctgaccttgaggccaccggctgctgggacgacctgaaaaagaaggcgtgaccttaccgatggttgaacatatcgaacgccagaccaagcagaaggacgcgattcgcgccgccttggccgactgcgaggagttcatctccgctcaggacctgcaccgcaggctggaggacgaaggctcgaaaatcggcttggccaccgtataccgccagctcaacgccttggccgatgccggtgccgccgacacgatccgcctggacggccagcagctgttccgcctatgcggcgacgacggacatcaccaccacttggtgtgcaggcggtgcggcaaaaccgtggaaatcgacccgcccagcgaggcttggctgcgcaaagtggccgacggtcacggcttcaccgttgaatcccacaccttggaggtcttcggactgtgctctgattgccaaaaggagcagaaagcgcagaaggctcagaaagcagtgagcgaataacaaatgggatcggcttcaaagccgatcccatttgttattccgctgctattccactgacttcagcgcgccgagcatgctgtttctttgaggtcgtgttctgcacgatgcctttcacgccgtccagcttcatgagcttggcgctgcgcgactccacattggaggtctcgtggttcttgagccgcaccatataggcgttcgactggtgctgctcgccgaacacgtgcttatagccacccgaagtcatgaacatgaaatgcccgaagtagggaagccggcttgtcacgcagcttgcgtttggccgctacccaggccggtaccacggtgctcgcccaggccagcaggaacgccgccagggtgatggcagggtggaacgccagcatgacacgccgatgtaaatgcaaatgataataattctcaatacatgttattctgtcgtgttggtggctgggcgatgatgcagcaacagcagcatcgcccagccgttcggctaattagagaggaaaacccaatcatgtccatcatgtccaacgccaagcgcgcgctcgccatcgcggccgccgcggcgaccctgctctcgatggccgcctgcggttccagcaacgccgccagcggcaagtccgattccagcggcgccgcgtcttccggcaagatcgaggtcgtcgcctccatcaaccagtggggttccgtggccgaagacctcggcggcagcaacgtcgaagtcaccaacatcatgaccaagaccaacgtcgaggcgcacgattacgagcccaccagccaggatgtcgccaagttcggcaccgccaaggtagccgtagtcaacggcgccgattacgacccgtgggccaccaaggccgcccagccgaccaaggccacgctggtcaccgccgccgaaaccgccggcatcaaggaaggcgacaacccgcacgtctggttctccgccaaggtgcgttccaacaccgccgacgccatcaccgccgcctaccagaaggccgacccgagccacaaggacgactacgccaagctcaacaaagaatggcacgccaaggaagaccagcttgagtccaagatcaaggagacttccgccaagaccgagggcctgccgtacgccgccaccgaatccgtggcctggtacctggccgacgacctcaagatgaccgacgccactccgaagggctacgcccaggcctccgccaacgagagcgagccgaccccggccgacatcaaggacttccaggacaccctgaaggccggcttcatcaagatgttcgtcttcaacagccaggaagcaaactccactactgaccagatcaccggtgccgccaaggacgccaacgtgccgatcgtggagctcgccgagcagatgccgaagcagtacaccaacctgctcgactggatgagcgcactggtcgaccagttcgccgccgccgtgaagtaatgcggcagtagccgtcaatccgcaacagcgataaggggaataatcaagtcagatagcgaggcgttgtctaggggagaacagaacacttcgctatcagggataggctccttatatatcagggtgcttcggggatgtcccgaggcaccctttgcgttagggtgaatagttaggaaacggtaagaaaaatagtggaactatggattttccaaggttcagcggcaacaatatgcccttgaaaagtcacatacggaaacaggcgaatgagcgagaacactagtaataccaccacagtgaaaccccatttcaagctttgggccaaaaaggtcgaagccaatgaagtcacgccccaacacccccacaagcccttccccggctgggtgtatggcgtgctcttcgttatcttcgacatcattgtcgtgacggcgctcgaagtgggcgtttcgtccagctccacccgtgtgcagctgtccagtccgaccgtcggattcggcttcgtgagcaagatgtggaccgacggcaatttcgtattcgtgctcaacgtgatacttgtcgcgttgctgtacctcatgttgctgatgctgttcaaccggttctggacggcaagcatcgtgattctcgcggtcggaatcatcgtggccgccatcgaacatttcaaggtcgagatccgttacgaggccattctgcccgccgatctaggcttccttggctcgaacaccggcaacatgctcaccttcattccggccggtgcgcatgtgaccatcctcgtggcactcggcgcgttcgccgtactgctcgcgctgattctggtgctgcgtcatttcgatgggcgcaaaggtcgcatgattcgtacggataacctgagcctgaacctcacctcccgtctgattcttctgctgctgccgattctggtgttcgcgttgtactgcattcatgtgagcaccaccgattcgctggccaacaagttctcccgcgccttgggagacacgccatccatgtgggattccgtgtatgacgcgcagcgcaatggtccgctcgtggccttcacccgccagctcaacccgaagatcatggacaagccgagcaactactccgaggagaccatgaagaaggtcgccgctcgctatcagaaggaagcggagacaatcaacgcctcccgcaccaacaacctcactgattcgacagtggtgtacgtgttgtccgaatccttctctgacccgagccgcgtgccgggactgaagaccaataaggattcgatgcccaacatccgcaagatcaaggcgggcaccacctccggcctgatgctctcctccggctacggcggaggtacggccaatctcgaatacatgggactttccggcctgagcatggccaatttcgagtcctccctgtccagcccgtaccagcagctggtcccgagccagcattggactcccaccatcaaccagctgtggggcgcgcccgtcaactcgctcggctaccacccgtacgaatccagcatgtactcgcgtgccacgaactacaagaagttcggcttctcgcacttctacacgttgaccggtccggacgtgatcaagtatcaggacaagatcgacgagtcgccgtacgtctctgataagtcttcctatgattctgcgttggaaggcatcaagtccggcaagacgaacaagttcattcagatcattaccatgcagaatcacatgccctaccacgagtggtatgagaataacgactacaccgccgaatccaccacgggtacgccgctgggtgatgatgaacagcagtcgattgagacctatcaaaagggtgtggagattaccgatcaggccactcaggagttcctgaacgaactggatgcgctggataagcccgtcaccgtagtgttctacggcgatcacttgccgggcatctactcgtccgccagcgaggatgacaacaactccttggccctgcacctgaccgattacttcatctggtcgaataaggcttccagctcccaaggcaataaggcaagcgatgcagcctactcttcgccgaacttcttcgtggcacaggccgccgatcacatgaacgccaaggtcagcccgtatctggcgttcctgaccgaaatgcattccaagattgccgctatggaaccgcctgtggtcaacaaggtccaaggctgggatcgtattcccgaaggccagaacatctatctcgaccaaaacggcaacccgatgtccaccgatgacttcgacaaggaaaccaagcagttgcttgccgactacaagctcatccaatacgacatcaccgccggcaaaaactacctcaaagacacagattttatgacgctgcctacagacagcctagtaggctgtctgtaggcagcgtgcgagccgacagacgagccagcaaggcgcggggcgtagcccgtccaaaattgcagtagcgctgccgtaaagcagggggtgctttcatgacgaaccagactttcgaacaactgaagaagacttacgaatccggtcgtacccggccgctggcatggcgccgcgcgcagctgaacgcactacgccgtctggttacggagaaccgtgatgcctttgtctcctcggctatggctgacttgggcaagcccgcggctgaaaccgtgctcatggaactgaacctggtggctggtgaagcacagttcgtgcgcaatcgtctgagcctttggaccgcccggcatcccaaagcgatgcattggatgttgcagccggctgccggatggacgattgccgagcccaaaggcgtggtgctcatcatttcaccgtggaattatccggtgctgctggccttggaaccaatggctgatgcgctcgctgccggtaacgccgtctgcttgaaaccgtccgagctttcaccgaatacgtccaagctccttgctgagttggtgccgcaataccttgactccgaggccgtgcgcgtggtcgaaggcgggcccaaggaaaccggcgaactgctgaaatgcccgttcaaccacatcttctataccggtggcggccacgtcggcaaaatcgtcatgcgcgcggcggccgagcatctgacgccggtcacgctggaactcggcggcaagtcgccatgctttgtggatcgcactgcggacatcaatgtggctgcacgccgcattgcgtggggcaaattcaccaatgccgggcagacttgcgtggcacccgactatgtgctcgccacgccggatgtggccgaggctctggccgagcgcatcgccgtagccatcaccgaattctatggcgaagatccgaaggcctcgcctgattttggtcgtattatcaacgatcgtcattttgaacgactgtgcaagctattgccggtcggcaccgtgccgcctgaggagccgagctcgccgctggtgcaggtggcatcggcggtaggcgcggccatggatatggttgggcggcgcttcaatgccgtgactactgggcgcggtggcgcgggggagatggccggcagcgcgaacaatgcggcgaagccgacggccggttcgaatatggcagccgctgatgatggtgcgactgcctcggccgctgttgagccgagcgagattcacaaggtgcccggcgtgttcgacctggccggtcgaatcgtttgcggcggcaaggtcgatcgtgccgcccggtatatcgcgcctaccgtgctgtacggtacgtcgccagatgcgccagtaatgaaggaggagattttcgggccgattctgccgattctggtggtcgaggatgccgagtccgcaatccgattcatcaacaagcggtcccggccgttggctgcatatgtgttctcgcgcgatcacgaggttcggctgactttcgaacgtcagaccagctccggagccttgggatattcgctgccgttgggccatctgctgtccagccggttgccgttcggtggcgtgggcgcgtccggcatcggcacctaccacggcaaagcaggcttcctcaccttcagccacgtcaaaaccgtggttaccaagccgcagttccccgacactctgcgcctcgtgtacccgcccttcaatgaagccaaggccaaactgttcgacatcatcgccaaattcagctagcgtgatatcgctcgctgatattgggtgatggcgttgtcatagtgacgttcgctgtcccggtaattacgtcaatcgattgattcgtgtaccgggccagatttttctgtcctagtatttgatttcgggtcatttttgcttaccgggacaaaactgacgccggaagtatcgtccgcgtattacgaaaatggcggaatagtgcggtttcgtatggaagggaatttcaaatattcctatattcgaggggttcagctgtcctggtttgcgaaaaagagccgaaatcggctaccgggacagaaaaatctggcccggtagccacgtcaatcgattgacatgtctgccaggccaaaaatatgcagcagatgcgccgcttctgttacttcagggctttgaagccgatgtcgtggcggtaaaacagtccgcgcagctcgagcttgtcgatgattgcgtagaccttgtcctgggcggacttgatgtccggagcggaggtttcgacgagcagcacgcggccagagttggccacaaggttaccgtgctcgtcagaggcgacgccggcgtagtagacgtgcgaatcctcgtcgacttcgatttcgggcacacgggcacccttgatgacgttctccgggtagccgttggaggcgatgaccacgccgagggtggcgttggactcatcccaggtgaattcgggggtttcgccgtcgagaatggcggagatgccggcaccgaggtcggaggtgagcttcgggagcacgacttcggtttccgggtcgccgaagcgggcgttgaattcgatgaccttcgggccgtcggcggtggcgatcagaccggcgtacaggataccggtgaatggcgtaccttcctcggccatgccttcgacggtggggcgcacgattttctcgatggcctcgtcgaccacggactgcggaatctgcggcaccgggctgtaggcacccatgccaccggtgttcggaccctcgtcgccatcgtgggcgcgcttgtgatcctgggagatgggcatcggccagaaatcggtgccgttgacaaagctcatcagggagaattcctggccgtccaggaagtcctcgataacgaccttggcaccggcggagccgaagcgatggtcgatgaagatgtcttcgagtgcgcgctgggcggtgtgctcgtccatggccacggtcacgcccttgcctgccgccagaccgtcggccttgatgacaatcggggcaccgtgctcgtgtacgtagtcctgcgccatctcgagatcgctgaaggtcttgtattgggcggtcgggatgttgtgtcggtccatgagctgcttggcgaagtccttggagccttcaatctgggcggcggccttggacgggccgaacgccttgatgccggcggcggcgaaatcgtccacgatgccttcgatcagcgggacttccgggcctacgaacacccagtcataaccattgttcttcacgaattcgataagtgcggcgtgattcgactggctcagctgcgtggtgtggatgccgtccttgagcatgcccgggttgccgggagccacggtgacttcgtcgatgctcggtgccttgagcagcgtgtaggcaatggtgtgctcgcgcgcgccggagccgataaccaatactttctgacccatgttgttcctttcctgcggaaagcgagttacttcagtacgatttgcgtgccggtggtgtcggcggtgatggagccgagcacgtaggcgggctcgttgttgtcggcgagcagcttcagcgcctcgtccttgcgagcggggtcgatggccagcaccatgccgatgcccatgttgaagatgttgtacatctccttatgatcgatgttgccggccttctccagcacgtcgaagatcgggagcacgggccaggtgccgagctcgatttcggcggccaagccgtccggaatcatgcgcgggatgttctcgatgaagccgccgccggtgatgtgggccacgcccttgaccacgcccgccttgaacaggggagagagggccttgacgtagatcttggtgggggtgagcagcacgtcgccgagcttttcgccgcccagctcgtcgagttcggtgtccacggtgtagccggcctgctcgaacagggccttgcgcaccagggagaagccattggagtgtacgccggtggagggcaggccgatgagcacgtcgccttcagcgatggtggaaccgtccacgatggcggacttttcggcaacgccgaccgagaatccggcgagatcgtattcgtcttcgtcgtacatgcccggcatttcggcggtttcgccgccgaccagcgcggaaccggcctgtacacagccgtcggccacaccggccacgacctgctcaagcagtgccgggtcgttcttgccgcaggcgatgtagtcaaggaagaacaacggctcggcgccctgggcggcgatgtcgttgacgcacatggccacgcagtcgatgccgatggtgtcgtgcttgttggccagcttggcgaccatgagcttggtgcccacgccgtcggtgccggagatgagaaccggctccttgtagcccaaggaggccagatcgaacaggccgccgaagccgccgatgccgccgaccacgccggggcggttcgtgcgggccacgtgcgacttgatgcgcttgacgacttcgtacccggcttcgacgctcacgccggcgttctcatatgcttttggcatttggttggcctttctacttattttggctcccctctggaggggagctgtcggcaaagccgactgaggggaggcaagcgcctctggttcaaagaattgttattgagcggattggtggtgagctattcggcgtccggctgcacggtgttgtactcgttgccgatgtacttgctcttgtacagcgcgaattcaggcagacgcacacggtcctcgggcgtgagggacttcaggaagtcggcctcgtagtcgtcgagcgcagtggggtagtcgccgttgaagtaggcgacgcacaggccaccgtatggggcgtcggcgttcagtccgatggattcgaccagaccgtcgagcgaaaggtaggccaaggaatccgcgccgatgtattcacggatttcctccacgctcatcttggctgcgatgagttccttggtggtggagatatcgatgccatagaagcaggggtacttcagcggcggggagctgatgcgcatatgcacttcagcggcgccggcttccttgagcagctgcacgatgcgcttggacgtggtgccgcgcacgatggaatcatcgatgacgataacgcgcttgcctttaaccacgctgcgcacagcagagagcttcatacgcacaccctgctcgcgcagttcttgcgtgggctgaatgaaggtgcgggccacatactggtttttgattagacccatttcgttgggcaggcctgctgcttccgcatagccggatgcggcggacaatgaggagttcggcacgccgataaccatatcggcctccaccggggattcggcggcgagacgtgcgcccatgcgcttgcgggcggagtgcacgttgacgccatagatatcggaatccgggcgggcgaagtagatgtactccatcgagcagatggccagctgcgtgttgttggtgtactgcacgatcttgtagccgtgatcgttgaccaccacgatttcacccgggcgaatgttgcgcaccagctcggcgccgacgacatccagtgcgcaggtttcggaggcgagcacgtaggcgccgttcttcatcttgccgagggagagcgggcggaagccgttcgggtcgagtgcgccgatcatggcgtcttcggtcatcagcaggtaggcgaaaccgccatgcaccgtgttgagcgcttccttgagcttgtccataaaggtgcgctgcatcgaacggcgaatcaagtgcatcagcacttcggtgtcggagttcgaatggaagatggcgccttcgtcttcaagcttgcggcgcagtgacgggcagttcgtcaggttgccgttatggcacagagccacgtcgccgtcatggaagcggaagatgaacggctggatgttgtctgtggtgcccgagccggccgttgcgtaacgcacgtggccgatggcgcaattgcccttcagtcgttcgatttcgcgctcatcgccgaacacctgggtgagcaggccgagtccgcgatgaccgatgagatgaccgttatcgttggagacgatgccggcaccttcctgaccgcgatgctgcagcgcgtgcaggccaaaataggtgagtcgtgaggcgtcggggtggccccatacgccgaagatgccacattcctcgtgaatgtcttcgagttcagccgacaagccaaagctcctttttcaaacaggggattaactatctatcaaccctaccaatcggcggctacatcgcgtgttgtggggtggtggaacttgttggggtttgcggacgcggtttaagcaccagatcagtcaagtatgaatagtggcttaggattttggcctttcgctgtttgtggtgggtggttgtggtgtggggtgatgccgacgggtaggttggaagcatggatacctcttacctgttcaccgccgcattacctggtgctccactttgtgctcaagcgtgataccgaattgtcggtgtgacgtgatcggttgactttcgtcaacgcaatttgaaaggctccgacggtattatccgtcggagcctttcgtcgtatgaatccggtgcttgtttttcggcttcgtctcagtgcctgaaatggctgaagaactcgatggtctcgggatcctgcgactcgtccatcacctcagcgggtgtgccgttctcggcgatgacgccgtgacggagcagtacgatgcggtcggccgcttcgtgggcgaagctcatttcgtgcgtggccatgaggattgtggtgccttgggcctttaactcggcaaccatgttgagcacttcgccgaccagcatcggatcaagagcggatgtgatctcgtcaagcagcagcagttccgggtcggtcatcagtgcgcgcgcaatcgccacgcgctgctgctggccgccagagaactgatcggggtaggcactggctttatcgcgcatgccgatgcgttcaagcagttccatagcgcgggtttcggcgcgatccttgctccagtggtgaaccttgattgcggcaagggtcacgttcctgagcaccgacatgtgggggaagaggttgaactgctggaacaccacgccgatacgtgcgcgaatcttgtcctggtcggcacgcgggtcggtgatatcggtattgcccagccaaatctggccgtcatcgacctgttcaagcaggttgacgcatttcatcaatgtggatttgcctgaaccggaaggccccagcaaagccaccacctcatgttggtgaatgtcaaaggaaatgccacgcagcacctgcgtgtttccaaaggatttgcgcacgtcatcaagacgcagcaccgtcttgttgctcacgggggagtcactcgcctcggtggtgatattggtcatttcgctcataccgttcctccgctgagttcgcgcttacgcagacgttccgtgtaccagtcgttcagcaggatgaacggcacgctcatcaggatgaacagcaggctggcgaccacatacggcgtgaagttgtaggtgctggccacgtcgatctgtgcggcgcgcacggcatccaccgcacccagcacggaaatcaggccgacgtccttttgcatggagatgaagtcattcatcagtgcgggcgccactttgcgcaatgcctgaggaatgacgatcagtcgggtcgtctggccggaggtcaggcccaacgagcgggccgaggctcgctgagaaggatgtacgtcgttaaaaccggcacgcagcacctcggagacgtaggcgctgtatcccattaccactgcaatggtgccgagtaccgagggatcgatacggccgaacaagcctaggccgggaatgccgaaaccgattagatacagcacgacgataataggcacgccgcgcatcacagtcgtgtagatcaatgccaggatacgcagcgggaacagaataggggagcggctggtgcgtaccagcgcgatcagcgtgctcagaatcgccacgccgaccactgcgacgagcagaacgcggatgttgagccataggccgtcaagcacatggggaaacgatttgacgaagtattcgccggagaagaaggtctccttgactcgtggccagccgggggagagcttcaagccgatgacgatgaccaccacgaacacaatggtgctgatcagactggtaatcgtcgattgaatttgctgatgaacacgatattggcgtcgttcgagctcgacctgacttacctcgtgtccgtcaggggcattgtgctgcctggtttcggttggtgctgcggtcatgtgatgaatgtcgctcgcttcctgaatgccgggatggccgggtgccacaggaaaattcccgcagcgcccggccaaggtgttgtgaccttatgatgtaagcctacttcacttacttcttcagttcggtcaggtcggtggtgtactcggccagccacttgtcctgaagcttcttgatggtgccgtcggcgttcaggtcatccactgccttggtcacggctgcagtcagcttggaatccttcggcagcacgatgcccatgccgctcttgtcttcggagtcaggcagacggccgagcaccttggcgtccttgacctgctcggactgcaccatgtacacgcattccacggtgctggtgaccagtgcgtcgatctgaccggcgtcaagtgcctgagccagtgcggcatcatcattgaacgtctggatgtcgtccttgatgttcgccttggcgtagtcgtaggcaagggtgccgaccatgacgcccacggtcgcatccttcagatcggataccttggtggcgttggcgaacttgctgtctttcttgaccacgacggactggctgtcgttgtagtagctggacgagaagtcaacggccttcttgcgctcgtcggtgatgccgaactgctggatgttgaaatcccagtccttggcgccgggagcgatggcggtgtcgaatgcggtgcgggtccacaccacgtcgctcttcttgaaaccgagcttgtcggccactgcgtaggcgacggccgcctcgtagccctcaccgctttccggcttgtcgttcataacccacggctcgtaggccggctgtccggtggcgatggtcagcttgcccggcttgtacgtctgctgggtgatgtcgtccgaatcggcggaattggatgcggtggactggccggaaccgcaggctgcggtgaacgacagagccaggatgctggcggtggccgcaatggtacggacgatgtgtcgcttattgaacatgggtttcctctcctcaagtgttcgtcatgcacacggttcaaaccgtgcttgatgcattcgcgccaattgtatggctattgggttacaaaacatcgatattttcggatgctggctatcgccattgcttatggccgactagagccgcgcaatctggcgcgtaagcggacggatatctcatattggcgcagagcgaaatggcgttcactgttcgagtgtgaagccgtcgaatacgaatcccggactgaccacacaggagaccagcgcatcgccctggcctggcactgtgcgctgccagacgccagccggtacgaccgcatgtcccgatacggttacgtcggcctgatcggtggtgatgccggaacccaaggtgattacggttcgcttggattcgtcggattccggagtctcgtcgctgccgccgagctccagtttgaccgatgccgggccatgccacagccagacctcatccgcatcgaccttatgccaggcgctggcatctccctcgggcagcaggaagtaaatcagtgacgatagcggtcggcttgaggcctcatccgtgtgcggggattgccagtcacgcgtgtaccagccgccttcggggtgggtttccagtccaaggcgttccactatggaccgggcgtatggactcatgtcttgcaaagcgacgctcataatgagatctcctgttcttggcgggtttgctggtttttggcttcttgatatcaggtcaggtcagcggtgtcaccaggcgttgttgtaggcttcgcgcccggatatcaccgtggctcggttcgtgcctgcgccgtgcctcaccagtgtttccagcgtttcttcgatgccggccggagatgatgtgtcgacggggatgtcgaagaacgcgaaatcagccaatgcgcccgcgttgatttgtccaatgcggttgcggcccacgtgcatgcccatggaggcggcgccgcccagcgtcatcatacgaatcaggcgatgtgtcagatcgtcgctggcatagccttgttcgcgggccaggtcgtaaagcatcgacacgtcatcaagcagatcgagggtcggcgtgctggagagcgaatcggtgcccacgcttaccagattgccttcctcgaggtattcgcgcaccggtgcatctttgccggtgttggtaatgcgattcgatcgggggcacaaggccacgcccacgccgcgctgacgtagaatacgccgatcctcgccattggcccacacgccgtgtgcaatgtgcacatccggtccaagcgagccaagctgatcgacgaactggatggcggaggcacctttgcccacttccttgagctgccggtagctttcccaatcgtggtcactccagtcggccgccgaataagtggtgagcaccggcggataagtgccggcctcgagcggggtctccgccagatggatatgcagtcgcatgttcagctgacgagcaatgtctggaagatcaacgaacggttcggactccagcgtatacggagcatgcgggctgatgccgaggtttggcagctgctcctcgttcatccggcgcaactgccggatgagctcagtgcggcccttttccatccattcggcgttgtgccagcccattacctcccaataagcgatgccgtgcatgccctgcgaagccagcgcgccggcggcgtccaaatcggtgacgatgtctgcggcggccgtcgttcccgattcgaccatctggcgagcgccgtcctcggcccactgcttccatggctgggtcttctgcgcctcggcgtacacctcgttgaatgccagttcccaggcgcggaaccgatcgtaggtgccttgcccgacctgcaccatgccgctgtactgcagatgagtgtgcgcgttgatcaatccgggggtgagcaccccatcccaatgccgttcatggatggtgccgtgagccgtcatttcctgcttcagcgccttcagcacccagcggcgtttacctacatgaaccacgcggtcgccatgtatggcaactgcgccatcgatgatgacggggcccgtcacggggatgatgagtttggcggaatacagtgtcacatcatcgataagctcggtatcgacggtcggccaggtgttgtcggtcatattctcctcgctgcgttgtgttcggtgccgtgtctatggctatcggtcggcgttctctcggtcgttttccgcgaatctggtcagtcgccaattgtagccgttgtcctccacggcatggctggctcggtatccgcgcgccttgagcgcgctggcggcgatgcgctggtcggtcgctgcgtcaagtctgataagcgtgtgatccagtgtgcctcgatgttccagaagatatgcgacggcgctggcctgtacggcgaagctcagatccatgatctcgattggattgccgcctcccaccgtgtagttcacgccatcgccgtcggcgattagcgtgagcgttggtccgtcgggaacattgagttgcacggtgtccctgttgacctgtggggtgaagtcgcttacctcgtccaaggcgatttcgttggcgatgccgccgatcactgcgagcgccgcgccctcgtgcattgcgcgcatgtgctcaagtgtgaccgtatgtctcacgccagtggcggacaccaccatatccgcgcaagggagtgcctcgtcaatgtcttgtgcggcgaagccgtcgaacaccgctttgagtgaagccactggatcgatatcgcagatggtgacttcggcgccaagcgcgcgaatgcgccgtgcgaagccttggccgaccgggccgtagccgatgacggtgacgttcttaccgtcgaatgcatgctcgccgagaatgcgctgcatggtggtcacgcatgtctccccagtgccgtgggcgttgtcgaatccggttttcagcacactgtcgttaacggctacgaccgggtaggtgagggctcccgcttcctgcatctgctggaacgcgcgtacgccgctggtcgtttcctcggccactccaatgaggttcgccgtgagttcggggcgttcgagcgaagcgagacgggcgaagctggcaccatcgtcgatgatgatgtccggctgtatttcgtccagcaggtgcagggccgcctcgtgcgcctgttccgcggtccagtctcggctggattcgaccgtgattccttcccggcgcagctgttccgccactcggggatccgtggaatccgggccgcaatatacgccgacgattgcgccggcggccttaagcttgcgcagcagaatcgcggtttttggctccagtatcagacagacggcaatacgaatgcctgagaaatcgacgcgagtggtgaggctatccatggtgtcgcgtaataccggcatgtgctgttccgcgtactccattgcctccagtccgcttgccttgcgcatatcggtgatggaatcgatgctttgtgtgccgtcgcataggaattcctcgttgtgctcgtcggtcatcgtggcatcttcgacggtcatgccccattgctgggcctgagacttgatttcggcatgcttctgtggctccggaatcgcgagtcgggctcctgccagtgatcgattcgtcttctgggatcgggctgccgcccacgctgcaaaatcgctgtctgctgtaatgcttttcttcatattccccatggtacgcatgcatgccgctgctccgccgctgcgcgtgtggcgtgggtgaagagcgtgcttgggcgcgttgcgtgcgtcgacttcggcagcttcgaacaggcatgttgcatcgaacaaatgttcgactgtgttgatatgctggtcgggccagcggtggtaaggaggtgatggcgatgggcagcggaacggtatcgacgcaacgcgagcatacctatattgccattgatctcaagtccttctatgcctcggtggagtgcgtggctcgtgggctcgacccgttgaccacgcatctggtggtggccgatgaaacccgcaccgataagacaatatgtttggcggtctcaccctcgctgaagaactatggcattcctggccgtgcgcggctgtttgaggtaaaacagcgcctgaatggagtcaacatcgagcgcgcggtccatgctcccggcggccgattaatcggggagtcctgcgatgcgtgcgacctggaacgctcgccggggctcaaagcctcgatggtcatcgccaagccgcgcatggcgcactatctggaaatcagcgggcaaatatatggcatctacctcaaatacgccgcacccgagcacatccatgtctactcgattgacgaggtgttcatcgacgccacgccatatctgcgctcgctgggtatggggccgcatgcgatggcgcgaaccatcgtgcgcgaaatcctcaccaaaaccggcatcaccgccactgccggcatcggctccaacatgtatctggccaaagtcgccatggatatcgtcgccaagcacatgcccgccgacaaggacggcgtgcgcgtggccgaactgaatgaaatgtcatatcgtcggctgctttgggatcatcgtccgctcaccgatttttggcgggttgggcgcggctatgccaagaagctcgagcatgccggactgatgaccatgggcgatatcgcccgatgctcggtgggtcgtgcttcggattactacaacgaagacctgctgtatcgcatgttcggtgtcaatgccgaactgctcatcgaccatgcgtggggctgggagccgtgcgaaatcgcggatatccgatcctatgagccaggtgcgcacagcattagcagtgggcaggtgctcaccggccccgccgactatgccacggcccggctgatcaccaaggagatggctgatgcgctggccctcgatctggtcgataaaagcgtgctgacgaaccgactgacgctcgccgtcggctatgacatcggcagtcttgattcgtcaaagctcgattcgtgcgctgattatgcgatgaaacgtgccgctgagcgggcggcgaaaagctatcaagggccggtgaccatcgaccgatttgggcgcaaggtgcccaagagcgcggtcgggtcgattggtttgggtgatttcacctcgtcgtcggcacgtattcgtgaggctatgacgatgttgtacgagcgcattgtggattcacgcttgcttgtgaggcggttgaccgtcatcgccgatgatgtggccactccggaggagctggccgccggcaaacgctatgaacagctcgacttgttcggtgatgacggggcccaatcgtatggatccgattccaccagcgaaaaagatggagagcatgatatccagcgtgcgctgctggatgtgaaacgtaaattcggccgcaacgccgtcatcaaagccatggacatggaagacggtgccaccggtcaggaccgcaaccgtcagatcggaggccatcgcgcatgaccctgcaagagacccgtgcgtacgacgacatcatcaacctgccacaccatcagtcgcgcaagcatccgcacatgtcccgccaccagcgggccgcgcagttcatgccgttcgcggccctgaccggctacaaccaagtcatcgagcaaacagcaaaaaacgccgaaaccgccatcgctcaggccgaagcccaaggcgataccgatttcggcgcttgacaatcgctctcgttggaggaagtctcagattcgtcagcctacgtgacgttcgaagcggtggaagccggtgatcttgtcgatttcggccatcgcgtcagccggaatcacaaagcccgcggccttcatgttgttctccagttggctgggcttggaggcgccggcgatcacacagctgatctccgggtgctgcaggatccatgccatggaaagcaccggcaggttcgtgccgagctcgtcggccaccttgcgcagctgctcgaccttgtcgaggttctcatcggtcagcagatcgttgatctggtggtcggactgccaggtggcgcgcgagccggccggcagcggctggcccttgcggtacttgccggtcagcagaccctgcgcgagcggggagaacgtggtgatgccgatgccgagcttgcggcaggtgcccatgatctcatgctcgatgtaacggtcgtttaggttgtactgcggctgaaccacggtgatcgggtacaggttgtagcggtcgatgatgcgctgggcctcttcaaggcgagccgaaccccactcctcggaaacgccatagtacagcaccttgccttgggcgaccaggtcgctcatcgcgcgcaaggtctcggtaaggtcggtggtctcgtcaaaacggtggcagaagtacatgtccagataatcggtctgcatgttcttcagcgtctggtcgatgctctcgaaaatgtgcttgcgggacaggccgcggtcgttcacgccttcgccggtggggaagtagaccttgctggaaatgaccagttccttacgcgggtactgcttcagcgtcttgccgaggaagcgttcggccgcgccgccagaataggcgtccgcgcagtcgaagaagttgacgccggaatcgtaggcgagcttcacggtctccttggccacgtcctcagccgccgtgcccttgagatccgtgacccagctgcccagtgcgacctcgctgatcttcagtcccgacttgccaacgctgcgatacttcatgtgtgctccttgataatcaatcgtcaccgtcgtctcttcatggccggccgtgaacgctaacaattcttattgaaacagttcaaccccacttgaacgcaagttggcggctattgcgacacgccggtggtgacttcgcgggcgcaacgaatgaaatcatcaatgacgctccaccgatacgatgtggccggaacgccgaactgaatggcatatgcggtatccgggccgcaatccagcacgcgcaaagtacgcaaccgttcgccgtcaagcagcgctggcaggaaccgctccgggcataggcaggcacccatgccgtaatggcacagttccagcagagtcagtacgttatccgaacgggctgtgactttcggctcaaaaccggcacggcggaacagcagatcggcaatgcgtccgtcaatatcttgtgggctgcctaggagaaacgggcaatgctccagtgaggaaaggtcacctgcggcaatggcgcgctcgtccggcgcggttctgacggcatcgacttggccattcgccgcgccaccggtagcggccaaatccatccacagtgattgtgcgaggaccagcaccatgcgctcgttatagaaatccataagttcgatgccggccggtttcccggcgaagtccgccaccgccagatcaagatcgccgttcgccagccattgttgaatctgatcgttgcggccctcaatgagttcaacgatgatattcgggcagtcacgttgcatcgccttcacaatcggcggcatgatcgcccggctacgcgtgtaggcaacacccacgcgcagcacgccggcctgatcgccggcgatgtcgcgcatttcttggccaagtgcatcgcgatcgcggcggaatcgctgcgcatatcgcgcgaacaccgtgccggcataggtcaattcgagcggcacatggcgtacgaaaagcgtgcatccgagctcccgctctagggcggcgatgttcgcactcagcgtctgctgcgtgatccccaaccgtttcgccgccttgctgaagctatgttccgaggccacggcggcgaagtattcgatgctgagaaagttcatggcgatactcccgtgtgtatggcgtttgcgtggtgtgtgtatgacgtgtcgtggcgcgaatcaatgccacagtattaaacctgtaatagatatcagtttagtctgtatttctcctgttatcttaggtcatggctcgtgcgaatagcgttgatgtttgcgactgcgggtcatgagatggaatctgagatgaggctgtagccggaagaggagaggatcgcatgctggaagcgggcacgatgttgctgttctgtgcggtgctgtttgccagcgtcgccctcggctggtcgattattcccgcgctgttcgttggtgtgctgctgttcatggggtatgggctggttcgccggtgctcgttgcgcgcgatggcgagccgtgcggccggcagcgtacggtccgcggggaccgtggtggtggccttcgtgctcatcggcgtactgacctcgctgtggcgggccagcgggaccatcgccttcatcgtggcccattcgaccgcggtgattcacgccgccacggtgattccgctgtcgtttctactgtgctcggcgatgtcggtgctggtcgggtcgtcgttcgccagtgcggcgactatgggcaccatctgcatgtcgttgggattgtcgatgcaggcgaacccggtgatgctcggtggcgcgattcttgcgggcgtctatgtgggcgatcgttgttcgccggtttccaccagtgccttgctggtcaaacagcttacgcatacgaacctgttcaatactattgtccgcatgctgcgcacgggtgcggtgccgtttgtgctgagttgtgtggtatacgttgcggctgcggtggtggagtggctgtgcgcgagcggtggttccggatttggtgcggctagtgcggctgctacggctggctcggctggctcggctagagcggctgtttcaaccaacgcaagcagcataaccgatatcggcggattgttctcatcggccttcgatttgcattggcttaccctagttccagcattactggtcatcgtgttggcgttgctgcgtgtggatgttcggctgcttatgctcgccagcattgccgcctcggtcgcggtatgcgtgggcgtgcagcacatggaatgggcagaactgttgcggctgcttattttcggttaccatgcgcaaaatccgcaggtggccgcactcctggacggcggcggcatcctctccatgctcactgtgatggccactgtctgtatctcctccgcctacgccggcatttttgccgagacgcggatgcttgctcggctgcagcaggtcatcgagatgctcggtcatcgcatcggcgcatgtggtgccaccatgattaccgcgacttgcgcggcggcgctcgcctgcaaccagaccctcaccatcatgctcactcaccagttgtgcggtgggctgtacggcgacgacgaatccgaacgctccgcacaagctatcgatttggaagacagtgccgtggtgatcgctccgctgattccttggtcgatcgccggtgccgtgccgcttgccaccatcaacgcgcccacactcagcctggccgccgcgaccttcctctacctgctgccgctctcgcggatgctcgcctcggctgtacgccgccgctcgggatttcggactcggcatcgatcccaaaatcaaaacccgggactcgccatcccacaccggcccaaacccatgctccacatgttcgctcatggtttccatcctaagtcgggcgattgagcgcacgaggcaatcaggccgagaactgtttgccgaattccgagaagagctgacggcgggcgaagacgagcaggccgagcagcaccagcagggagaccagcccgctgaccatcaccagtacatcccacggagcccagccgagcggaatgaacgtcagaggcatcagaccagcgacgatgtcgaacgccagatacttggcgtactcgtcaatggccttggcccgcagcacgataagcagcaccacgtcaaagaccagcgaaaccagacacgtgatcggtatgacgaacatggtgacgacatgattcatcgtcgccacaaaccagaccagcgcaatcgccagcatgatatagaaatatcgaaacatgaggcgaagcggccgcggcacgtgcagaatcgcactattgatgaacagcacgctgatgatcagcgcggccgccgatgcactggcaatcggtatcggccacgaaaacagatagctgaagaagccatgcagcagcaaaatcgcgccggttacaaacgtgatgatttccaccgccaaacgcctcggacgcagatagatctgctgcgcggggaatgcggcgggggaggcctcgccgcgcaattcgttctggcagagcgggcaacgggccatatcgccggtgaaatcgacggtgcaggcatcgcaatgcttcatgccgacgctcctttctccacatgcacgccagcgatgttcatacggccgctgatgccctgcgcggcgagaatccgacacaggttcttgatgacgttcagatcatggtagatggtggagatgccgatgctcaggtcgtcgccgaacgagcagaccgtgaaattcaggctggccggtgtggtgaggaagctcaccgaacgtacatggcgcgcgagtcgttcgtccaaggtgactcggccaaggttcgagacggtggtcgtggtctcgcggtcggcgatgaaccgggccagctccagcacccagtccttggcaggggagggcgcaagacgcagcaccggattcttttccagcgcaatcatgcggttcatatgcgattcgacgcgctcgcgactggtggcatggccgagctgctcctgcacatggcgggcgatgtcggccaacggctcatcggtcagcaatccacccataccgttgccgtgcgcggtgcgggcggcggactgctggccgtcgccggctgcgtctgggcttgttgcggaagttttcgcggagtcctcatcggcttcgatttcggccggcgtgtacgccacgtaagtcatgccgtagaagttgcgcacggtctccgacctgaagaaggcgcgcaagtcgaccggaatatccacgcgaatcgcgcgattgcgggcgcgcgagggcatgacgtcgcgaatcgcgcacagtatcgcggcgatgaggtaggaggtgagactcactccgcactgatgcgctgcaccaagcaccttgctggcgctgacgtggtattccatgaacgtaggcgcggcccggtcgatggggccggccagccggtagatcttcgtgcctggcgcagcgccggccttgtctttctcgtagtatttgtcgaagctgttttcggctttgtcgctatccgaaccgtcgtaatccgaaggcacgcccggcacgtcgtatcgctcggcgatgtaggcgtgcagcagcgacttgaacaggttgatggcgccgcgaccgtccgaaatgatgtgcgagacctcgagattgacacgattgcggaaatagcttacgcggaacagcatgcttttgggcccgtaatgcagtcgcgagcatatcggcagatgttccggctccaccagcggccggccgtctgactgttcgaggtaatgccagaacatgccgttgagcaggtgcacgttgaagctcgggaactgggcgatggcatggtcgagcgcgtgctgcaggatgtccggatcgatgccgtccgccagctcggccgaatagcggaacacggtctgcgaggagcggccagcctgggaggagtagaacttgccgatgttgtctagtcggtaccaagtacgtcttgccacgcgtcgcctccctccggtgcgttggcggtggtgccggtgccgggagctggttccagcggtgtgccgtcgaggaaatgctcgatgattcggtaggtggtggccaccagtcccacggccgacgtattgagcaggtagccgtggatgccatcgtgaattcggtaacaggagacgttgtcgttcaccaattgcaggcgacgggcgtacgcttcgtcctcgtctctgagcgggcagtattcggcggacaacaccagcgtgcgcggctgattgctcaggtcgtgcgcggtgagcggcgcgaaatacggattggtcagatcggccacggacgaacggtacatgtcgatgtagtcggccatgtcctgtgcggtgaggatgtagtcggtgccgttggtccgcaccgattcgaacgggctggtctcgggattgtaatcgttgccgactaccgggtaaagcagcatctgcgtgcgcggcatgaactcgccgcggtcgcgggccatgagtgagacggcggccgcaagattgccgcccgcgctgtcgccaaacagcacgatgctgtcgggatccggtgctgggattgtcgcagatatatcgcccccgccggcgggggctgtcggcgcagccgactgggggtgatcaacatcaacagaaccacccaccccagaaatcggcaattccccagcaaacagctgccgggctacctcatagcaatcctcaacagcagtagggaagcggtattcaggagccagccggtactcgactgagatcacacggcgttgcagacgtacggccatatgcgcgcaagcctgcgtgtacaggttgatgccgcctgtggtccaaccgccaccgtggaaaaacaggatcgtgccacgcggcgtgactgagggaagttccgtgttggcattgccggaaataccgtcggcgttgccgctcgacgtgctttccttgatgagtattttgggtaggactttgggtaatacggcgggcagaatcgcggatattgccgaggccacgggcgtgccattggcggaagattcctccagggcttcgggcaggggcgctccataggcgaccagcggcgtgaacactcgcaatggtacggcatatccatccgccataggcgcgaaggcgtcctcgacacggcatttcggattgtcgggtgcctgcttggcgataagctcttccgccacgcgctgcaatttgtacgacttgcccgcgttgggcttgatgtagctggcggccttcatcgcggcgaacaatgcctcgttgatcggcatgacgacaggtcctttcagcggcggattcggtagtgcgaacaccccaaccttagcccatgaccggcatgaacaaaaaagggaaggaacccgagagttccttccctgtgtgccgtatcagacgcgatacgcgccgattatcaggcggtgaagtattccacgccggcctcgaagatcggctggtacttgttgccgggcacgttgacgtacaggccgttgccggaacgctccgagtgacccatcttgccaaacacgcggccgtccgggctggtgatgccctcgatggcgagcagcgagccgttcgggttcacatccaggtccatgccgggggtgccggtctcgtccacgtactgcgtggcgatctggccgttggccctgagctgggcgagcacctcgtcggaggccacgaagcggccctcgccgtgggagatggccacggtgtgaatgtcgccgaccgaagtcttggacagccacggggagaggtcggaggccacgcgcgtgcggaccagtcggctctggtggcggccgatggtgttgaaggtcagcgtcgggcaggcgtcggtcatcggcacgatgtcgccgtacggcaccagacccagcttgacgagcgcctggaagccgttgcagatgccgagcatcagaccatcgcggttcttcagcaggtcacgcacggcctcggtgacggccggcgcacggaagaacgcggtgatgaacttggcggaaccgtccggctcgtcgccgccggagaagccgcctgggatcatcacgatctggctcttgttgatctcgtcgaccaacgcctgcgtggattcggcgacggcggccggcgtcaggttgttgacgatcagtgtggtcacatcggcgccggcacgctcgaaggcggcggcggaatcgtactcgcagttgttgcccgggaacaccgggatcaccacatgcggcttggccacggaagagccgacgtacacggtcttcttcggcgcgtggaagtcgatggtctcgacggtcgcgcccttgtcctcgcccttggaacggtacgggaacacggattcgatgccggactcccaagcttcctgcacagcgtccaggtccagcgtctcgccggcggccttgaacacgtactcggaggtggtggtgccgatttcgccgatctcgaccaaattggagacggccggaagcttggcatcgtccgccagctcgacgatgaacgaaccgtatgccggggtgaacaggtcgtccacggcgatgctgttgttcagggtcacgccgatgcggttgccgagcgtcatcttgaacagggcttcggcggtggcgccatagcccggcgtagagacggccagggcatcgtggaagtcggtgagctcctcgatcacggagaacacctcaagcagcgcatccttgtccggggtcagaccgtcggccaggtagcgcggcgcgatgcgtacgatacggtgatcggcgtccttgaattcaggggaggtggcgcgcttcatgttgcccacggccacggcgaaggagatcagcgtcggcggcacgtcgagatcctcgaacgaaccggacatggagtccttgccgccgatggcgccggcgcccaggtccacctgggccatcagcgcgccgagtacggcggccgccggcttgccccagcgttccggctcgtcgcgcagcttctcgaagtactcctggaagctcaggtaggccttctcatgctcgaagccggccgcgaccagcttggccagcgactcgaccacggacaggtaggcgccggtgaactggttcttggacatgatgtacgggttgaagccccacgccatcgccgaagcggtggtggtctcgccgaacaccggcagcttggcgaccatggccatgttcggggtgagctgacgcttgccgccgaacggcatgagcacggtgcccgcgccgatggtggagtcgaagcgctccgaaaggcccttgttggaggccacgttgatgtcggtgaccagcttgttcatgcgttcggccagcgtgccctcgccccacggggtctcgtaggactgctgttcctcgacatgcacggtctggtgcttggaagcgccgttggaggccaggaactcacgggacagattcacgatcttgtcgccgttccaggtcatcaccatgcgcgggtcctcggtcacggtggcaatcaccgtggcttcgaggttctcttcgcgggcgtaggccaggaactcgtccacgtcctcggcggccacgtccacggccatgcgctcctgggattcggagatggccagctcggtgccgtccaggccctcgtatttcttgggcacggtgttgaggtccacgaacaggccgtcggccaactcgccgaccgccacggacacgccacccgcgccgaagtcgttgcagcgcttgatcagacggcaggcatcgccgcggcggaacagacgctgcagcttgcgctccaccggagcgttacccttctgcacttcggcgccgtcgagttcgagcgattccacgttatgcgccttggacgaaccggtggcaccgccgatgccgtcacggccggtgcggccgcccagcaggatgattttgtcgccaggggccggggtttcgcggcgcacatggtcggccggggtggcggccacgaccgcacccacctccatgcgcttggccacgtagccggggtggtagatctcgtcgacctgaccggtggccagaccgatctggttgccgtaggagctgtagccggcggcggcggtggtcacgagcttgcgctgggggagcttgccttccagcgtctcggagaccggcacggtcgggtccgcggcgccggtgacgcgcatcgcctgatacacgtaggagcggccggacagaggatcgcggatgcagccgccgatgcaggtggccgcgccaccgaacggttcgatttcggtggggtggttgtgggtctcgttcttgaacaggaacagccagtcctcgtcgtggccgttcacgtcaaccttgaccttgacggtgcaggcgttgatttcctcggactcgtcaaggccggtcaggacaccgttcttcttgagccacttggcgccgatggtgcccatgtccatgaggcagacgggcttggcgtcacggccgagctcgtggcgcatcgccaggtaacgctcgaaggcggccttgacggtggcgtcatcgatggtcacttcgtccagctcggtgccgaacgtggtgtgacggcagtggtcggaccagtaggtgtcgatcaccttgatttcggtgatggtgggctcgcggctctcctcgctgaagtacttctggcagaattcgaggtcggccagatccatggccagaccgcgctcgtcgatgaacttctggccggcttcggcgtccatctcgttgaaaccggcgatggtctcgaccttgccgggcaccggcacctgggtcttcagggtttccttggtctccaggctggcctcgcgggcctcgaccgggttgatcgcgtaatgcttgatggtgtccacgtcggcgtcggtcaggtcgccttccagcgcgtacagcttggcggagcggacggtcgggcgctcgccctgggagatgagctggatgcattcggcggcggagtcggcgcgctggtcgaactggccgggcaggaactcggtggcgaagaccttggcgccggcgaagtcgggcaggtcgtaggccacattgtccacctgaggctcgctgaacacggtgggcacggtctggtcgaacagctcctgggagatgccttcgacgtcatagcggttcacgatgcgcagggccttgaggccggtcagtccgaggatcgtgcgcagttcgcccgcaagctgctgggcttcgacatcaaagccgggcttcttttccacgtacacgcgaaaaaccatggaaatcctttcttgaaattaaagacaattggctcccctcgagaggggagccagataatgcattactcggcgacttcgatgccttcggacttggcgagttcggcgaggcgctcctcgatctcttcgtaggccgggatgatgctgccgagaccacggcggaacaggtccttgtcaaggtgctcgaccttgccggagtggtccttctggtcccacagacggcaggaatccggggtgatctcgtcggccaacagcagcgtgccgtcggtggcgcggcccatttcgatcttgaagtcgaccagcttgacgtcgatcttggcgaagatctcgatcagggcctcgttaatcttgcgggccagcggggcgatctcggcgagatcctcgcgagtgcatacgccgagggccaccaggtcatcgtcgttgacgaacggatcgtgcagatcatcgttcttcaggaagtactcaagtaccggctccttgagcggcaggccttcctccacgcccagacgggagcagaagtggccggcggccacgttgcgcagcacgatctccaacgggaacatgttcaccttgcgcaccagctggccggtgtcgtccactcgcttgataaggtggctgtcgatgccgcgcttcttgagcaggtcgaagatgatggtggtgatgaggttgttcagacggcccttgccggtgaagtcttccttcttttcaccatcgccagcggtggcggtgttcttgtattcgacccacagaacctcgggatcgtcggttgcgtacagttgcttggccttgccctcgtagagcttttccagcttctccatgactcacctttcaggagtggaatttctgggtgaactaacggtaaaagggtaccaatcgagggctacaacaacactcagcatgacgctacgatgcggccggcgcatcatacgtcgctgcatcgaacggccatacgctgttgggatggcggaggcggccgtcattggccagtacgatcagctcgtctccggtcgtgtagccttccggcatgaaggtatctgcagaagcgcgtgtgaatactcagatgttcgtcaatagacgaaacatgactcttcggccatatacacacgataatgggagtgacgaaatggtacaaggaggttcgtcatgatcgttcatccacgacccggacggcaataatattgaggccatgctgagctgatcaggccgtggactactccacggtaatcgtcaacgcatcggccacgaggccggccttggcacgggcgtcggcttcggactcgccgacggccagtgccacggccatgcggcggtggccatgcacttcgggcttggcaaaaatgcgcaggtccgtgccgggttcggccagagcagcggccacatcggtgaactcgacctcaccgtcgccggccaccacaatcgcatggcttgccgccaccgagccggccggaatcgtgagcgacacatgctcgggggtgatcggcaggccgagaatcgcgcgggcgtgcagcgcgaactcgctcagacgctgggaggccattgtcaccataccggtatcgtgcggacggggggagacctcgttgaacagaatcgagccgtcggtgagcacgaacagttccacgccgaatacgccccaaccggtttcgccggccgcctgagccttggccaccaagccttcaacggcggtacgtgcgatgtcgcgcgcccgctcggcctcaccatcgggttcggtagccggctgccaggactcgcggtaatcgccggactcctgacgttggccgatcggcgcgcacgtcacaatgccggcggacgaagaaacagtcagtaccgtcagctcacgctccagcggagcaagcgcctcaacgatcacgcgcgacacatcgccctcatcggcggcgcggcggccctcctgcgcttcggtccaagcggcatcgatggcgtcggcggaacgcaccaccgactggccgtgaccagacgagctcatcaccggcttgaccacgcacggatagccgacttccgaagctccggcgcgcagctcttccagcgagccggcaaaacgatacggtgtagtcggcaagcccaattcttcgtgggccagtacgcgcaggcgctcgcggtccatgcaaatcgcggcgatttcggcgctcggcaccacctgggcgcccgcggccgcagtaccggccagcacatcggtggcgatggcctctacctcgggcacgatgatgtccggcttgatttcatcgaacaatgcctgcaattcggcggcattcgccatatccaacgcgcgatattcatgcgccacctgctgggccggagcgccggcatacgagtcagcggcgcacacccacgcgcccagtcgcatgagctcgatggccacttccttgcccagctcaccagcgcccaaaaacagcacgcgggtggggtgcttgcccagcggtgtgcccagcgggcggttggctgcgcgagttgcgggggagacggcggaagtctcggcgggaattgcgggagaggaggtggaagtcacggcagtatttacggcgttctcagtcatacccacattctgccatgccgcgatgatttcgcctatgcggggctcggattcggcgacgtgcgctgcggagcgcgtgattcaatattgggcaaaatgcggcagcccataccatttcatacgcgttcaggcagcgcggccgacgccattgcagcgcggtggtttaggatgaggcaatgcgcgaaaacgggattgaagagagcattgatcgtccgctgactatcgctcttgtggtcgatacggtgggcaatcagggcaacggcacctccaattcggccttgcaatgggctgcagaattggagcggcaaggccatcatgtgaggcttgtcggtataggggcgcccgaatatccggcgcgcgtgaatagggtgccgctcgtctcgtgggtggccgccaagcagctcatgcaattcgccgaacccagcgacacgttgttccgcaccgcctttcaaggcgtggatgtggtgcatatctatatgccgttcaaattcggccgtcgtgccgctaaagtcgcccaccaaatgggcattcccgtgactgccggattccacctgcagccggagaacgtgctgtattcggccggccctctacgtcgcattcccggtatttccagcttcctgtactggctgttcaagcactggctgtacaagcacattgaccacatccatgtgcccaccgaaatgaccgcgagcctgttgcgcgcgcacgggtataaagccaagttgcacgtgatttccaatggttattcaccggtgtattcgccgaagaagccggccgatccggatgcctcggctcccgtgccgttccgcgtcatcgcttccggccgactggctagcgagaaagatcagattacgctgatcaaggcggtgtcgatgtcccggcacgccggcgatattcagctggtgatcgccggtactgggccgctcaagcagtatctcaagttccgcgccgggcgtttgctggcgcgcaaggccgatatcggattccacaagcacgccgatatgcccgatttgttgcgttcgggcgatttgttcgtgcattgttcgattgccgacatcgaatcggtgagcgtgatcgaggcgatggcgtgcggattggtgccggtgatcgccgcgtccgaactgtcggcggccagccagttcgcgctgatcgacgagtcgttgttccccgtgcgggacgcggccctgctggcccgacgcatcgattggtggatcgcacatcaggccgagcgcgccgaatggggcgaaaaatacgccgaatacaccaaggcgcattattccgtggaagcctcggtccacaagttcgtggatatggaacgcaaggcgataggggagtaggagccttctcgtttgcggagaggtctttccctcagtccgcctgcggcggccagctccctcatcagagggatctacgaaaaaacctccctctgatgagggaggtggcatcgcgaagcgatgacggagggagagattagcgaagggttttacaacaactcaataagttgatcgacctcttcaggcgtggtggcccagctggtgcagatgcgcatcacggtgtgcgtgtcgtcggccttttcggtaaagccgagcttgatctcgcgctccagacggtcgatggtcggctgatccatcgtcacgaaaatctggttggtgggcgcttcgaaagtgagcgtgtagcccttggcgcgcagggcctcgcgaatacgatcggccgcctcattggcgttgcgggcgatcttgaaatacaggttgtcggtgaacaaagcgtcaaactgcgcgcccagcacaaagcccttggccagcaaggcaccgtgctgcttgatgagggtcaagaagtgcttcggcgtgttgtgcttggtaaacaccacggcctcgccgaacagggcacccaccttggtaccgccgatgtagaacacgtcggcgatggtcgccagatccgcgagcgtcatgtctgaaccggtggcggtcagcgcgtagccgagtcgcgcgccatccacgaacagcggcatgtcgtacttgtgcgccacatcggcgatggcctgcaactcggccttggagtagatggtgccatattcggtgctttgcgagacgtacacggagcccgggaacaccatgtgctcgtagttgccgtccgcatagaaggtcttgcagaactcgtccagttcggtcgggtccattttgccgttgtgctggggaatcgtgagcaccttgtgcccggagaactcgatggcgccggcctcgtgcacgttcggatggccggaggcgaccgcgaccacgcctgcatacgccggggtgatggtgtcgatgacgacctggttggtctgcgtgccgccgacgaggaaccacacatccgcgtccggctggccgcaggcctcgcggatcttggccttggcctgatcgctcagttcgtcggacccgtagcccgaatacagatggttgttggcttcagccacggcttcaagcaccgcgggatgggcggcgcgggagtaatcgttctcaaaagacagcatgacggaccttttgtccttatgttcggtgaattggatatgccctgagtgtacaacgcggtggttcccggcatgcctatttggcctataacccaggagcggggaattcagggagaaaaaacaaaacccttccgcgaacggaagggttttactggggtggccaacgcggctcgaacgcgcgaccttctgaaccacaatcagatgctctaccaactgagctatggccaccatagtgccgtattcagcaagctgaattcgcgcaacaggtgaatactatacacaactttgcggatgtgtgctcatcggtgtgtcgcgatggaatcaagtggtcggtttcattcttggggccaggctgcgggctgtctcagatggcgggatgtggatgagtgggtcttgtgcggcgattgatgaaaagtcaaggcacacgacggtgtgatggtacgaccggggattgcagaaatgattacgtgagtgttcgcaatgtgagcattatgtttcatatcaaccgcgacccgcctagtttcatgcgatgttacctacaccaaacaagggaagagaaacaccatggaaaaggttaaagcctttgcagattggctgaccaagtggtttacggtcatcgtcatcgtctgggccgtcttcaactacttcgtgccggccgccagcttgtggggcaaggcgtacaccggctacatgctgggcatcgtgctgttcggcatgggcctgaccctgacgctggacgacttcaagcgcatcctgacccagccgctgatggtcatcgtcggcaccgtagctcacttcatcatcatgccgctcatcgccgtggccctgtgcgcgatcttccacctgtccggcccgctggccgtgggcgtgattctcgtcggctgctgcccgtctggcacctcctccaacgtgatgagctacctgtcccgtggtgacgtggccctcgatgtctccatcggcatcctctccaccctgtgcgccccgttcatgattccgctgctgatgcagctgctcgcttctcagtacgtgtccgtgccgactcagtccctgttcctcaacgccgtcaaggtggtgctcttcccgatcgccctcggtgtgatctgccacatgatcttcggcaagaagatcgagaaggttacggtcgccctgcctatcgtttctcaggtggctattctgcttatcatcggcgtggtcgttgccgccaacggtccgaagctgttcgtggccagctccctggtggccatcccggtggtcatcctgcacaacctgtgcggctactcgctgggcttcggcttctccaagctgatgtacaagatctacccgaagggcttccgctacgcacagcagaaggccatcaccttcgaagtcggcatgcaggactccgctctgggcgcaaccctggccctgacctccttcgcaaccaacccactcgctgccgtgccgtccaccttcttctccgtgtggcacaacatctccggctctatcctgtccagctggtggcgcaaccacgatgacaagcacgagatccactgggattccgacaatggcgagaagggctctgccaagagcaccgtttcagcggcccacccgttcgacgccgataaggccgccaaggtcgctgcctgaaatcctgaaatggtgagaaaggtcgggtaaggcacgactccagtcagtcggtcatccacctttcctacctcgcataacatagccgctcccgcttactcccgattgaggtatcgggcgtttcgcgagggcggttttgctataattggtaatgcagaaagcggcaaggtaatacggcaaagaggccgggtcgctagaggttcccatcggatatggaagagcacgaggatgtgctggaaacagataacacagaagcggatgtggtgaaaagaaacataatgtaacctccttggcggtgcccccgtgtgacatagtctccgcgggggcacctgctgtgtggcgttccctttttgcgacgcattcccgggaatattgcgttgggagaatagttgggtgtgtgttttgcgacgcattggaatattgcgttgggaggagaggaaaagtacgggggcgcaggaggtccccaaaccagtgagttgtggctcggcgcgtcgttgtccggaggaatcgtaatatagatattcgtgtgtgccaacagcacgccttatgtaacaggcgagcatgctgggatatccttcaaaccgctgatcgcacgcagtaatgcgccgacgggaggggcgaaggccatcgggccggtggactgggctatcttttccgattcgtcgggtgccgccaacaggcggataccaagcgagtgtgctgaaaagtgtgggtgcagtgcggcggtcacacaaaagcaagagaaaccactgaatcggagaattcaagttgcctactattgaacagctcgtccgtaagggacgtcaggcaaagccgaagaagtccaagactttggccctgaagggcagcccgctgcgtcgcggcgtgtgcacccgtgtctacaccaccaccccgaagaagccgaactcggctctgcgtaaggtcgctcgtgtgcgcctgtcctcgggcatcgaagtcaccgcctacattccgggcgaaggccacaatctgcaggagcactccatcgtgctcgtgcgcggcggccgtgtgaaggatctcccgggtgtgcgttaccacatcgtgcgtggcgcgctcgatacccagggtgtcaaggaccgtaagcagggtcgttccctgtatggagcaaagaaggcgaagtaagagatatgtcacgtaagggaccttccaagaagcacgtcgtgctgcccgatccgatctacggttccaccgtggtggcgcagctcatcaacaagattctgcttgacggcaagaagtcgatcgccgaagacatcgtctactccgcgctcgatatggtcaaggagaagtccgaccaggagccggtggctgtgctcaagcgcgccctggacaacatccgtccgtccctcgaggttcgctcccgccgtgtcggtggcgccacctaccaggtgccggtcgaggtcaagccgaaccgcgccaacaccctgtcgctgcgctggctgaccgacttctcccgcgcccgtcgtgagaagaccatggctgagcgtctcgccaatgagatcctggatgcctccaacggcctcggtgcttctgtcaagcgccgcgaggatactcataagatggcagaggctaacaaggccttcgctcattaccgctggtaatcactcgccctgagtaaaactaaggaaaaagatggctgaagagatttcggacctccacgacgtccgcaatatcggcatcatggcccacattgatgccggcaagaccaccactaccgagcgtattctgttctacaccggtaagaactacaagatcggcgagacccacgacggcgcctccaccatggacttcatggcgcaggagcaggaacgtggtatcaccatccagtccgctgctaccacctgcttctggagccgtcagtcccacgacaccaaggacaagttccagatcaacatcatcgatacccctggccacgtggacttcacggccgaggtggagcgctccctgcgtgtgctcgatggtgccgttgccgtgttcgacggcaaggaaggcgtggagcctcagtccgagaccgtgtggcgtcaggctgacaagtacggcgttccgcgtatctgcttcatcaacaagatggacaagctgggcgcgaacttctactactccgtcgacaccatcaaggagaagctgggcgctactccgatcgtgatgcagttgccgatcggttccgagaacgacttcactggcgttgtcgacctggttgagatgcaggcttacgtgtggaacggcaccgaggagctcggcgccaagtacgacaccactgagatcccggacgacctcaaggacaaggctcaggagtaccacgagaagctcgtggaagccgctgccgaagccgacgacgacctcatgaacaagttcttcgaggacggcgacctgtccaaggaagacatccgcgctggcgtgcgtaagctcaccatcgccaaggaagccttcccgatcttctgcggttccgccttcaaggacaagggcgttcagccgatgctggacggcgttgtcgattacctgccgtctcctgaagacgtgccggccatcaagggctacaagcctggcgatgagtccgtcgagatcgaccgtcacccggtcaagtccgatccgttcgcggctctggtcttcaagatctccacccacccgttctacggcaagctcgtgttcgtgcgcgtctactccggctccgttgtgccgggcgactccgtgctcgactccacccgcgagaagaaggaacgtatcggcaagatcttccagatgcacgccgataaggaaaacccgatggaccgcgctgacgccggtaacatctacaccttcgtgggcctgaagaacgtgaccaccggtgacaccctgtgcgccatcgacgatccgatcaccctcgactccatgaccttcccggatcctgtgatccaggtggccgtcgaaccgaagaccaaggccgaccaggagaagatgggcatcgccctgtccaagctggccgaagaggatccgaccttccaggtcacgaccgacgaagagtccggccagaccctgatcgccggcatgggcgagctccagctcgacatcatcgtcgaccgtatgcgccgcgagttcaaggttgagtgcaaccagggcaagccgcaggtcgcctaccgcgagaccatccgcaaggccgtcatggaccagggctacacccacaagaagcagaccggtggttccggccagttcgcaaaggtcctgatgaacttcgagccgctcgacaccaccgagggcaagaccttcgagttcgagaataaggtcaccggcggccacatctccgccgaattcatcggccccatcgaggccggtgtcaaggaggccatggagtccggtgttctcgccggcttcccggtcgtgggcgtcaaggccaccgtcactgacggccagatgcacccggtcgattcctccgaaatggccttcaagctcgcaggttccatgtgcttcaaggaagctgccccgaaggccaagccggtcattctcgaaccgatcatgaaggtcgaagtccgtacgccggaagagtacatgggcgaagtcatcggcgatctgaaccagcgccgtggcaacatccagtccatgaccgacggtgtcggcgtcaaggtcatcgacgccaaggtcccgctgtccgagatgttcggctacatcggcgacctgcgttccaagacccagggtcgtgccatgttcaccatggagatggactcctacgacgaggtgccgaagagcgtctccgaggagatcatcaaggcccagcgcggcgagtgacacgcgccactgcatgaagtagccagtgtcttcagtcagcggtaatatcgtataccgctgactgggttctggctcttcaaagtggcacataacccagaaacccagtagaataagcgagttcctgtgcgaaagggtgcaggaaactcacgagacgtccaggaggacaaaagtaatggcaaaggaaaagtacgagcgtactaagccgcacgttaacatcggtaccatcggccacgtcgaccacggtaagactaccctgactgccgccatctccaaggtgctgcacgaggagttcccggatgtcaacccggagtacgacttcaaccagatcgattccgctccggaagaggccgcccgcggtatcaccatcaacatcgcccacatcgagtaccagaccgagaagcgtcactacgctcacgtcgactgcccgggccacgccgacttcgtgaagaacatgattaccggtgctgcccagatggatggcgctatcctcgttgtggccgccaccgacggcccgatggcccagactcgcgagcacgtgctgctcgcccgtcaggttggcgttccgaagatcctcgtcgccctgaacaagtgcgacatggtcgacgatgaagagctcatcgagctcgtcgaagaagaggtccgcgacctcctcgacgagaacggcttcgaccgtgactgcccggtcatccacacctccgcttacggtgctctgcacgacgacgctccggaccacgagaagtgggtccagtccgttaaggacctcatggacgctgtcgacgactacatcccgaccccggttcacgacctggacaagccgttcctgatgccgatcgaggacgtcttcaccatctccggccgtggtaccgttgtcaccggtcgtgtcgagcgtggccagctggccgtcaacaccccggtcgagatcgttggtatccgtccgacccagcagaccaccgtcacctccatcgagaccttccacaagaccatggacgcctgcgaggctggcgacaacaccggtctgcttctgcgtggtctcggccgtgacgatgtcgagcgtggccaggttgtggccaagccgggctccgtcaccccgcacaccaagttcgagggcgaagtctacgtgctgaccaaggacgaaggcggccgtcactcgccgttcttctccaactaccgtccgcagttctacttccgcaccaccgacgtcaccggcgtcatcgagctgccggaaggcgtcgagatggttcagccgggcgaccacgctaccttcaccgttgagctgattcagcccatcgctatggaggaaggcctgaccttcgctgtgcgtgaaggtggccacaccgtcggctccggtcgtgtgaccaagatcctcgcctgattttcatcagacaagaatcttcgcttgaactagcgttataggaaatccccttcgaggaaactcggaggggattttctataaccgcagcaggatatggatatgtaccacgacttccggcctggatgcgctagtgttgcttttcaatagataaacggactgctgcactgcgaggatatgacactgatggcaggccgggaaagaaggtcgatgatgactggtgcacaggccgctcactgtggttctgtatccgcaatttcgctgggactgcccgtttccacggcgattcccgaagccaaaggcacactgccgaaagccttgttcgtaggcaaagcgccgatttccggcaaactcaagcagcgattggtgaacgagatcgaatccatcaccatgctggcgttggcccggtcggccaacacggggcttgcggacggcaaactgatcccggaagtgctggtcatcggactgaagcttacggccaaagccaccggcataccgaacgaagtcatcgacctgatcgccggacagcgcaaatcgggcatcgtgttcgtgtgcgtacgcgacgtgccgttcgagggcagcacgcgtgaggaatgcgcgttcgccgtgcgccgcgccataccggggcgtgccgggcacacgccgatctatcaggtatatgccggcgactggcagccggcgggggaggcccagctggagctggccggctctactattgatgagctgtgggcatcgctgtgctcacagaccattttgggtacgccggaggtcgagaatctggatgcgcgcatcattcgccatactgaaattgctcggctcgaatccgaagtggacaagctcactcgtgaccatcagcgcgtcaagaacccggcccagcgcaacgagatctatgccaaactccacaaggccaaggcgcagctcgcaaaactgcgcgaggcatagtgatgtgaaagccattgggcttccgctggcgggagctggctcgcgaagcgagactgagggtggtccaggtccgtggcctagggctacgcccaagctaattgaaatattcgtgcatcatacagcgtacagttaaaccatgttccctctgctcgaaaccctggtcgccgtatacgaggtgggtcagttcacgctggccgccgatgagctgaaggtatcgcagtcgacggtgtcgtcgcgtatcgcccaattggagcagatggtcggcgcgccgctgttcgtgcgcaatgcgaaaagtgacgtgacgcccacacaggccgggcggatgctgtaccagactgccatcggcatcgacggattatggcgggatacgcgtgagcagatcgcccgcgtgcaggaggcgcgtgagccgctggccgtgtcgttctcgcacacgaccgcggcgattctgctgccgaaggcgttgccggtgatggctcgggacatggacggtttcgacttcgctgtacacgtgatgaactcggatgcgattctcgaacaggccagcatgaaggccgtgcagctcggcgtggtggaaaagccgatcgtgaacgattcggtggaccgcgtcaccctgtgcgaggaccggctggtgttggcgggggagcctgacggcgtgtggatggtgcgcgaacacggttccggcgtgcggtattacacggatctgtatttcaagaccgctcaggttgtgcctgcacgcacgatggaagtgtccagtaatgcggcgattgtggcggcgctgtccgccgggttcgggcagtcgttgatttcggaagccgccgtgccggcgggcgtgccggtgcagcgggagcttggcgatgagtttgtgcggcggttctatgcgctggtgccgagatccggtctgacgcacgatcagcgggagttggcggagacgattattgctgcgctgcgcgggtagtcagatagtcgactgaggggaggttgcgaacgttgtttctctccctccgtccgcctgcggcggccacctctctcatcagagggagatcaattaggtatcgacaaaatcgatgatatgtattggttgcaatgatttgaccgatgtaaacgcttgagcttcaatagacatcatgagagagttctgtacaaaatggtggaagcgcattgccaccgttgacatgctgttcattggtgttctgactctgctggcctcgctgttcgcctcctggctcaagcagttccccggattcagcctgttcggcgcgctcatcatcgcgctgctcatcggtatgatcatccagttcccgatccgcagtgcctacgtcggttccaatgatggccgcaaggcaggcgtcaaggacgccgctggcctgatttccaacaagctgctgcgcctcggcatcatcctgctcggtttcaagctcaacctcgccgtgctgttcacgcagggcatcaagtgtctgccgatcgccgctgtggtcgttacgctgaccatcatcgtgtgctatgccatcgcccgcaaactcggtgtcgacccgatgctcgccatcctgaccgccggtggcaccggcatctgcggtgcggccgccgtcatgggcctggccggttccatcaaggtgcctgaggacaagcaggacgagaaggacaacgacgtgaccatggccgtggccatcgtagccattatgggtactgtgttcgcgttgctggagatcgcgctcggcccgctgaccggcatgaccaaggaccagctgggcatcaccgccggtgcttccctgcacgaaatcgcccacgcggtcgcgggcggcgacgcgttcggcgcggtggacatcgccaccatcatgaagctttcccgcgtgctcatgcttgtgttcgcggccatcatcatcgccatctggtgggagaagaagcattccgaggttcagagcaccggcaagaagaccgtggccttcccgtggttcatgctcggcttcatcggcgcttcgattatcggcaccttcgtaccgttcgtcacctccatcaccccgcagctcgtggactttgcgtacatcgtgctcggcatggccatggccgcgctcggcatcaacgtgaacttcaaggccatcgcttccaagggcaagaagccgatgctcgccagcttcctgacatcgattctgctcatgtgcttcgctgcaggtgttgcgatgctgttcttctgataagcgctccaaatacaaataggcgaaggcgaacgacagtgagcaattggaatgtgtcacctaaaaatcacgtacttgcacaacggataaccccagccgaactggcaggccatcgcaatgaacttcaccacatatggactcagcccggtcgcacccggcatccagccgatcagcagcgtgctgaacgtgaagttccagatccacagcagcacgaacagcgccacggaacgggtgaagttgctggacgatttgaatgtcacgttgcggttcatcacgaagttgtaggtcgccgaacacaccacggcgatgccgttggcgatctgtgagggtacgccgatcaagtgcagaatggcgaacgtcgcatactccacaatggtctgcgtggcggaaacacccacatacttgcccagcacggcgagtccattttgcttcggggttgccgtgcccacggtattttccgcagtattcgttgtggtcgaggtatttgcggcgcccacaccttgattcggcttcacatccgctccattgttcgccatgcccatatacctcccggatgtacctgtgacgttcgacctcgcaatgataccgctgaccgcgtcgggaatcggcgtggcggtcagacgagaaaaccgcaggccgcagcaacgaccggcacacccagcgacagcaccagataggccgctgcggtggggtagcggtgtttgcggaagagcgtcaccatttcgttgattgcggtcgagaacgtggagaagccgccgaggaaaccggtggccagcactagccgccatggttcatcaagtgtcccgccgagtgccagcgccgcgaccaaaccggctaggaatccggcgatgagattgatggtgaacgtggaaagtgggaatgcgcgctgccagtacgttttgatggtcacgtcaagcagatagcggcaggaggcgcctacgccgccgcacaggcagaccaagattggtaggaatacggtcatcacgccttacctcccttgctggtcgtagcggcattcgtatcagcggacgcttcggcggatacgttcgaggagccggccagatgcgttcctgcccacacgccggcagacgcacaaaccagacccagcgcgaacgtcaccagtagataggcaatgccggccgccacctgaccgtcgcggattgcggtaaaaccttccagcgcgagtgtcgacatcgtagacaaaccaccgcatacgcccatgccgagtccgcgactggcaagttctttggaacgtgcgccgaaccgggaagcgccggccaagtaagcggtcaaccctgcatagcagaagcaagccagcatgttggccacaaacgtgccggtatggaagctgccagccgcgggaatctgtgcgaacgcatagcggatagcggtgccgatcgcaccgccgcagaagacgaccaacacaatatcaagatgaatatcggggagcttgcgcgccgggggagtggtcgtgtgcgtaatcggccgggcacctgcggatggggattgcgaatccataatagcctttcctgaaaccgctgaatcctgctgaagacacaacgatttcatgcaatatcaaatcgtgtgtaggaactatcagcagtgtgcggttcgaaacgagttcaggcgggttccatcgccggttccttagcctactcgtggcggcgacaacaaacggcagcagtatctcggatattggcctatcgcggtggatttcggcaagagacttctgcaatgccgatgaacttggttgccgtgaggcgataaagcacgtagatgaattgcttggttgcttccatacctcgtgggtatggctcaacatggtttatggctattggctaatacagatcgattgtcgtttaatggaacatgaggataacgggccctaatcgctcggtgccggaaacaaggagttgtgaatatgtctgaaaccatgaaagccgcgattttcgttgagcctggcaagatgaccgtggaagaagtgccaaaggcggcacttcagcaggatgatgacatcgtgattcgcatggtgcgcacctgtgtatgcggctctgatttgtggttcttccgtgggctgagcggacaggccgcacacagtcaggtgggccacgaagccattggcgtggtcgaggagactggcgcggcggtcgaatccgttaagccaggtgatttcgtggtcgtgccattcccgtacagctgcggcaagtgcccggtatgcaaggccggcttcgaatccgtgtgcccgcacgggggctacttctccgcttgtcaggccgaatacctgcgtgtgcccgaggcggacggcaccgtggtcaaggtgcccggttcaccggaagattattccgatgaacagctcgcatcgctgctgaccatttccgatgtgatgtccaccggttatcacgcggcggtttctgccgaggtcaagcccggtgacacagccgtggtcatgggcgatggtgcagtcggcctgtgcggtgtgattgccgccaagatgcgtggtgccacgcgcattattgccatgagccgtcacgaggatcgcgcggcgctcgcccgcgaattcggtgcgactgatatcgtgcccgagcgtggccaagaggctattgacaaggtgctggagatgaccggtggctatggtgcggacgcggtgctcgaatgcgtgggctccaagcagtccttcgacacggcgattggcctgattcgccgcggtggcgtgattggtcgtgtgggtctgccgcacgacgtggagatcagcgccgaaggcacgttctacggcaacatcggcatcaagggcggcccggctcccgtgcgccactacgatattgacggtggtctgctggatgcggtgcttaaaggcgagattaaccctggccgcgtgttcaccgccgaatatgacctcgaccatattcaggacgcttatgaggccatggaccagcgcaaagttattaaggcgttgatccggttctaatcgcgtggtgtgacggggtttaccgcagtggtatttaacgcccgtatgtatgcgtcccctttgtagggccgcatacatacggacgttgtgatgtgtctgacgcggtttacgctgaacgattgtggtgacgcaaaccggtcacctgttactcggcgagcagtgccttgtactgtgcagcggactgggcgagggcctcgtcggtgatgccgaaagcgccgcacgtggcgaacggcttgagtcaggtcgcgccgatgtataagccgtgccctcgatcggaataagcagctgctcgatggggtagtggccggggtgccggtctggtaggccgattccggcgaaccggtggacactgcgcatcgcgtcgggaaccgtggccaaggcgtacaccgaactcgccgactgcggcatcatcgacaccggtgccggccgcgcggcgcgtgtaaaacgggtcaagccgattcccgaaccgctggtgcgcgcggccaagacctatgccgacgaggcccgccggcttggcgcgagcctcgatgacgccttcaacgccctgtgcgcgcagtggtaaagcgcgcaccgatgcgaagcctacacggggtgcaccgtcagcgaaaagtcgccgatggtgctgacggtcgagggtgaggccagattgcagacatctcgcaagcagtacgtggcatacagcggaagataggttgttccgccgtcctgcgcaatattggagcgggacagcaccacgccctgcgagatgcgatattcggcattggccaatacggcgtcgatggcggcgtgcgtgcggtagctgcgccccgacttgacctcgaacggcatcacagaatcggcgttcgtgtcagcgatgaaatcgacttcaccatgtttctttgccatgtagtaatacagcggaatgccttgcgccgtcagctcctgagcaatcacgttctcgtagatggcacccagattcggtgaggaatcatcaaggtatgcggcttgcgcggtcggttgcgggtatcgtgccatgagcataccggtatcagactggtacagtttgaacttcggtgattgcgccgtgcgtttcaatggtgttttcggctcggtgacgcagttggttttcaatgccacacccgcatcgacaagccaaagaaaatccttctgattgcggtcgtaccgagcaccggggctgatggaggagacggcgaatctgccgttaccgtcaatcagctgagtggggagctggtcgaagatctcctgcacctgcaatgcgcgattgcctgcgtactgcgaaatatcgtggcgatattgccggttcaactcgttctgtaccgcgcgcacagccgccaaatcacccttggtgtccagaaaacgttgcacgacttccggcatgccgccgactaccagataggtgcggaagttcgtcatcattgcatcgtgaatgtaccggtcgattggcgtgaccgaccggcaggattctcggatgttttcaagtgtcgacttctgtacgccgatggcccaacagaattcctcaaaatccatgggacgcatggttttttcgatgaccgagccaacggggtaggagcgtacgcccttgaactcagtgccgagcatggaaccggagaacacataatcgaaacggccatcggccaccagaaacttgaccatggtcatcacatccggtgcctcttgcacctcgtcgatgaaaatcaacgtatcaccgggaatgagcgttgaaggtgagaacaaggtaaggcggctgatgaactcctgcacgtcgttcgccgatgcgagcgctcgggccgcctgcttgttctcgtacaggttgatttcaaggtaatgggcgtattcgtgcttggcgaactcgcgtaccgcgtagctcttgccgatctggcgagcgccggtcagcagcagtgctttgccggtaccgctccgcttccattccagcagatcgtccgagattttgcgctcaagcatggcagctcctttccgaatcccttatgagggtagcattttctgccttgtatgtgcaaaatgccgcatttcaaaatggggctttggtgcaaaatgccgcattttaaagtagggttttggtgcaaaatgccgtgtaaatggtgaattggacgtgcttgtaaggggagctggatgatcgtgcggctggatgaccttgtaactaaatgattgaacgattgcgcggccgtcgtttgcgtggccgcaaagttgtgtgggctgttcgcgaattatgcgcggtcggccgtcatgtgcctgcgcttggggtgctcgataagtagcgctcgcttcttggcgtcctcggcggtcgaagccggtacgccgtcggaggaggcgtcgatgatgcgctgcaggtagccgtatagggtgtgcagctcgtcgtcattcagacagtccagcatagaggggcctgatcaaaaccagttcacgaggtcctttttgctttaatccccgctgagagcgcgtagcgccggaggatgatcggatgccgcgacgccgaatcaagattcagccgctcgccgaccagcccgaccagcaaggaaccggattcgcgcatcggcggcatgcgcgctgctattcgcgctgaaacagcatggcatgggtgcgctgacaccgcgccggcgcaaaggccatcagtgaaactggggaatcggattgcaggtggcggacggtgcccaagacgaaagattctcgtccggcgttcagccgctgtcgttggccgtgatgatactggagaccatgaaactcaggcggcggcagccaagggcgaagtcgagaaagaggtgacggcgtgacacttgaacagaggtcagatagcgcggcggcaggccacgaggcatgtgaccagccgatcaggagcctggaaatcctcaaccaatgcgttccgctgttcgagacgctgaaggatccgaaccggcagcagttgctggtgcaattggtgtgccatgggccgcagacggtgggggagctggccgaatcgtcggcactgtcccgcacggccgtgtcccatcacatcaaactgctggaacaagccggattcatcgaaatcagcaaagacgccacccgccgcatttgctcggtgcgtgcggatcgatggctgccgctgctcgatgaactgtcttccgccctgaaagccgaccttgcggcggcggagcagtgccgagcatgagcgacgatcaacggccgcaggcgattgaggtgcgcggtgcgcgcgtgcataacctcaagaacatcgacatcgacattccgctgggcgaactggtgggcgtggccggcgtctccggttcgggcaaaagctctctggcgctcggcgtgctgtatgcggaaggttcgcggcgctacttggaagcgctgtccacgtacacgcgccgtcgactgactcaagccagccgcgcccaggtggacgaagtgctgcatgtgccggccgcgctggccctgcaccagcggcccactgtgcccggcatccgttcgacgttcggcacgatgaccgaattgctcaacagcctgcgactcctgttttcccgcgtcgcctcgcacgtgtgcccgcattgcggggcgcgcaatgaaccgacgctgaacgtggcggccggcctgcccatcacctgtgctggctgcggcaaggaattccacgcgcccggcgccgaattgctcgccttcaactcggccggcgcctgcccgacctgctccggcaccggcatcgtgcgcgaagtaaaccgcgcggccctggtcccggacgagtcgaaaagcatcgacgacggcgcggtgctgccatggggttcgctcatgtgggacctcatgaaacaggtgtgcggcgcgatgggcgtgcgcaccaacgtgccgttcaacgaactcacacccgaagaacgcgacatcgtattcaacgggccggccgtcaaaaagcatattctttacaagccgaagaaaggcgacgatttcgccgaactcgacttcacctacttcaacgccgtgtacacggtggagaacgcgctcgccaaagccaaggacgagaagggcctgaagcgtgtggtccggttcctcaaggaaggcccatgcgccgactgcggcggcacacgactgagcgtcgccgcccgggccccgcatgtgcgcgggctgaacttggccgaagccggcgcgatgaccttggacgcggcggcggattgggtgcgcggagtgccggaatccctgcccgccgacatgcggccgatggccgccaacatctgcgaatcgttcttggatgtggcccgacggctgctcgatctgggcctcggctatctggcgcttgaccgcgccggcgccacgctttcgaccggcgaacgccagcgtgtgcagctcgcccgggccgtgcgcaaccgcaccatcggcgtgctgtatgtgctcgacgagccatccatcggtcttcatccctcgaacgtggacgggctgctcggcgtgatgcacgacttggtggcggacggcaattccgtggtggtcgtggaccatgatgtgcgtgtactcaaagcgtgtgaccatcttatcgaaatggggccggttgccggtgccgaaggcgggcatgtgatcgcgcaaggcacggtcggcgaggtggcggcgaaccccagtagtcgcattgcgccgttcctatccgaccaggtgagtgcgcgtatacgtgagcgtgtggccgaatcgcaagtgttcagccttggccacatccgcatgacaaccagtcagctgcatacggtcaaaccgttggacgttgatatcccgcgcggccggctcgtggcggtgaccggcgtctccggctccggcaaaaccacgatggtactcgaatcgctgattcccgcactcaaagcgcaggcggcgggggagctgttgccggaacacgtgcgcgagcttgagaccgagggcatccgtcgtgcgaatctcatcgatgccacgccgatcggcgcgaacgtgcgttctaccgtggccacttatgccgatattcacgacgaattgcggcgcgcctttgcccgatgtgaggcggctaagacgggcggctggaaggccggcgatttctcatacaataccggccgactgcgttgccctacgtgcgacggcaccggttcgatctcgctcgacgtgcagttcctgccggatgtgaccatcgaatgcccggattgctgcggctcccggtacgcgcccgaagctgatgcgattcggcgtgcggttaagggagaatctcgcctttcgttgagtttgccccaactcatggcaatgagtgtggaccaggctctggccgtgaccagcgacctcaagaaggttcacgcacgtctgaccatcctgcacgatctgggtctcggctacctgacgctcggcgaaccgaccccggcgctttcgggcggcgaagcccagcggctgaaactcgccagcgaaatgggcaaggcccagttgaacgcggtattcgtgttcgacgagccgaccatcggcctccatccgctcgacgttcgcgtgctgctgggcgtgttcgaccggctcgtggtgagcggcgcgaccgtcgtggtcatcgaacatgacctcgacgtgatcgccaatgcggattggattatcgatatgggtccgggcggcggcgaaagcggcggacgcatcgtcgccaccggaacgccggaacaggtcgcggccaatccgaacagcatcaccgggcggtatctgcgctgacttgtatggcggtcacgcgcctttgcataggaccctgcgcgagtaggatagccgtccatggtgcagattcatggcattagacgcgcaagcgcggacgcgaaatatcggcagatgaccgggcagccggtcaaaccgctgatcctcaaactatgcctgccggccgtcatttccaatctggtgactactgcatacaacctgactgatacctttttcatcggccagctcggcaccgcgcagtccggtgctatcggcatcgcgttctccatcatgaccgtgatgcaggcgctcggcttcttcttcggcaacggcgcgggcaactcgatgagccgcgaactcggcaagcagaacaatgatcgcgcctcccgactactggccgtgggctttgcgggcgcggtgatctccggtctggtgattgccacaatcggactgctgaccctgcggccacttgtcgtcatgctgggctcgacctcgacgattgccccatacgccgtgcaatatctgacgccgttgctggtcgccgcaccctgcgtgtgcggttcgttcgcactcaacggattgttgagataccaaggtcaatcggcgttcggcatgattggtctggtgtccggcgcgctgttgaatttcctgcttgcgccattgttcattttcgtggccggtctggggattttcggtgccggcctcgccaccgccatctgccagacggtgagcttcacgattctgaccacgatgagccgcaaattcggcgtgatgaaactgtccctgcgcaattgcaggccggatgtgctgctcatgcgcgaagtggccggcggtggcctgccctcgctgatccgccaaggcgccggttcgatttccgtgacctgcgtgaacattgccgccaatccgttcggcgatgcggccatcgccggcatggccattgtgatgcgcattatgttgggcgccaactcggtgatcgtcggcctcggccaaggtttccaaccggtgtgcggctacaactacggtgccggcctgttcgcgcgcgtcaaagaagggtactggttctgcgtgcggctcgccacctgcgtgctcgtggtgttggcggtgttgctgtgggtgttcgcaccgcaactggtcgagatcttccgctccgacccggccgtggtggcggtgggcgtggccgcgctgcacatccaatgctgcacggtgattctcaacggcttcaacatgatgggcaatatgatgacccagaccatgggccgcaccggcatcgcctcattcctggccctgtgccgacaaggtctgtttttggcaccgatcgtactgattctgccgatgatgttcggcgtgctcggcgtggaaatggcgcaatcggtgtccgacgtgctgacattcctagtcactatcccgttcatgcggcgaatcctgcatgaattgcggtgaatggtagatggcaactatgaataatcgaagtgcaaagcgggtgccgggcgttccttctcccgcgtatatcgaatcgctgtaccgcaccatggctgccgcccttggcccgaccggatggtggccggctgaaaccacattcgagattatggtgggcgcggtgctgacgcagaatacggcgtggggcaatgtgaatcgttcgcttgcggcgttgaacgcggagggtgtgctcgaaccccataagctggcgattatggggccagcgcatctgcaggaacttattcgcccgtccggcttttatgtcaacaaatccaagacggtacagtcactgagccgatggtatgtggagcgttgcggagcctcgcctgagggcgcggcagatattcccgacgccgaattgcggaccgaattgctcggattattcggtatcgggggcgaaacggccgacgacctgatgctatatgtgttttcgcgccgcacattcgtggccgatacttatgctcgccgactattcgccttccttggatttgatgtgccaaccggctatctggcattccacaaggcctattcgcccgtggtgctggatgcgagcctcagcgtcaaggatttgcaggaattccatgggcttattgacgagttcggcaaggcctaccgcgacgacgcggccaaaagcgagtcctttttgggtggatggagggcttgactgcacggcgaatcgttctcaataagaaaagtgtgaggcccgcacggtgccaatcgcacatctgaatccaagaaatggctgtttgatgctattcccgcgaatgcgcgattgagtgatattgtgcgtttgcctcacacttttcttattgagaatgattcgctgcgatatgccgcttacttgacaaccttaaaaccgctggtccatggggtctgattggtgacgccttcagccgctgctgctgcggccttgtccgggttgcggtcgatgacctgcacggtggcgccagccttgacggtgatgcctgtgacgccggcaatccgctctccaccgagcagatcgacgacccctatcgccgtggcatcatcgccgtgcatgacgccgagattgccgccgaacttgactggctgcgctcgatgctgggtgtcgaaaacgagtctgtgacagaatagttcgaccgacacaatcgccaaaacgccgaacaggagccaatgatgaccgaagacaagccgatcgccaagccgattatcgatgatgcgacgcgcgagaaaatggcgcttatgttctctggcgaggtctacctgccggatgatgtggacggcttttttgatctgcagggcgcccagcgtgatctccagctcgaactcaacgccacgccgctgaccaacccgaagcgccgtaccgaactcatgcaggcgttcttcggcgcggcgggggagggtctgtacctcgaatgcccggtgtatgcgaactggggctgcaatacttattggggcgagcgctgttacgccaacttcaacctgacgctggtggacgatggtgagatcttcatcggatcccacaccatgatcggccccaacgtcacgcttgtagccaccggccatcccgtgcgtccggacctgcgctatcagggtgcccagtattcgttgccagtccacatcggcgagaacgtctggatcggcgcgaatgtcaccgtgctgcccggggcaccatcggggacaacgcggtcattggcgccaactcgctggtcaccaaggacatccccgccaacacggtcgcctatggcagcccgtgcaaggtaattcgcgaaatcaacgaacgcgacgacgtctactactggcgcgaccgccaattcagtgagcgttttaagctcaaagagcagtagcgcgaaagctcactcccacacgtcgagcttgcgatttttgtagaaatactcgcggtccttgtcgccgatttcacgcacgacctcgcagggcgcgccgtaggtgacggagttggcggggatggaatgtgtcacgaccgaaccggcgccaatcacgcaattgtcgccgatggtcactcccggcagaatcgacacgttcgcgccgacccacacgttgcgcccgctgatcaccggaatgcaatacgtgtaatggtgctcgcgcagcaccggcaacacggggtggccggcggcgcattagcacggggaacggttgaacgagaagtggattggcatgtggtggtatcgaacatactgatgcgtgtgccgccgagcctgtccagatggctgcctatatgaaccagtgacagaaaagcacgggaacgcgagcgagaggagtgtgcatggggcagttcggcgtcatgattggccagttagtcggatttctgatcatgctgatggtcgggtatggatgtgtgaggcttcgattctacggtcagacggcgttggacggcatgtgctcgttgctgctcaacgtgctcatccccgtgcttgtgttttcgaacgccgtcgatggtgcggaccgcgcgcagcttgccgctaactggggcgtgatgctgctgaccgccgtgatgtacgcgctgctcatcctggtgttctggctggtcgccaaactgttgcggctcaaaggttcgcgtagccatgtatttcaggcgtcgcttattttcggcaacgccggattcatcggcattccgttgattatggcactttggccgcagaacggcgcgatttacgtggcgctgatgtcgatcatcgaccaaacgctgctctggacgtacggcgtatggctgtgcgagccggtcgacgaaacgactggcggcaacgcgattggcgcgcgaggtgcggtcgtgaacggttcggtgaacggcgccggttcggtgggcaatgctggttcggcgagcaatgccgcaaacggtggttctccggccatcgtccgcccctcgccaggcacccgcgtcctcggcctgcttaaacgattcgtcaatcccgccttcgtcggcgtgatgctcgccctgattctgattctgctcggcgtcaaggtgccggacatcatcctgaagccgctgcacaccatcggcaatatggccacgccgatgtcgctaatctacttgggcggcctgttcgcgctgaccaagtggtggggcgtcctcaaacgctacgaactctatgctggcctagtcgccaagatgatcgcattcccgctcgccttctacgcgctactgaccgcgctgaccggcgcattgccgcaactgccgatcacccatgacatggtgctgatgatcacggtcatcgccggactgccgaccatgaccaccatcgccatgttcaccggtcgcaagaacaacatgcccgagtatgcggtcggcttcgtgctcgtaagcacgctgttctcgctggcctccctgacgattgtgtcggcagttgtgttctgaattgtccccttcgacgaaaagaatgccggggcctccggcgcttggaatttcatcgacgccgccaacgactccaatccgaggcggccgtgccgtatttcaaggagatattcgattacgcgcgcacgctcgatccgcagcatcgcccgctgacctacaccaatctgctgatggccgccggaggcaaagacaagtgccatcagttcgcggatgtcatctgcctgaaccggtattacggctggtatgtgcaagatgggtatcagctcatcggagccaagaaggccttcatcaacgagatgaaccaatggatgaacaccgaacccaacaagccgtttctgttcaccgaatacggtgcggacaccgatgccggtgtgcacaagctgccgagcatgcaatggagtgaagagtaccaatgcgagtacctcaccatgcaacacgaagtgttcgacatgttcgaggcagtggtgggcgagcaggtatggaacctctgcgacttccaaaccggtgaaggtatcatgcgcgtcgacggcaacaagaaggacgtcttcactcgcgaccgtcagcccaaagccgccgcctatgtactcaaggagcgttgggagactaagtagcggcccgcccctggaatattccaggagcaacacacatcgcataacacacaacgcaacatacaaaaaagaacctcgtgaaacgaatttcacgaggttctttctagttacgctgaatgactcccattagactcccacgagggaagagcaatgggaattccaacgtggctaagctctcaaactcagatgtggaatctgatttctatggtttgaggcaattattgatataatgcagaaaatggcttgataatgccaattatgtggtgtatcgaaggtgggtatagacggctttagatttctttagattgccattgttggctacccttttggctaccctatggaatatcctggtcgtatggcacgaagaacacacggaagcggcagcgtttacccggaacgcaccggagggtttcgggcgacgtgcgagttgcctccggatccggcgacggggaagcggcggcgtctggtggcgcgtggacgcaccaaggccatagcgttgaaacgtttgaaggacaagaagctggagtatgagcgctccggtcgtatgccgagccagacgactccatatttgaaagattggctggataggtggttggatgagattgtcaaacctcgtctgcgtccttcgacgttggcgacatacagaagcaccgtcgaggcgttgatcaagcccgcgatagggggcgttcggttgggcaggctggagccgaagcattttcggttgatggaagagtacatcaccaaaggcgatgacacatgcgatccgccgaggaagccgcgaagcagcgcaacggcgggcagtgcatggcggacgttgcacaaggcgctcgacgatgccgtgaaggaggggatcattgagtcgaacccgagcgaccgtgccgaagctccgcgggttgtttatacggagcgtaagattttgacgccggtgcaggcggggcaactcattaatgccgagaacgatgtcatgtggcatctgatgtggcggctcgcctatgagacgggcatgaggcagggggagcgtcttggtttgacgaactccgagatccagctgatcgacaacgcggtatgcatcgtggtcgaatggcagctgaaggtctacaacaacgtgaagggcgtgcgggacattcccagttcactcggcgctcgacatgtgacgggcaaggcttatctggtgcctcccaagacgaatgccggaagacgtgtgatcccattgcccgaatcgctagcggttgagttggggcggtacatcaaaggtaccgggcgaacaaattcggacgatctggttttcgttcaggcggatggaacgccgctgaaccgtatgattgagacccgggcgtggaagaaggcgctgaatcgagtcggactgccggatgattatgtgccgcattccgcccggcacacggcggcgacggcgatggcccagttgggcatgagcgacaaggtgcgtgaatccatcatgggacatagcgatataagcgtcaccaaccgcgtgtacacacatgtcggtacggccgacgcatccaaagccatcaacggagtcgaaacgctgctggcgttggaacccgcgaatccgcgggttctagatagaagtgcaacacctgcctagggttggaagtgtctaggttccagctggaggtgttgcactcgtgggtacatgttattcgcacctgtccccggacgagcggatcaggatcgagaggctgcattgcgagcagggtctgagcgtcagggaaacggccaggctggtcggccgggacaaggccaccgtcagccgcgagctgaaacggggactgtggttcgcgtccaacgagaacgaatcgtaccgcccgtaccggccgcggcggctgaagaccggcccgtggacgtccatgccgttctgctccgccctcgcggcgcagcggagggccgacctgaggcgccacgggtcccgcaaaccgcggcgcatggactcggaccggctgcgctcgtgggtgatggacgcgctgcgccgtggatggagccccgggctgatcgagggcaggccgaagctggagtaccccggcgaccccgtgatgcgggtcagccacgaatgcctccaccaatggatccacgccaaaccccagcgcgacctggacctgcgccaatacctgccgcggggcaggaagcgccgcgccagacggaagggacgcaaggtcaggggccgcgcatccccatgcgcgtggacatcggccaacggcccagggctgtggactcgcgcgggcagttcggccaccgggagtccgacaccgtgataggcgcggcccctcgcgcgtgtgcatcgacacgcaggtcgaacgcaaaagccgcagaccgttcgcccgcctgatccccgacaagagcgccatggccaccgcgcgcgccgaatacgagatctacagggacctgccgccccgggcgcgcatcgaccggacctgggacaacggcagcgaggcctcctgccaccagctggtcgacgaggccctgggcatgcccgcctacttcgccgacccctactccagctggcagcgcggaagcaacgagaacaggaacggcaggatccgccgctacctgcccaagaaaaccccgttcgacgacctgacccaggccgagctcgacgacatcgtcaaggagaccgacgacacccccatgaaacagctcgaatacaaaacacccaacgaggcatgggacgaggagataacccgactacaatcgcaaaacaccaacccaagcacaagcgttgcacttacaagttgaatccgggtttgacgaaccgtgttttcatgtaggataattccatgggaggtggcatcggcgatggggttggtggataaggtgagacggctgttggggcgtgattgggagatcgccaacacgcggcttatggaggaacaatattcggcgtgcgacacgctgcttgccgcgacgacgacggattatgcggatggggcccgcgcccttgcccgcaagtacggacaggatgggcacgggtatatggaagcgcatggcgtcatcctccgttccgatcccgatgacgaggggaacgcgggcaccgtcctcgtcgagggaaaccgcatcggtcggattccccgctatgtggccaggcagcttgaattcgggccttccggcgaggagcccgtcgtcatacgcatgttcaccgaacggacggccaggggattgcgctgcgaggcgtggtactggttcggccgttccgaaccacgctggttctattctcgggaccatcgccctcccatgacgcccgaagccaaagccgaggccgcgcaacgggacacggagcgtatggtggaggaagctctcgaagaaggcgggccacgcgcagattccttccggctgggcatggttgatgggacgcattacctggagacggtcgagccgatcaaacagctcaaacgcgaagaccgcctcgaagaggcgcttgacttgtgcatgacagccatccaaggagccgagaacgaggcgcgggccgaaggacatcaacccgctccctggtatacggaacaggccgccatcatcctccgcaaactcaaacgccccgatgaggagaaagccatcatccagcgctggattgacgcctgcccagaaggatacatcaaagccaatcccgacgaaacgcttgtcgtccgcctccgccgcatacgggaaaaggaaaacgccaaaagatcctaatgccgagaagacgcgcctgtcatatgcgtgccgtgctgccggcgtcgtgcatatgacagactcccgcggatcacgcaaccattctcacgcccggctttagctggcgttcagtgctagcgaatcgtccgattggaataccgcttctctactcgacatcgcaagctataagaacggacttgccatgcagcggttcaggtctgtagaagatgatcccggcctccccgtactaaagattcgtgagcttagccagggctattgcggcagtgacgccgagcgatgccgcagcgacattgacgagtcggtcaccatccatgatggagacctcgtgttctcctggtctggaactcttcttctcgacttctggtctggaggcaatgctgggttgaaccagcacctctttaaggttacatccgatgcttatccaagctggttctattacatgtggaccaagaaacacatgcgccgcttcatcatgctggcgaaggaccgcgcaaccaccatgggccatatcaagcgcagtgcattgcaggaatccaaggtgctcatacccccagcagacgtgatggctgaactatccgcaaaaatgcagcccatagtggacgaaataatcggcttgaaggttcaatctcgtaagctaggcgagcttagggatgcgttgcttccgaagcttatgtcaggtgaaattgacatctcacaagtcgagttacctacaaagtcaaatgagattggttaattggcatgaacattgcaaaactttacaagaaaggttcacacatggatatcaggaccctaatgaagaggcaatacaacgtcgagcttcggatagaaagagatggcgaaagccatattgagcatggcgtagtgggtgatggaattatctctatgccagttgatgctgatatccaggagcgtgacaagatatttcgtcaaaacagttgcgggacgaatcaaaagtgattaccgttactcgccgtatgtctataactctttcgtgttcccctcgaacaatctagagagtattaaagaagccgcattagcggttgttaaatctcgtgcgatatacaccggcaaaaaccttgccgatatgtatgcaataaagaacagattcttttacccggaacttatgcaagctcaccgagaacttgacgaacaagtgatggcgggatacgggctacgtagcgacagcaatgaaggacagattgtcgatatgttgttcgacttgtatttgcgggtgactggcaaacgcggttattagccggtatggtcaccgatatgttagggcggcaggagtgactgttgttgttcctgccgcctttcttatgtggctctcagttgtcgttcatgccgaattcaattgtccgaagcacgcccttccagtaggattcccggtcaagcactgtatcacgggacgccttcttgtcgaatatttccagaatcgaatatgagaagtttcggatgatgtgctctgccccgtactggttcttcaactcgatcatctccttgttgccgccggtcgggtcggagaggttcgcgtaggatgaccatcgtgtccataggccatcggcgtcactggatgcgctccccacgtatagccgtcctgtgctccggtctgtaatcacatataccgcctttacgctggatagagcgtcatgccattccggttcgttgtggttgatgatgtcctgtaactcgccgtgcgtgagacacacgtgatcgtatccgttgaatgctccgagcttcgtccgtggcgagatctcatacacttcaggatccagttgcgcctgtatattcgcgtatttgcgtagatacaaatcacgcccaatgggtttgttgagacgaattacaagtcttttccgatattcggaatactcatccattagagttagctcatatccatatatgttccattgtcccggggctgcatctcgtacatggtatagaccgccaaagatgaagtactctggcccatatcgatagtattgggcgaacgcgaacaagtacttcctgcctcccatattgccgtttggttgcttggttttccaggcgttcatgatcagccaatccgggtcgtcatgtagcaatagattccatgctggtcgtgaccggtcgttcgggttcatgttgaacttaatctttgcctgatctggtttgtcgaagtggaacagatcagtgagttttattggcatttgctctgtcattttcatctcctaaggtaacgtttgaacttttcgtttgttgcagagtgcgctaccgcgccagttataaaagaaaacgtgagtctctctacctgagtatttcgtaaatgaatccgtcgtgtagcttgacggcgatcttgtcgtagcgggagtcatcggggtgctcttccatcgcatcgtgggcggcgcacagtcgttggatgtcgccaccgatcaggttccgtttgctgaagaggtcactggcgtgcttatgcattgccttggcgacgctgttcttgctgtctccttggtggattgcccatgcggcgactaccgccagttcatggtcgagggctttcttgagttccgatatcagcagcacttgggcgacgtgatggcatagtccgttgtcgtactccggagacaggggcatcactatgcggccgttctctcgttgtattggcatgacagccgtctctgcttccagctgtttggctaaatcagtggacgcttcatcgacttggtcgagaagatcgagaaccatgttgtgcatgagtttgctgtaataggcgctgttctcgatttccttgagaactcgcatgttatctcgcgtgtgtttctgcggtgattccagccgtgccataggagtcccttctccagaacaattctatatgaatatggtacccagaaaaactttggggaattagctgattgacgaaaggatggacatcgtcaagggagcgcacagagcgatcccgaaaaccagaaaggcggcggtcatatgccacgcaggaaaagctatacaactgtcgaaggatttcagagccttgatcagcatctcattgcccagcagatgattcccctgagggttgatgcgaagcagggcgattgggatgccgagaccaaaaccaatgcgcagaagaccaatgcggacggcgtaccccagtggctgatccagaccttgttccagccaatcgacggtgatgcagagcatgtgcccgaggtcgtgcccgttaccgtgacggccaaggtgaaacccgtcatccgtgtgggggctccggtggaatttgttggattcggcgcatgggtttacgtctcccacgacaagactacgaagcaggtcacgtcggtgaggcgcagcttcatggccgccgggttcaaacagaacggtggtgaatgatgatggggcgtaagaccagtatcacggtccgtatccccattgacctgctggaccggttggacgcgtacggggaatccgaattcggtcgtcgttttgatcggagcatgttcgtcgtggaagcggtaatggatcggctgaataatatcacggaaggaatccatcatgggtgacgtgttgttctggccggcgctgactttgattgtctgcgtcgcggccgtggtctttatcttggtcgtgcggttgcggaaactgcgccatacgattgagcatcacatgcctgaagcggtcgtgcgccgcgatggttggggctgtcgcgcgattgccctacccggccgtcggatctggctggtgccgaccgacatcgccgagcagcaggcgatggacgcgttgaaggagacggcgaaggcgtaccccggctggatcccctcgcatcggatgatgggacgtggtacgcgggcatactggttgctgtccgtccgccgtccggtgcggaagataatccgtcgcgaagatataccggcggagaaggatccggcccattacgtctgtatcggtctcaacttatctcgcaagccggtcatgatccgtagcgacgcgcacacactggtcatcggcttgacaggcagtggcaagggcagcatcatggcgacttacgtcgacggactttcgcagctgtatgaagacggcctcgtccagttctggggcatcgacctcaaaggcggcgtcgaaatgtcggtgtacggcactctctttgattcccaccacgcctatacgctcgacgacgccgtcgctctcctgcaagatctgtctaccgaatgcgaccacagaatggacagtctgcgtgggcgcgcgcgggagctgccgccgacgcccgagtatccacgaatcgtcctgctgatcgatgaagccgccgagctacacggcaaggcagataggaagaagagcgaattggtcacgcgcttgctggactcgatcctcagacgtgggcgtgcgctcggcatcgtcgtcgtggcgctcagtcaggatccacgtgtcgaatccgtcccgctgcgggcacggttcccgcagcgcatcgccctccggttgaacagcgaggaggaaaccgccatgttgctcggcaaggaggcgatagataggggagcggcaccttggctgatcgctcccaaccagcagggatccggattcgtctggaaccaaaacatgggaacaatcgactatttcagggcgccgtggtatggcgacgacgacctgatggaactgggcgcgtaggcgctgtgagaaccccgccgtcggagcgatgctcgcgcaggcggcggggttctctatacccaaaattcggtcattgaagcccggctgctcttgattattagatccaaatctcaccgaataccctgaaaggaggtgcattatgccccggataaccgtccgccgacacggcgcaagcgcatccattccacacgtcggggtgcataatggcacactccaatcagaccccacaaggacggcgaacaggggatggactcccgccgtcgcccggcggaatgcgcaattcctccagcgggtggatttcggcatgatggaaggcataccgtatgcgctgacgttgacgttgccggccaaaagcatggaacgtgtgacgcccgacttactgcaccgcctcatcgacgtcatgctcaaataccttgccagaaggggaatgaagcacttccactgggtcattgagttcaccgccaagcacatgccccacgtgcatatgaccgtctggatgtccgatacgcaccagcggtggaatccgaaaacccatcagcacgaaaccgtggacaacgaccttgttacggttaccggcatcgttgtcggcaagtggctggatgtgacagccgactgtgggatacatacctccggacaatcgcaggacgtgcaactgttggacggcaacgctgcatggctttcatatgtcgccaagcacactcaacgcggagtctggcactatcagagggcgttggagaacatgccttccacgtggaaggagaacccgggcgcgatgtggggacactcccggaaaattcctctgaccgaggactccgttcttcccgccgatctgcatgcctttcatcaattccgtcgtgaaacccggaaatggtgttgttcgcaggcctcacggatagctgacccgaaacgtcgggcaaaggccatccagcaagcgcggcgcatgaaccgatgcccgatacgggaactgtccgttgtgcgtccgatctcgatatggattccgcgaacggtgtcagcggcgatcattagaggattgcggtcgcgcggatacatgatcggtcgtgacgtttacgaatgggtgatatcagaaatggatcgattgcgtgcgaccggtgacgatcctgaccggatgcgggcgctccaacggacatttgcggaaatgatgcgggggtgaacatcatggcgatcgtcatccccgaaatcccactcaaggacaagctcacgctcacggtgccggaggcgtcggccctttccggcatcccatacaagatcgtcaacgccgccgtcaagaacggcaacctcgccgcatgctacgccggcagctccaccgtccggatccgacgttccgacctcgacgactgggtggcggccttgccatccgactggtgttgaaacacaagaagaccccggagaaatccggggtctctttgtatgccaattggctaccgtttggctacccttagaatcaagaatggctcaattccatggaaaattagccatacgggtcagatgtggaagtagagctcgtactcgagcggggtcggggccaggcgagcctggtcgatctcgtcgcgcttgaggccaatccaggtctcgatcaggtcgtcggtgaacacgtcgccggcggtgaggaagtcgtggtcctcttccagggcgtccatagcctcagccagggagctcggcacctgcttgatgccggcgtgctcttccggcggcagctcgtagaggtccttgtcgaccggctccggaggctcgatgtggttcaggatgccgtccaggccagccatcagctgagcggagaaggccaggaacgggttgcaggacggatccggagcacggaactcgatgcgcttggcagccggggaggtgccggccagcggaatacggatggcggcagaacggttacgagcggagtacaccaggttgaccggagcctcgaagcccggaaccagacggtggtaggagttcagggacgggttggtgaaggccagcacggaggaggagtgcttgatcagaccgccgatgtaccagcgagccagatcggacaggccagcgtagcccttctcgtcgtagaacagcggcttgccgtccttccacagggactggtggcagtgcataccagtgccgttgtcgccagcgatcggcttcggcatgaaggtcgcagccttgccggccagagcggcggtctcgtggacgacgtacttgtacttcatcaggtcatcgcctgcgtgctgcagggtgttgaagcggtagttgatctcctgctgaccagcgccggccacctcgtggtgggaacgctcgagaatcaggccgaccttctgcaggttggcgaccatatcgtcgcgcaggtcctgagtgtggtcaatcggcggaaccgggaagtagcccttcttgacgcggttcttgaaaccgatgttcggggtgccgtcttcctcaacgtcaacaccggagttccacggagcttcgatggagtcgacctcgtagaaggagcggttcatgccgttctcgaagcggaccttgtcgaagatgaagaactcggcctcaggagcgaaggaggcggtgtcggcgataccggtggacttcaggtaggcctcggccttgccagcaacctgacgcgggtcgcgggagtacggctcgtcggtcagcgggtcgacgatggagaaggccacgtcaagggtcttgtgcttgcggaacgggtcaatgaaagcggtctcaacgtccgggaccagcttcatgtcggactcgttgatggcttggaagccctgaacggaggaaccatcgaacggcatgccgtcggtgaaagcgtccttcaggaattcgctagccggcacggtgaagtgctgctgaacgccgataagatcggtgaaacggacggagacatactcgatgccttccttgttgataagggcctcggcgtcttccttggacttgagttcggtcacgggaccgctcctttcgtatgaaatataacggtatctatcgtaaaatcgagcgtttcgccggctcgaaacttgggttacgagaatgtttcgtgactgtggccgacaatcgcgcaggcgcgttatttcaacgaaacatcattacagaatggaaacggaggctatcgggggagtgggtagaggtgtccgcaacgtggacagtggatattgacaggtgacgtaggtggatgtatgtggacgcgattatgagacatatgacgaagccccggaaccgattgaacggattccggggcttctgtgcgatttggtggtgtgctgccgatcagcgaccgcgcatcgcgcggcgggagatcttctgcgggtggttcgggtccatgcccttggggatggcataacccttcttggcctgcagcgtgcgcagacgatcgttcagcgtttccatctcggccttggtcagcaggaagcgacgacgcggatgaatcttggcgatcagtgcgttcttgtggttcgtgggctcatagctcttggacttggtcaccgtgctacgcagcttgtccagtggcacctgcttggggccgtggcccacggagatgcggtacaccggaatggaggagccggcggtgacgcccttgatatcgtgttcctgacgatccatcgccttcatgatgcgaccgtattcgccttcgccgatcaggtagatgccgttcatcgaagtgccgcgccagatggcatccttggtcttcgggtcgatccacaccggttcctgcgggaagttaaagccggctttctgcatgttgctcagcacgccgatggcggcaccaggcttgccgtcaatctgcttgtagccgactgcatccgcgcggcgggtgagcatcatggtggccagtagcatgccgagcatgatggcggtgatcatggtgaagatccaggtcagccaggtccacttggcaatcagaccgatgatgatcatcacgactacaggcagcaggaaagcaccggcctcaagccacggcagggccttgtcttccttagccgtgtacttgtagatctggatgatctgcttgattgtgctctgcttcttcggcttcgcgtccttttccgccatcacttcttcctttgttgggacgaaacacactagacaacatcttatcaggtgcgctggtccgaacttgtttgtgctggttggtctcagcgtgtgtgtaacggccgtccgtcggccttgagcagcgcctcgccgagcgtttcactgaacgtgggatgcgggtgaacgaggcgggctgcgtcggcgagcggcacatggttgccgaccagctgttcggcttcggcgatgatgtcggaggccatctgggagaccatgtgcacgccgagcacgcgcggggtgtccgggttggccgcgtcgcagccggagacgatggtcagtgaaccggccgtgccgctcatcagcatgcgcgcgttcgccagcatcggatagttggtctccttgatttcaatgagatcctctctcgcctgcgcctgttcgacggtgagcccgaccgacgccgcttcggggaaggagaacacgatttgcggcacggtggcttcgtccaccggcttgggattgagtccggcgatggtctccgcgatgacgatgccttgctcaaaagcacgatgcgccagcgcgtgaccggccgtcacatcgcccaccgcccatacgcccggtttgtcggtgcggccgtacgcatccgtggcgacatgtccgtggtcgtcaatcgtcacgccccatgctgggtcggtgatcgggtcacgcccgatggcgacaagggcgatttcgccccagacgctttgttcgccgtcctggccttcgcacgtgtagtgcacggtggcaccaaggttcgcgccggtgtccacatgggtgacgctggcgcgggtgatgatgttcacgccatgacgtttgagctcacgggtcagcgtggtgccggctctccggtcccaggctgagagcacacggtccttgcgaatcagcaaggtcaccttcgaaccggcggcgttccacatcgaggcgaattcaagggcgatggccccggcgccgataatcaccgccgacgagggaaattcgttgacttccagcgcctgtgtggagtcgatgagggcgccggcgaacgggttgccgggcaatgggcgtggcttggcaccggtggcgatgacgatgttcgtggccgtgaggtccatcgtggggccgctgggctcggggacatcggccttgtgataggtgaggatgtcgctttggtcgggggaagggacgaggtggacgatgtggttggaagttgctggagcggtctcatccgcatggaacgcggcattggctcggaacacggtgatgccgcgatgggcaagcagtccggccagtcctcccaccatcgtcttgaccacgcgcaggcgatagtcgcgcagcgtgccgaagtcgatgccattcaccgaggcgttgacgccgagctcggccgcacggtgcacggtgtcgatggtgtgggtggcggtgatgagcgccttggaggggatgcagccacggttgagacatgtgccgcctacggtggcgtcacgctcgacgagtgccactttcatgccgagttcggcggcgcgcaaggccgtggaatagccgccggggccggccccgatgatgaccagatcaaactgttcgctcatgattgcctccttgatacatataagtatggctcccacgctagggagccatatgcggctatcgccgccacttcgcctaaaaacagtccactggactgttttctttacggctcagcccctcaacgaggggagccagagtatatatggacaatcagtccgccggccagtgaccgcgcttcgggtaacgcggcttgggaagcctccaacgacgcatctgaatcgaacggctccaagcgtaggagaaggagcgggagcccttggacacggaccgttcgccgtacttggcgatgagcttggccttgagcttgcgccacatcagccatacgtcgatgatcacggcaatcaggtaaccgtacataagcgccatcatgatgatggaagcccactggttctgcatcaaagaagtgacgaacatggaaacgatcagaatcgcgaaggccaccgggatgaaccattcaccaaggttgaaacgggcatccacataatcacggatgtagatacgccaaggcaagcgttccgccttgggcatgtggttgatatcgccattctgcatcgcctcgtactcggcgttctccttctcacgcagacgggctttggcggccttggcgctggccctgcggtccaccggaaccagcggacggataccggcggcctgagcctgcttcatcttcggggtaggacggccttttttctcagaaggattggcggccttcttcggggcctgctcaacaggagcctggacctcttcttttttcttaaacggattccatgtcatgctttgaggttacggtgacgttcagacacttgtacactggcgcagccattgcaatgacgccgctcacacatatatataaaggaggaccatcatgacaacgctcaccgctgacgagattcgttcgcgcgtcgaaaccgattggaaccgcatcgtcaaggtactggccgaaaaggtcgcgctgcagtcgatctccgccaagggcatcaccgccgaacaaatgaagcgctccgctgaattcgtggcagacgaactgcgcctcgtgggtgtggataccaaggtggttcaggcttccaatgccgacggcactccgggcgcatgggaggtcatcggctcgcatatcgtttctccggacgccctcaccgtgctgctctacgcccatcacgacgtgcagcctgttccggacccggccgagtggaacaccgacccgttcgtggccaccgaaattgacggccgcctctacggccgtggctccgccgatgacggcggcggtatcgccatccattccggtgcactgaaggccctgggcgacgacctcaacgtcaatatcaaagtgttcatcgaaggcgaagaggagatgggctcgccaagcttcattcccttcatcgaggctcaccgcgacgaattcgccgctgacgtgattatcgtggccgattccggcaactggtcggcggacattccttctttgaccacctcgctgcgcggcaacacctgtgtggacgtgaccgtgcagggccttgagcatccggtgcactccggccagtacggcggcccgattctcgactccaatacgttggccgccatgctcatcgcttccatgtatgacgagaacggcgatctggccgtacccggcgtggccgcggaagagccgatcggcggtttgcagcacgaccttgacgaaaccaccgtgcgcaaggattctggcgtggtggccggttacgagttcgccggcaccggttcactggcctcacgcctgtggaccaagccgtccgtgaccgtgatcggcttcgacgcccacccggtcgagggatccttcaacgtgatcgctccggagacccgcttccgtctgtcgctgcgcaccgcgcccacccagcgccctgaagaagcgcaggaagcactggctgcattcctcgaatcccacgcgccgttcggcgccaaggtcactgtcgaacgcggcgaaaacggcatgggctgggccatggacccgaccgccgtggccaccaaggacgcgctggaagccatgaccgaggccttcggcgttgagcccatcaacaagggcgaaggcggctccattccgttcatccccgaactgcagcgcattttccccaacgctcaggtgctggtcaccggtcccgaagacccgaaggccaacgcccacagccccaatgagtccatctccctgcccggcctcaagaacaacgtgatcaccgaggctttgctgctggacaagctcggcaagtagccgaaccgcatcggtaatggtagtgagccgccgtcaggtaggtcacagatgtggctattgcctttgacggcggcttgctttatagtcgggagttgacacgggagctgccgttgggcggctgagaggagactcatagtctcgaccgatggaacgtgaccggataatgccggcgcacggaaatgtcgctcttacctacccgtgcctgaaccaacccgcgcgtggccacgaacatatgcatcatgtgcgtacatatatccacgtatgttcggcctgcgtgcgagcagaagaaaggcacattcatgactgaagctgtggccaaagccaattacaagtggcgcgtcgtcgatatcgtcgtcgccgcaatcatcgccgtcgcatccggcgtcattttctggggctgggacattgtctgctccgccccgctggccctgtttgaaggcgtgacccccggtttcgagggtctgctcaacggattctggctgttcgccggcccgctcgctgcaatcattgtgcgcaagcccggtgccgcactgtttgccgaaaccctcgccgccttccttgagcttacgctgggcaaccagtggggcgtcggcggctcgctgatcgtcggcatcatccagggtctgggtgccgaaattgccttcgccgtcttcgcttggaagaagtggaacatcggcaccaccatcctgtccggtgcgctcgccggcgtgggctgctgggcctactactgggccaccaacccgggctggaacggcctgcgcgtcacttggtatctggtgggctccatcatctccggcgtcgtgatcgccggcgtggtggtctggtacttgtctcgtgcgctcgccgtcaccggggctctggagcgttttgaatccggccgcagcaaggcgcgcgtctgatgcagattaatccggctgcggtagaggccagcggctggggatggcggcacgccacgcgtaaggacttcgcgttgcgtgccgtcgatttcaccatccggccaggtgaacgtgtgttgctgctcggtgcttcgggcgcgggcaaaagcacgatgatggccggtctcgcaggcgtacttggcggcgatgaggaaggcgagcaggagggctcgctcaccatcgatggcgtcgatgcgcgcgaggcgcgaggtcgcgtgggactggtgcttcaggacccggactcgcagatcattcttgaacgactgggcgatgacgcggccttcggctgcgaaaacctcaacgtgccgcgcgaggagatttggcagcgagtgcgcgaatcattggatatggtgggactcggcggactcgaactggatcggtccacccgccatctgtccggcggtcagcgtcaacgtctcgcgttggccggcgtgctggctatgaagcccggtctgctgttgttggacgaaccgaccgccaacctcgatcccgaaggcgtggtcgaagtgcatgacgcggtcaaaaaggtcatcgaggccaccggacagaccatggttgtggtcgaacatcatatcgatgtatggctcgatctggtcgatcgcgtgattgtgctcggccgacccgatgcaagttcgcccacgggtgcggtcattgccgacggcaagccggacgaggtgttcgccgagatgggcgacgtgttggccgccggtggcgcgtgggtgccgggccgtgcgattcccgattactcaccgaagcaggagtctgcgcacgatgcgccggtgctcagcaccgagaacttaagctttggccgtggggccgctcttggcgttggtatcaatctggatttttatcccggcgaagtaacggctctgatgggtccgaacggcgcgggcaaatcgaccttggccttgaccttggccgggctactcaagcctatcgccggcaaggtgctcatcgccgacaacctcaagcccgcgcatgccgggcgtgagccgatcgactggaaaagcaaggaactgctgggccgtatcggcatggtgttccaggagcccgaacaccagttcgctgccaactttgtgcgtgacgaggtatccatcggccccaagtcgatggggcagagccaagacgaggcttatcagaccgccgaccgcatgcttgagcagatgaatctcacgcgcttcgccaaagccaacccgtacaccttgtctggcggggagaagcggcgactgtccgtggcctccatgctggccgccgcacccaaagtgttggtgatggacgagccgacattcggacaggatttcagtacgtggaatgaaatggtcaagctgatcgccgccatccgcgaccaaggctcgtgcgtgatcatggtgacgcacgatgaggcgctggtggatgcgctgggcgcacgacgcgtgatgttcgaggaggcgaaggcatgagtgacgtggtaaccgtcagcccgcaggaaacgcgcgtggagccggtcaaagcctcatcgccctcatggttcatcgcgcgcatcaacgcggtcagtcgcatcatcggtgcgttgctgctgtgcattccgatgttcatcagtctggatgtggtatccgcatccacggcgctcggcatcgaattcgtgctgctgtggattggtggcgtggctccgtggaccgtatgccgtaagacctggccggtatggatcgccgccgccggcagttttatctccgtgttcctctacggccgcacctcgggcgagatcctgtggcagggtggctggattgtgatcagcgaggggtccatcaatctggccatcgccacggctatcagggtggcggccattgccgtacccggcgtgattctggccttgggcctcgatcccactgatttggcggacggtctggttgagattctgcacttctcaccgcgattcgtatacggcggattggccggattgcgcatgtttacgctgctgcaggaagattggcgcgcactcggcttgtcccagcgttcgcgcggccttggtgacggtaacgccatcgcccgtgctctctcccaagcgttcggactgctggtgctctccatccggcgtgccaccaaacttgccaccgccatggaagcgcgcggcttcggctccggcgccccacgttcccaagcccgcatctcgcgtctgaagcctatcgactggatcttctacgtcatctgtctggccgtcccgctggcctccataggcgtagccgtcggcaccgggaattggcacttcgcctttcagggtgtctgaaaggcgacaggctggcacagtgcctttcagggtgtctgaaaggcgacagattagcacagtgcctttcaaggtgtctgaacgccttatgatgcccccgctggcgggggctgtcggcgtagccgactggggtggttccagcctcgaccaccctcagtctcgcgactgacgtaatgacccggcagtagggtagtggctatgcccatcaacgcccagattcttgataatccgaaatccgaccgcgtgcgccgcatcgccgatctgacccgcgccaaaggccgcgaacgttcgggccgttttcttatcgaaggcccgcaatccgtgcgcgaggccgtcacttggcggccggacgtggtgcaggacctgtatgtagaggtttcgcaggcgctggaacatccgcgtatcatctcctccacgttggagaagatcgtcgaaacctcgcaggatgccacgatttatgtgcactactgcaccggcgacgtgatgcgccgcatcagtccggacgcccaaggcatcgcggccgtcggcaatgccgagtccatgcacgccggagccgatgacgtcgaacttggcaagaacggtcgggccccgcagattgccgccttctggcaggtgcgcgacccgggcaacgccggcaccgtgatccgtgcggccgatgcggccggctgcgacgccgtaatcttcgtggacgactgcgtggacgtgctgaaccccaaggtcatccgctccaccgcaggctccctgttccatctgccggtactcgccatgagcaccgacgaattcttcacctggacaggcgaccataatatggacgtctgggccgccgacgtatacggcaccgaagaacgcaagccggaaagcctgcccgcagtactggcggacaaggcggcggtcgaggctccgaaagccgtgctgttcggcaatgaggcgcgtggcttggaaccggacatcctcacgcgctgcggccgcatcgtctccatcccgctttatggcaaggccgaatcgctgaacctcggcacctcggccgcggtgatgctgatgtcgctatctatgtcgggtcatgttgaaagaatgtgaaaccggtaaaaacgctgtgaaacgctgagaaaacatcagacgaaagggttctcgtggcagaacaaatggtgttcgacgccgaccaggtgaccgctgaggttgccgagggcatcgagaaaatccagaacgcctccaacctggaggagctcaaggccatcaagacaacgtacgcaggtgccgattcggcgatgaccaaggccagcaaggccattggctccctgcccgccgaccagaagaaggaagccggcaagctcatgggcaagctgcgcgccgacttcggccgcgcctatggtcccaaggaggtcgagctcaaggaagccgccgagaaggccgcgcttgccgccgaaaccgtggatatgacgctgccggtgagccgtaagcctctgggcgcccgtcacccgctgcctaagctgatggaggacgtcgaggacttcttcatctccatgggctggcagatctcctccggcccggaaatcgaagccgaatggtacaacttcgactccctgaatttcggcccggaccatccggcccgccagatgcaggacaccttctacgtcaagggcaatcaagccaaggacgccgccggtttcgtcggctccaacatggtggtgcgtacgcagacctcctccgatcaggtccgtgccctcctgacccgtggagtgccgctgtacatcgcgtccccgggccgcgtgttccgcaccgatgagctggacgccacccatactccggtgttccaccagtgcgaagccctcgccgtcgacaagcacctgaccatggccgacctgaagggcgtgctggacaagctcgccgtcgccatgttcggccctgaagccaagacgcgcctgcgcccgagctacttcccgttcactgagccgagcgccgaactcgacctgtggttccccgacaagaagggcggccccggctggctcgagtggggcggctgcggcatggtgaacccgaacgtgttgaagtccgccggcatcgacccggacgtctacaccggtttcgccttcggcgtcggcatggagcgcacgctcctgctgcgcagcgacatcaacgacatgcacgacctggtcgaaggtgacgtgcgtttcgccgaacagtttgtgatgggggagtgattcagccatgcctatgatcgatatcgattggctcaaggaccatgtcgaggttcccgaaggcctgacctacgaacagctcgccaaggaccttgtcaaggtgggtcttgaggaagaggagattcactcctctcaggtgaccggcccgattgtggtcggctacgtggtcgacgccacccccgaaccgcagaagaacggcaagaccatcaactggtgccacgtggactgcggcgacgaatggaacgagaccgacgaagacggcaacaaggtgccgcgcggcatcatctgcggcgcgcccaacatgaaggccggcgaaaaggtcgtcgtcaccctgcccggtgccgtgctgcccggcgacttcaagatcgaaccgcgcaagacctacggccacatctccaacggcatgtgtgcctccgaacgtgagctgggtctgggcgacaaccacaacggcatcatcctgctgcgtcagtacggcttctccgaggctgaatacgaggctctgaagcctggtcaggatgccatgcacctgctgcacctcgaccagcctctgcttgagatcaacatcaccccggaccgtggctacacgctgtcctaccgtggcgtggcccgcgagtaccaccactccaccggtgccgcctacaccgatccggccgtggcactcaacgagaaggccccggaacctgctgactaccagcccggcaccccggtggacatcgatgttgaaatcgacgataacaatccgattcacggcgtgcccggttgcgaccgctactacgcgcgtatcgtcaaggacttcaatcccaacgcccacacgcccaactggatgcgccgccgcctgattcgcgccggcatgcgctccatctccttggccgtggacgtgaccaactacgtgatgcttgacctcggccagccgatgcacgcctacgacctcgacaagctcgaaggcccgattgtcgtgcgccgcgccaacgagggtgagaaactcaccaccctggacggcaaggaacatgacctgagcgtcgaagatctgcttatcaccgattcgccgaacggcgaacgcggctcgcgcatcctcggccttgccggtgtgatgggcggtctgtatggcgaagtgaccgccgacaccaagaacattcttctggaggccgcgcacttcgatcaggtgaccattgcccgttcggcccgtcgccacaagattccatccgaggcctcccgtcgcttcgaacgtggcgtcgacaccgcgctgcagcctgccgccacccagatggccgccgagctcatggccaagtacggcaacggcgagcccagcgaacacccgaacgacgtgaacaacacgccgcgcgccaaggccatccacttcaaggcctccgaagtggcccgcgtagccggcctcgacgtggacatcaaccgcatctccgacatcctgaccgacattggctgcacggtggccggtggcggcaacggtgagttcgccgtaaccgcgccgagctggcgtccggacttgaacgagccgtgcgacctggtcgaggaggtcgcccgactggtcggctacgaccagattccgatcaccgtgccgccggcaccggtcgagggtctggtgggcctgaccccggaccagcagcgtcgccgtcgcgtggcggacgagctcgccgagttcggcatggtcgaatcgctgagctacccgttcgtgggtgacgacgattacaaggccttcggcttcgacccggaagccaccaagaaggtcagcgtcgagatcgccaacccgctctacggcgaccgtccgtacttgcgtcgcgagattctgccgaccctggccaccaccgtgcagcgcaacatccgccgcggcatcgaaaacgtgtccctgtacgagctcggccacgtctacctgtgggatccgaacgcgcccgccatcccggcactgcccggcggcgtgcgccccaccgacgaacagctcgccgcgcttgacgccggtctgcccgaacagcccgaccatgtggccggcatcctgaccggtctggccgaggacgacggctggatgggcggcaagcgcccggtcgactggtccgacgccgtcgaggccgtgcgccgcatcgccggccgtatcggtgccgcaatcgaactcgaccagcccgccgctgacgatgtgcccgtccaatggcaccccggccgcgccgcccgcgtcatggtgggcgacgtcttcaccggctgggttggtgaactgcatccgcgcgtcaacgaggcgctcggcttcccggcccattccgcggccttcgagctgaacctcaccgcgctgttcgccacgctgaccggcaagcccgtccaggccaagccgatctccacgttcccgccggtcaagcaggatttggccttcaccgtggacgagaccgtgaccgcaggccagcttgagaacgtgattcgcaaggccgccggcgcgaacctcgaatccatcgaactgttcgacgtgttcaccggcgaacaggtgggcgagggcaagaagtccctggcctatgcggtggtgttccgttcgccgagcaagacgctgtccgccgaagacagcgacgccatccgcaaggccatcgtggctgaggccgccgaaatcggcgcccagctgcgcgcctgacccaaccaatcatccgaatcgaggagcgccatgagccaaccggagcaggacaagccgaaatacgggcagtaccagcagcctgaatatggtgctatgtctggccaatacgggccgaattacaacccgtatatttatggcgctcccgagccggatactaagaaggattccgccgcagccgctggcgataacggtggcgcggcacaatctcagcaggctggccagccgtatggtcagcagccggcgtggcccggcaatcagcaggcgggcggctggccgtacgctcaaggcggccaacagtccggtccgggcgcatatccgggcgggtacccgggcatgcagggccagccgtatggtcaacagccgaacggtcagcctcaccagccgcattattaccacggcatcgacctgaacgatccaaaccagaacccactctacgggcactgggattcgtatgcgatcatctcctttatcctcgccctgttcttcccggtgccagtgctctcggcactgatgggcgcggtggcaatgtggcgcacgcgcactttccatatgaagggcttcggtttggccgtggccgccgtggtaatcaacgtgctgtacaccatcgccgtcatctggatggccttcaatggctatgacgccatgagcctttaccaggaagccctccagcaactgaccggcggcaccggctcctcctccgactccatctccgcataagtagcgttcacataccaacacacccactgcataaatatgcaatagtctgcataatcgcgtatactcatccgaagacacatcagtgaaaagagatgagtatggcgaaatatacagtggccgtggccggtgccacgggctatgccggcggtgaagcgctgcgcattctggccgcgcaccccgacttcgacatcacctgcgtggcaggccattcctcagtgggggagtcgatggccaagcacatgccgcatattccccaactggccaatctggtcgttgaagataccacgcccgaagtgctgaacgggcatgacgttatcatcctcgcactgccgcacggtgcttcgggcaagctcgcctcgcagctcgatccgaatgccgtggttgtggatttgggcgccgaccatcgcctcgaagaacaggccgcttgggatgagttctacggcggcgatttctatgagcattggacctacggcatgcccgagctcatcaccggcaaagctgcggacggctcctacacccgccagcgtgcggcgcttcctggcaccaagcgcatcgcaggtcctggctgcaacgtcaccgccaccacgctggccctccagcccggcatcgccgaaggactggttgaatcgcaggatatcgtggccgatctggtcgtcggatactcgggtgccggcaagaatctcaagcgcaccaacctgcttgccgccgaggccctgcaatccgccctgccgtattcggtgggcggcaagcaccgccacattcccgaaatcctgcagaacttcgcccacgcggccggcaagagcgcggccgaagccagcgaattcacgctcggcttcacaccgattctcgctcccatgtcccgaggtatcctcgccaccgtgtccgcccgcatgacggacaaggccaagacactgagcgatgaggagattcgcgccgtatggtccaaggcctatgaaggtcaggacttcatggtgctgctgcccgagggcacgctgcccgccaccggcaacatcatcggatccaacgcagcccacctgcaggtcgtcaccgaccgcaaggccggccgcatctacgcttttgccgccatcgacaacctcaaccgtggtaccgccggacaagcggtccaatcactgaacatcgcactaggcctgccggaagacgcgggcctgaccaagatcggagtagcaccgtgagcgttacatttgcacaaggtttctccgccgccggcgtggcggctggtatttcatccgtcgaaggcaagaaggacttggccctcgtggtcaacaacggcccgctcgacgcggctgcaggcgtgttcacctcgaaccgtttctgtgccgccccggtgcagtggagccgtaaggtcgtcgccgacggtcacgtcaaggccgtgattctgaactccggcggtgccaacgcctgcaccggcgaggccggttacgcccagtccgtcgccaccgcggaaacggtcgccgggctcatcggcgccgaaccgaatgatgtggctgtctgctccaccggtctcatcggtgaactgctgccgttggacaacgtgctggctggtgccaagagtgcccatgaggctcttgccgccaccgccgaagccggcaccgacgcctcccacgccatcatgaccaccgacaccaagccgaagacggtcgaactgaccggctccaacggctggaagatcggcggcatggtcaagggctcgggcatgattgccccgcagctggccaccatgctgtgcgtcatcaccaccgatgcggttgtctccgccggtcagatgcaggccgcactcgctgtggctgccgaacattcgttcaaccgcatcgacgtggacggctgcatgtccaccaacgacacggtcctgctgctcgcctccggtgcctctggcgtcgaaccggacaaggacgaattcaacaagctggtgcgtgaggcctgcgcatccctgtcccgccagatcatcggcgacggcgaaggtgcctcccacgacatccgtatcaccgtcaccggtgccaccagcgaagacgcggcacttgcctgtggtcgtgccgtcgccgcctcgaacctgctcaagtgcgccatctccggcaacgatccgaactggggccgcatcgtcagctccctgggcactgtgccgcctgaagtcgcgccttacgattcgaacaaggtgaccgtggacgtcaacggcgtgcgcatctgcgagaacggcggtgccggccgcgaccgtagcgaggtcgacatgaccccgcgcgaagtccacattgacatcgacctgaacaccggctcggacgccgaggccaccgtctggaccgacgatctcacccacgaatacgtccacatcaacgccgactacgaaagctgacaaacagcccagtgggctgtttgtagcagccggcagcgatagcgtcgccggcgtcgcagaaaagagaaaaattgtctacagaattgaagggacctgggttccatttcgacgtgcacaccgatttgcgcgccgatcagaaggcagaagtgcttattgaagcgctgccatggctggaggagttcgccggccagcgtatcgtcgtcaaatacggcggcaatgccatggtcgatgaccatctgaagcagtgcttcgccgaagacatggtctttctgcgtcaggtgggtctgcacccgatcgtcgtgcacggcggcggtccgcagatttcccacatgctcaaggccctcggcatcaaatccgaattcaaaggcggcctgagggtcaccacccccgaggccatggatgtggtgcgcatggttctgaccggcaaggtgtcacgcgaactggtaggcctgatcaacgcgcacggcccgctggccgtaggcatgtccggtgaagacggcggcctgttctcggccatgcagcgcaggcccgtcatcgatggcaagcccaccgatatcggcctggtcggcgacgtggtttccgtcgatgcctcggcagtcgaggatctggtggctgccggtcgtatcccggtcgtctcttccgtggctccgaacgaagaagatgccactgaagtgctcaacgtgaacgctgattccgccgccgccgctttggctgccgctgtgggcgcgcacaagctcgttatcttgactgatgtggatggtctgtacgccgattggccggataagaattctctgattggccggatcggtgtggaaaacctgcgcgatatgctgccggacctggaatccggtatgcgacccaagatggaggcctgtgtcagggccatcgacggtggcgtgccccaagcccatgtcatcgacgggcgcaagccgcattcgattttgaacgagatattcacctccgcaggcatcggtaccatggttatgcccgatgaaggactggaaatgaggagctcttatggctactgagcatgaggaaaaactaggtacggaagacagcaagtggctgggagagtactctcaggtccacatgaatgtgttcggtacgccgttgcgcgtcatggatcacggccaaggtgcccacatctgggatgttgacggtaacgaatacctcgatttcctggcaggcatcgccgtcaattccctcggatacgcccaccccaagtgggtcaaggcggttgccgatcaggctgccaaggtggctcatatcagcaactatttcgcgtccgagccgcaaattgagctggcatccaaactggtcaagctggctggtgcacctgaaggctccaaagtctacttcggcaactccggtgctgaaggcaatgaagctgccctcaagcttgccaagctgtatggccgcaccttgcctggtgccctgccttccatcggcggcaagcccgcacgcattctcgcaatgactcacggcttccatggccgtacgatgggtgcgctgtccgccacatggaaacccggtatccgcaagccgtatgatccgctggtgccgaacattgaattcgtacgcgccggcgacaaggtcgccctgcacgacgcttttgcacagaccggtctcggccgctatggcaagggtccggtggctgctgtgattctggaacttatccagggcgaagccggcgtacagccgttgggcgccgattacgtcaagttcgtgcacgaactgtgcgatatcaaccacgcgctgctcatcatcgatgaagtacagaccggtatcggacgtaccggcaagtggttcgcattccagcgtgacgatctgtccggcggcgtgacgccggatatggtgactttcgccaagggcgtggcaggcggattcccgatgggcggcatgatcgctttcggcgagaaacttgcggctctgttcactcctggttcccacggctccacctttgccggcaatccgctgggtgcggctgcgggactcgccactcttggcgtgattgaagacgagaatctggtggccaacgccgaagctcgcggcgaacagctgcgcgatggcattatggccaccggtaatccgctgttcgtttccgtacgcggtcgtggtttgctggacgccgtcgagctcaagcatccctgctcccacgcggtgatgaactactgcctcgaacacgggctcatcgtcaacgcggtggctcccaatgcgctgcgtttcgcaccgccgctgattataaccgcacaagacgtggatcaggcacttgccatcctcaaggatgtgcctacggacctgcccgacgactgatttctctccgtcactgccgccccaccgatccaaggagatcatcatgaccccagaacttcgccacatgctgcgtgacgacgacctcaaccatgaggaacagaagcaggtgctcgaacttgccatcaagttccaccacgaccgcttctacaagcagccgttcgccggtccgcaggccgtcgccgtactgttcgacaagccctccacccgcacccgttccagcttctccatcggcgttgccgagcttggcggttacccgctggtcatcgacaagtccggctcccagctgggccgtggcgagcccgtggccgataccgctcgtgtgctcgaccgcatggcttacggcgtggtgtggcgcaccttcggtcaggaccgcgtcgaagaaatggccaagtactccacccatccggtggtcaacgccctgaccgatgacttccatccctgccagattctcgccgacttccagaccatcgccgagcaccgaggcggcgtcgacaacctgaagaaccagaccatcgcctacctcggtgacgcggccaacaacatggccaactcctacctgctcggcggtgccgtggccggcatggacgtgcgcgtggccggcccccacggctacctgccccgcccggacatcgtggccgacgccaagcgcatcgcggccgagaccggcggctccatcctggtcaccaccgatgccaaggaagcggtgcaggacgccgactgcgtgttcaccgacacctgggtctccatgggcgaggaagccgaatacgccatccgttccaagccgttctgggattaccaggtcaacaccgaacttatggcattggccaagccggatgcgctcttccagcactgcctgcccgcctaccgcggcaaggaagtcaccgctgaagtgatcgacggcccgcagtccgtggtgtgggatgaggccgagaaccgtctgcacgcacagaaagcgttgctgacttggttgaccggcaaggcccgtggagacgaaagcctgctcgcatgagtgaaaccggtccgtccctgcagcgccctgccaccagggcggcgcggctgagtgccatagaacaggcgctcgccacgcatatcatcacctcgcaatcacagctgtccaaaatccttatcgacgagggcattgcggtgactcaggcgacgctgagccgcgaccttgacgagatgcacgcggtgaagacccggttgaaggacggtacggtggcctacgcggtgggtcgcagcgtcgttgcttcagaaggtgaggatgtaggggagcgcggtgaggcacagatgtcccgcgtgctgaacggactggtcacctcggtggccgccgccggaaatctggttgtggtgcacacgccttccggtgccgcacaatacgtggcctcggtgattgacaggcagccgatcgaaggcgtgctgggcaccatcgccggagacgacaccgtcatggtgatttgcaccaatgacgacaccgccgtctcccgctccgactggctactaagcctcgcctccaaatgaccaacacgccgtgcataaatatacagtcctctgtatatacttgcatcagtttgtttttcagaccttgaacgaaagggaaccaatggcagataacaagcgcattgttctggcctactccggcggtcttgacacatccgtcgccatctcgtacctgaaggagcgcaccggcaaggacgtcgtggccgtgtccctcgacgtcggccagggcggcgaaagcctcgagaccatcaagcagcgcgcccttgcctgcggagccgtcgaatcctacgtggtcgacgcccgtgacgagttcgccaacgaatattgcatgaaggccctcaaggccaacgccatgtacgaaggcgtctacccgctggtctccgccatctcccgtccgctgatctccaagcacctcgtgcgcgccgcccaccagttcggcgccgacaccatctcccacggttgcaccggcaagggcaacgaccaggttcgtttcgaggtctccatcgcctccatcgacccgacgctgaaggccatcagcccgattcgcgacctgtccctgacccgcgacgtcgagatcgcgttcgccaaggagcacaagttgccgatcacccagaccgagaagtccccgtactccatcgaccagaacgtatggggccgcgccattgagaccggcttccttgaggatccgtggaacggcccgaccaaggactgctactcctacaccgacgacccggccttcccgccggtcgaagatgaagtcgtcatcgagttcaaggaaggtgtgccggtcaagatcgatggacgtgacgtcaccccgctgcaggccatcgaagagatgaaccgccgcgccggagcccagggcatcggccgcatcgacctcatcgaggaccgcctggtcggcatcaagtcccgcgagctgtacgaggctccgggtgccgtggctctgatcaccgctcaccaggaactcgaaaactgctgcctcgaacgcgaacagcaccgcatcaagcgcgacatcgacaagcgctggggcgagctggtttacgatgcgcagtggttctccccggcaacccagtcgctcaacgccttcatcgaagacacccagaagtacgtgtccggtgagattcgcatggtcctgcacggtggccgcgccgtggtgaccggccgtcgttccgactcctcgctgtacgactacaagctcgccacctacgattccggcgataccttcgaccagaggtcctccaacggcttcatcgacatctatggcctgccgtcccgcgtggccgcagcccgcgacgtcaagttcggcaacggcatcgaggtcccgaagaacaccgtcgagtaatcatttactttggctcccctcgttgaggggtcgcgccgtaaagcaaacagcccagtgggctgtttgcaggtgaggtgcgaacgacagtgagccaacaatcagcagccgtcaggctgtccgtaattacaggacgctgtcgccgcagatgactgaggggagtacgagcaaagattatgctcgtgctcccctcgttttttttttgccgatgacggaagaagctcagtgctctccgtaatgagttcggcagacggctatttccaggttttgaacatcgttacccgtaatgcggtatacgatgcggttcttttcatcaatacgacgtgaccagtatccctgacattgccgccatggaatacgaacaacttgaatccaccggtatgtagcccaacgctgatagtctgacaagcagtctgatttgtttgcaatccatggtttcaaggagccttcatgactgagaacaacgaacatctggccctgtggggtggtcgctttacgtctggtccgtcgccggaattggcccgactgtccaagtccacgcagttcgactggcgcttggccgacgacgacatcgccggttcccgcgcccacgcccgtgctctcggccgtgcgggacttctgaccgccgacgagctgcagcgcatggaggatgcgctcgacacgctccagcgccacgttgacgatggctccttcgcccccatcgaagacgatgaggacgaggccaccgccctcgaacgcggtctgattgacattgccggcgatgaactcggcggcaagctcagggccggccgttcccgcaacgaccagatcgcctgcctgattcgcatgtggttgcgccgtcactcccgcgtaatcgccggactcctgcttgacctcgtcaacgccctgatcgagcagagcgaaaaggccggccgcaccgtgatgccgggccgcacccacatgcagcacgcccagcccgtgctgctcgcgcaccagctcatggcccacgcttggccgctgattcgcgacgtgcagcgactgatcgactgggacaagcgcatcaacgcctccccgtacggctccggcgcactggccggcaacacgctcggcctcgacccggaggccgtggcgcgtgagctcggcttctcccgcgtgaccgacaactccatcgatggcaccgccgcacgtgatctcgtggccgaattcgcgttcgtggccgccatgaccggcgtggacatctcccgcctgtccgaggagatcatcatctggaacacccaggagttcgccttcgtcaagctcgacgacggctattccaccggctcctccatcatgccgcagaagaagaacccggatatcgccgagctcgcccgcggcaagtccggccgactcatcggcgatctgaccggcctgctggccaccctgaagggcctgcccaccgcctacgctcgcgatctgcaggaagacaaggaggccgtgttcgaccaggtcgatacgctcgaagtgctgctgcccgccttcaccggcatggtcaggaccatgcacttcgacggcgaccgcctggaagaggaagctccgaccggcttcgcgctggccaccgacatcgccgaatggctcgtcaagaacggggtgccgttccgccacgcgcacgagctctctggtgcctgcgtcaagctcgccgaaggccgcggccaggaactgtgggatctgaccgacaatgacttcatcgagaccttcgccgcgttcctgccggccgacaaggctccgggagtacgcgaagtgctctccagccacggttcggtcgactcccgcaacggcaagggcggcaccgcttacggtcgcgtgcgcgagcagatcgccgacgccaaggccgaggtcgaagaactcaagctcttccccgcatccacgtcggatggctccgcctacaaagcccccggcacgttctagtcccaatgaagctccctctgatgagggagctctattttgttgttgtcactgcaacggcatacactgagaaaccgtaacgaacgggagccgtgaggctgagaggaagtcgccagacttcgaccggggaacttgacgcgggtcatgccgccgtaaggaatcgttgtcgcagatttgccgggttctccgatacagctttcattccgtttgcataattcagccgtgagacggtcgtgatggagccaatacatcacagcggtcgaacggtcgcatgattgggttcatgaatgggcgcaccacttaaggtacggttcgtttcgtgcacccttttttactatctgaaaggatattatgcaggtcaacggagagcaggtcacgctcgagacgccggtcagcgtcgccgattatctcgaagcgcacggattccgcgccgagcgtgtggccatcgaactcaatggtgagattatcccgcgcgataagcgtgccgacgccatgctcgacgaccagtgcgtcatggaaattgtgcagtttgtacagggtggatgaaaggaaaagctatgagcaatattaatccggttactgaagcatctgttgaggcgactccgctgccgccgcagcccgccgtcaccaatccggtcggcaccgccgcgccgattctcccggtggaagacaagccgctgaacctgggcggtcacgagttccagtcgcgattcattctgggctccggccgctacgacctgaacctcatcaaggctacggtcgaacatgcaggcacgcaaatcgtcaccatggcactgcgccgcgcgcagaccaccgagaacagcgtgctcgactacattcccgaaggcattacgctgctgcccaacacctccggtgcgcgcaacgccgaggaagccgtgcgtatcgcccgactggcacgcgaagtgtgccacaccgacttcgtcaaggtcgaaatcgaacacgagaccaagtacctcttgccggacaacgccgaaaccatccgagccaccgaaatgctggccaaggaaggcttcgtggtcatgccctacatgttcccggacccgattgcggcccgtcagctggaggaggccggtgccgctgccgttatgccgctcggttcgttgatcggctccaatatgggcctgcgcatgcgtgacttcatcgaaatcatcatcgccaacgcgcatgtgccggtcatcatcgacgctggtatcggccgtccgagccaggcctgcgatgcgatggagatgggtgcggatgcggtgatggcgtacacggccgttgcctctgctggcaatatcccgctgatggctgaggcgttcaagcacgccatcgatgctggtcgtgcggcgtatttgtctggccttggcaaagtgaccgagggacaggctgtgccgtccagcccgactacggggtatttgcactgacacttttattagctcccctctctgaggggagctggccgcgtagcggactgaggggagatggaaacatggagaaaacatggcattgactgatgaacaggtggagcggtacgcgcgccatctgattttgaagggtgtgggggtcaaagggcaaaagcggttgctggcctccagcgtgctcatcatcggagcgggcggtcttggttctccggccgccctgtatctggcggcggccggcgtcggccatatcggactggtggacggcgatgtggtggatatgagcaatctgcaacgccaaatcatccataccactgcacgtgtcggagcgcccaaagtggaatccgcggccacagccatccgcgcgctcaacccggatgtgacggttgatacctactacgagctcgtcgacgcgagcaacatcgccggcctcatcgaaccgtacgatctggtgatcgatgccaccgacaacttcgccgcaaaattcctcatcaatgacgcctgcgtgctggccggcaagccgtatatccatgccggcgtggtcggattcgccggtcaggtgatgaccgtcattcccggcgaaggcccctgctaccgctgcatcttccgcgacctgcccgccgccggtgagattccgacctgcaaggaagccggcgtactgggcgcggtggtcggcgtgatcggcagtctggaggcgactgaggccgtcaagctgattgccggcgtgggggagccgctcgtggctcgcatgctcactgtggatgccctgaccatgaatattcgacgggtcccactgccaaagcatgtgccggattgcccggtgtgcggtgagcagccgaccattactgctattgatccggccaactatattcagccggcctgcgcgatttagagctatgtggtgcccctccttgaggggtgccaagatcagaacgagaggggaagaacatgcctattgctttgcataatgcggtcgatgacgatgagagcagtgaagcatcgtaccgccgcatcacgccggcggaatttgccaagctcgacccgaatacggtcacgctgctcgacttgagggaaccagccgacttcgccgcccacccggtcgaaggtgccatcaatgcaccactcgaccctctggcccatgtgctcaaaaccgtgcccacagatcgaactgtcgtagtctattgtgctcaaggatggtggagcgaggaagtagctgaaatccttgccgatcgcggctacgatgtagcaagcctcgatggcggttttcaaggttatctcgactatcttgaaacccaccacgattaacggttcccgttgtcgttcttttggatgagtgtgcacggacatatttgtgccctacaatcggtcacggtattactcgatggattcttgaatatcgccgggtaatcgtaattcacaacaggggattgcactgaaccaacccaaaacgggaaggaccgaaaatcgtgggacatctgctcacccgaacgcagattcaacgcctggtcgccaagcacggccgtgaggtcatcgagcatcgccacatgcagatcgaacgctgctgctaccagcacggcaatgtcaccacgttcgaacattccgtgcgtgtcgcctgcctggctgtgtggatggccgaccgcgcacacctgtggtaccgcgtcgacctcaaatccctgattcgcgcggccctcctgcacgattacttcctgtacgactggcacgactgggataacggcgaacaccagtggcatggcttcacccatggccacgccgccctggtcaatgccctgaaggacttcaagctcaacgatatcgaacgcaacagcatcgagaaccacatgttcccgatgaccccggtgccgccgcgctatatcgaaggctatctggtcaccttggcggacaaatgctccgccaccgccgagaccttctcgttcgaccggttcaacaagcgcgcgttgcccgccgcgaagccttacgccgagatcgaagcccgtcgatgatcatcacactcgaacattatttcctctggtttctgttctacagtttcgtcggctggatgtacgagtccattctcgtctcctgccaacagcaccgcttggtcaaccgagggttcctcaacggcccgctgtgcccgatctacggcaccggcgcgatactcggcgtcgccattctcggcaacgtacataacccgatcatcatcttcctgatttcgatggtgggcgccacgatactcgaatacacaacctcgtgggtcatggagcagctgttccacgcccgctggtgggattactcgaacttccgcttcaacctccaaggccgcgtctgcctgctgggcgcgttgattttcggcctcggcggcgtgggcgtggtacttggttcgcagccatatgtcgagcgggtcacggatatgattccgctgccgatgctgcatacgctggtcacggtactggccctgatcaccatcatcgacttggcggtcacggttgcgggcatgctcgaattcgagcgggtgctcgattccgtctctcaggtggtgcaggatgtggcggcacgcgccggtggcacgtggcagtggggctccagtgcggtatccgacaggatgcgtgagctttcgcaggatacggttgagcgtctgcgctgggccgtcaatggcgtcatcaacgcacagcagaagcgtatgctcaagtccttcccgaagttccaggtgccggatcgtcaggacatcatcgactctttgcgcgaacttatgggcccgcgccgctagaataaggcgttttactgaatcgcgcggctcggctggtgtccggcactgtcgccatgttctgcgaaacttgactgtgcccaattgggcagtcttattcacaattcgatagggagaagcgacaagctatggctcacgtcaccgacttcaaggaagcgggtttcaacaccctgcttgaggaactggaatggcgcgggttgatttcccagtccacggaccgggatcgactcgcagaagcactgaacggcgagcccatcacctattattgtggcttcgatcccaccgctgcatcgttgcatatcggcaacctcgtgcagctcatcaacatgcgtcacctgcagcttgcgggccatcatccgatcgctttggtcggtggcgccaccggactcatcggcgacccgcgccagtccggcgaacgtacgcttaacccgaaggacgtggtggccggctgggccgatcgcctgaagaatcagatcggcggcattctggacaccgaaggcgcgaacgccgtacgtttcgtgtccaattacgattggaccgcctcgatgaccgtcatcgacttcctgcgtgacgtcggcaagaacttccgtctgggcaccatgctcgccaaggacacggtcgcccgccgcctgaactctgaggaaggcatctccttcaccgagttcagctaccaggtgctgcagggcaacgacttcctccacctgtttgacgaataccactgcacgctggaactcggcggctccgaccagtggggcaacctcacctccggcctggacctgatccacaaggtgcgcggtgtggacgtcaacgtgttcaccagcccgattatcaccgatgcttccggcaagaagttcggcaagtccgagggcaacgccgtctggctcgacgccacgatgctcagcccgtacaagttctaccagttctggatcaaccgcccggacgtggagatggaaagcctgctgaaggcgttcaccttcctgcccaaggccgaaatcgaacgactggtcgaggaatccaagaccaaccccggcaagcgcgaggcccagaagacccttgcctgggaggtcaccagcttcgtgcatggcgaggccgctacccaggctgccatcgatgcttccggtgcgctgttcggccgcggtggcaacctcgaagacatcgacgaggaaacgctggaatccgtgctcgacggtttcaaggtggtcgacgagaacggcgagcacgtcttccccgtctccaagcccggcgatcgcgtaatcgacgccgcccaggctgccggactgttcaagtccgcttccgaggcacgccgcgccatcaagtccggtggcgtgtatctcaacaacaaccgtatcgaggatgaggagcaggtgctggccgaagccgacttcctggcaggccgcttcgcgcttatccgtcgtggcaagaaggcgctcggcgccgtggaaaaccgttaatcaacaacgaattaaggaaaacaagtaatggcagaaggtaacgagcgttccggcaagtcttacggcggcggccataaggggtatggcgatcgccgaccgggcaaccgcggcggcaagggtttcaagccgcgcggcaagggcggtttcaagccgcgtcatgatggtgagggtttcaagccgcgtcgccgtgaggatggcgagggctacgcgccgcgccgtgacggtgatggcgagggccacggcggctaccgcaagtcgtacggcaagtccggcggcttccacaagggcggccgctccggcttcggcggcaagggcggttaccgcggcaatggtccgcgccgtgacggcgaaggcttcaagccgcgccgcgaaggcggctaccgttcccacgaaggcgagaacggcgagaatccgcgctaccagcaccgtgataacgatcgtcgtgatttccgccgcgatggtgagcgtcgcagcttccgccgcaacgacgaccgccgagatttccgtagggacgaccgtcgcgatggggaccgtcgtgacttccgtcgtgacaatgaccgtcgtgacttccgtcgcgatgaccgcagggataacgatcgtcgtgatttccgccgcgatggtgagcgtcgcaacttccgtcgcgacgacgatcgccgtgatggcgaccgccgcaacttccgcagggacgaccgccgcgatgatcgtcgtgacttccgccgtgacgatcgccgcgacaacaaccgtcgtgacggcgaattccgcgagttttcgcaggaagagaagcgccagtaccgtgaggagaagcgctctgaatacatgaggcgcccgcgccgtaactccgacggcacgatgagcttcccctcgcagaacccgtacaccgaccgtcgtcccgacgagcccaagatgcccaagggcatggaatggtcgatgctgtccaaggatgagcgcgaacgtctgcgcggcctgtccaaggagcacgcggagaacattggtctgcacatcctcgccgctttcgcgctggaggagagcgaccccgaacttgccttggagcacgccaagtgggtggcccgtcaggcctcccgcatcgacttcgcccgcgagacgcttgcgttcgtggcctaccgtcagggcgactacaagctggccctgcgtgagttccgcaccgcctaccgtatgaacggcttcctcgactacctgccgttcatcgctgactgcgagcgtggcgtcggagagccgaagaaggccgtggaactggcgctgtccgatgagggcaagcagctgcatggcgctcccaaggtcgagatgttcctggtgtacgccggtgcccttggcgatttggagatgtgggacaaggccattgaagtggttcacaccgtcggccgttcccaggggctgccgggtgagtaccgcatgcgtgccgtgcaggccgagcagtacttccttgaagaggccggccgcagcaaggaagccgagcagctcaacgacctgctggaccgtcttgaggaccagtatgccgacgaggagattgacgaaaacagcgacgacgtggtgatcgatcacgatctcgaagacatcaccgacgactccgacgtgctcgaaaagctcggcatcgatccggatgaggcgcagtacgccccggatccggagcaggaatacggcgatgaggatgacgaggctgaagacggtgatgccgagtctgatgaggccgacgagaccgagaccgattccgccaatgacgccgaggctgacgattccgccgaatccgccgactccgactccaccgaacccgaaaccgaaaccgaaaccgaggagtgaacggcgtaatgacccgtttcctcaaaggcaccgatcgcccgctcgccgaggcctatcagcttgcgctgctggacctcgacggcgtggtgtatcgcggcaagaatccggtcgaatacgcggccgattccattcgtgcggccgaagccgccggtatgaccatcgaatacaccacgaacaactcctcgcgcttccagcacgtggtggccgaccagctcaagggcttcggcttggacgtggagccgtggcaggtcatcacctcttcggtggtggccgcccgtatggtggccaaggcgttgcccgccggcgcgcgcgtacaggtattgggcgccgagcatttgcgcgatgaggtcacccgcaacggcctgaccatcgtggacggtcctcaggaccgcccgcaggccgtcattcagggctggtatccggatatgacttggcagatgatggccgatgccgcgttcgcggtcgaggccggagccacgtatttcgtgaccaaccgcgacctaacgattcctcgtgaactgggcatcgcccccggttgcggatcgatgattcgcgccgtgatcacggccaccggcgtcgaaccggtcgcctccgctggcaagccggaagcgtacatgtacgatgaggcccgcgaactgaacgccgccgaaggccacgatttggtgcccaaggaggcgtccatcgccattggcgaccgcctcgacaccgatatcgaggccggtaaccgcggcgactacgattcgctggcggtgctgaccggtgtcaccaacccgaccgaactgatgctggctccgtcacacctgaggcccacattcatcgcccctgatctgcgtgaactcggcgaagcccaaccggagccggtccgcgatgagagcggtacttgggaatgccgcaaggctagcgcttggtttgaaaacggccaggtacacgtcagcgaccccaccagtatggacggcctgcgcgccgccgtatgcgccgcatgggaagccgccgaccaaggcgcacagcttagcgaggccacggtaccggtgttcgccatcgaggcatagtcctatgcctacggatagcgaacatgcgccggtcaccgagcgataccccgaacttgcggatatcgatgaacaagacaacgaccgcaagcttgagacctatcgcaacgtgctggaatccttacaacacgagcttgataacagccgcagctagcagaggtgattcattctcccgccagcggaagatgacgtgaagtgctggatggtggctccatgccgagccaccccgttggtggatggtgggccgaaaggaagatatatgaccgagcagcatatcgatcccgcgactccacttgaccgacttgacatgatgctcgtggcttcgggactggtcgaatcgcgggccaaagcgcagcgactcatcaaggccgggcatgtgcgcgtggacggcgagaccatcaccaagccatcgttcatggtcaaagccgggcacagcgaactcgccgtggataagggcgacgactacgtctcccgaggcgcttacaaactcttgggcgcgttcgaaacctttgccggcaatggccttaccgggccggaaggcttggaatgtctggatatcggtgcctccaccggtggcttcaccgacgtactgttgcgcgggggagcggccaaagtcgtagcgctcgacgttgggcacggccagctcgacccgcgcatcgccaatgacgagcacgtcatcgaaatgagcggcgtcaacattcgcgaagtagaggccgacgacctgccttaccggccggcgatgatcgtttccgacgtctcctttatttccctgacctatgtgatcccggtaatcgcgcgcatcgcggctcccggtgcgcagattgtgttactggtcaaaccgcagttcgaggtcggccgggcaggactcggcaaaaacggcatcgttgaagatccggcattgcgggagcgggcattacacgacgtggtcgcctgtgctgaacagcacggacttgacgtggtggccactgccgatagtcccatcatcggcacccacggtaatgaggaatacctgctttacgctgtcttgagatgaatgcgttggcagtctccgttcaccagcagcacgctggaggtacggtcgatgcctagtgcggtggcacacgtggcgctttccaccgcactgccgttgcgtagcatggcggagtccgccgtcaaagtccggcattgcagatggttggcttcaaccgtgacggctgtgatatggcgaaccgtgctgccatcctcatacccatccatatcaaaacgggaaaacatcgtactgcggagtggatgaacttccagagccctgctgttgacgtcatgacccttcaacacgccgttcaagcggactgtctgaccgctaatatgacgggtgcctagggagccattgacggacagatttccggaacaaacgatatcgccgttgcatcgtagtttgccggtaaaggttatttcatcgcaaataatgtcgccgccgacttcgatgtcgccgctgccgctgatgctggatacgcgaatatcaccatcacaccgcacaatgccacttttgatgaccagtttgtccccttctataactgaggcctcgagggtgctggtcacaatcatggtgtgaaaatgcgcgccatcggcaagacgggaacgttggtccactcctatggtgccgtagactcctttgcctatcagcgtgcaattctgcgtatgcttgcccatgatgataaaactccccttattaatatggacgtacagctttatggcttattgccacaataatgagcgcatccatgttgagggggttatatcggtcacgatgtgagcagatagggggtatagcgagcgcagttaggggggctagccttggatgaagtggtcgatctgatcctgcttgcccatgaggatgagttcgtcgttgcgatgcatgaccagttccttggagccgtactggaactccttgcctggggccttgaggcccaccacggtcacgccgtatttgccgtgcacctgcacgtcctcgatgctgcggcctaccgcgtacaggggcgtgtggatcttgacgacggtgtacggcccgtcgatttcgatgtaatccagataattgccggccaccagatgacccacgcgcttgccggcatcggtctccgcattgatgatgtgacgggcgccgatgcgctgcagaatgcgcgcatgctcctgggacacggacttggtccacagatcggaaacgccggcgtccagcaggttgccggtgatgatcaccgaagcctcgatgctgtcgccgatggccacgacggccgtgtcgaactgggcggcgtcgatctgctcgatggccagcacatcggtcatgtcggcctgaatggtgggcagatgcgcggaccaacgggccacaagctccgggttcttgtccactgcgagcacatcctgacccatctggtcgagggtggcggccacggacccgccgaaacggcccaagccgatgaccagcacgcttttgttgccgctcggttttgctgccatgatgatggtcctctctatgtcagattgctgggcgccgattgaatggccgatcagccaacgataatgttttcctgcggataacgaataggttcgggagccatcggtcggctgatggagtaggcgatggtcaacgggccaagtcgtccgacaatcatctcggcggacagaataaacaggctggccggattgccggcgcttgccacgcccaccgaataaccgcccaacgagaaggccgagcaggcttcgaacacggcgtccacgaacgcgcagccggtggtgaacatcagcatcatcgcaccgaccataaccaacgcaaagcaggccgtggtcacggacacggcggtcatctgaatacggcgggggatacggcggcggaacacggtgacatcgcgatggccggtgaatgcggcgcggcaaatcaagagaatcaccgcgaacgtggtgacacggatgccgccagcggtggatgaggaacctgcgccgatgaacatgagtatgctcatgaacaccttggtctcattcgtgacttcgggcacccaggaaatatcgaaaccggcggagcggggcatgacggcggcgctcatcgcacggcgcatcttcatgccggggtcatctgcggggaacaggccggtattgctccactcgaccagcaggaaccaagccagtgaggtggccaccagcacagcggtggtcaccaaagtgagtttggtgtgcaatgtccaacgtttcgggctgagccgccggcgtgcgcactgcaccagattcagcaccacggggaagccgagcgttccgatgaatgcactgatgagaatcggcagccccacgccccaacggttcacatgcagaccagtggcatccggcgtgaaaccggtgttgttataggccgacaccgcgtagaacagcgcctgccacaaggtacgccccatattgccatggttcacgcggaacaggtcgggcagcagcagcacgaaggtcagcacctcggcgatgatggaggtgcccagcaccacggtgagcacgcctttgacctcggaaagcttcgtggtgcccagctcgttcgcggtgagcatacgctgggagaccttgagtctgcgggaaacgccaagagccaccatcgaggcgaaggtcatgactcccagaccgccgaactggatggagaacaggacgacgacctggccgaacatcgaccagtattcgccggtgttcaccaccggaatgccgcaggtggacagggccgagacggcggtgaagaacgcgatcgggaaattggtgaagatgatgtccgatgtggagatcggcagcagcagcaaaccggtgacgatgatgatcagtgcgccgaaatacaccatggacagacggcccgggtgcctgagcagacggtcggtgatgctgatacgtcgaatgcgcttggcggttttatcgcttttgtctcggctcagtacatcggctgaataccaccatgacagtcccttcgaggcctcctcattggcggaggattcgtcgaagtcattggccatgggtcctcaagctcctcaactgatactgctgtacggtcatacggcatgccatcgcgctgcgcacggcacgcgtacggtgattgcgcggctgtacgccattgtatgccgaagccttacgataatcgactctgtggaacgttgccggcgacgcgccacgaagcagcatttttcgaacacctgtacgactgatgacggtgtctgcggctagaataatgagcagtgcgaccgaatcgacaggaggatgccatggccaagcgcaacgcggtggtggtgacgcataccaggctcaggcagaccggaaccgtagtggccgaggcggtgagccagctgcgagtggccggtttcgaagtcaccatcatcgacaacaccgaggcccccgatttcggcgtgcagccgccgtgcgtatcggacgacaccgaaatcgtcgtggtcctgggcggcgacggcacgatactgcgcgccgccgaactcgtccactgcacccaggtgccgattctcggcgtgaacatggggcatgtcggcttcctggccgaattcgaaagcttccagatcgacgaggcgatccgccggatcgccacccacgactattcgatcgacgaacgcatgatcgcccatgtggacgtctggctgcccggcgccaccaagcccattgaggattgggcgctgaacgacatcacactggaacgcgccgaccggggcaagatggtcgaactgtccatccgcgtggacgatgtggagatgaactcgttcggcgcggacggcgtcatcgtctccacgcccaccggttccaccgcctacgccttctccgcgggcggtccggtcatgtggccgaacgtcaaggccctgcagttgattccgttggccgcgcacgccctgttcgccaggccgctgatcatcggctccggctcgaccttcaccatcgatattctggacgattccatgtccgaaggctggatttgctgcgatggacgccgtcagcgcgccctgccgcagggtacgcgcgtcatggtgcgcgaatcgcgcgataccttgcgcctcgcccgactctccggcgtgccgttcaccaaccgtctggtctccaagttcgatctgcccgtggtcggttggcgcgagcacgcgcgcaacgaggcctcgagccagtcgctgcatcacgggcacacgttcccggcggccgcgtatgcggctggcgttgccgttgccggtgacgctggcgtcgctggtaccgagcccgacaagccgggcgaacgtgacggcaaggcaggatcctgatgctcgaagaactcgatatccgcaatctggggccgattcgagaagccaccattgcgccggccgcaggcatgaccgccatcaccggtgagaccggtgccggcaaatccatgctgctctccgcgatccgactggtctccggcggggccgccgaatcctcgcgcgtctcggccggggcggacgaggcttgggcccaggcgattttcgcgctctcggatgatgccgtcgcatctgaacattccggcgacaccaacgatgccggttctggcgatgccgacagtgggttcaccggtgctgccgcggccgtggccaaggcccatgacgcgggcgtcgaccccgaagacggcgaactgttcctttcccgcaccgtacgcgcttccggacgttcgcgggctgtgctcggcggcaagtccgtaccgcgttcggtgctgggggccatcgccggcgaactggttaccattcatggccagaccgatcagctgaaaatcgcggcctcctcacggcaacgcgagtttctggaccgggtggccggagacgaagccgaactggccgcctaccgcaaggcgtgggatgcgctggccgccatggatgagcggctggaacgcctgcgctcgcaggaatcctctgcccgccaacaggccgactacctgcgcgaatccatcgaccgcatcaaccgaatcgacccgcagccggggaggatgaggagctgaaggcgcgccgcgaacgcatcgaaaacgcggccgacatcgcccaaggcgtgggttcggcgctgggcgcgctggatgcctcgcaggtggatgtggacgccgccgacggcgcttcggccgtggaactcatcaatcatgcggtgacctcgttgcgcgcgattcgcgtcggcggcacgttcgcagagcaggccgatcggcttgaatccatcaatgccgatttgggcgacgtggtgttcgccctgagccaggagctgggcgacgaaggcagcgtggaggatctggaccagatcaacggccgtatccacgagcttggcgacctcacccgtcggtggggccccaccttggccgacgtgctcgcttggcgggacaaggcggcgttcgatctggaggatctggacgcctcgccggaaaaggtcgccgaactcgaatccgaacggcagacgctgtacgatgcggccctcgccgccgccgacgtgctgagcgccgcgcgcgtggctgccgctgccgacttgggcgcgcgcgtcactgaagaactcggttcgctcgccatgctgggcgcctccttggaagtgcgcgtcacgccgcgagacaaggccgatgatccgctcggcccgtatggtcgcgacgatatcgcgttcctgtttacgccgttcgaggggtcgccgcagttgccgatgggcaaaagcgcttcgggcggtgaactgagccgactgatgctggccttggagctggtggccgccgacacgcgcggcggtgccgaccagaccttcatcttcgacgaggttgacgccggcgtgggtggcaaggccgcggtcgaactgggcaaacgtctggcacggctggcccgcagcgcgcaggtcatcgtcgtcacccacttggcgcaggtcgcctcgtgggcggacgcgcagttcgtggtcaccaaggagccgccggatgccgatgacgacgatttgggcgtggtcaccaccatcgccgaagtcagcggcgaaacccgcgtccatgaaatcgcccgcatgctctccggcagcgaatccgaagcctccctggaccacgcccgagaactcctatccgattctcggcttacgctcccgctggcgcgagctggcgccgcaggcgactgagggtggttgaagaagatggagattagcaaatgaccaaggccgccatattcgacctcgatggcaccctcctagactccatgggagtctgggaccaagtcgacatcgacttcctgaacaagcgcggaatcgaagtaccgcctgactacatgaccaaagtttccgccatgcaattccgccagatcgccgaatacaccatcgcacgcttcggccttacagacgcgcccgaagagctcatgcaggaatgggacgacatggccagcgtcgcctattccaccacggtcgaagccaaacccggcgcgcttgactatctgcgcgatctgaaagactccggtgtcaaactgggtgtcgccacctcgctgcccccgcgtctgcgtgagccggcgctacgccacgtcggcatgttcgatttgttcaacgatatcgtctccgtcgatgacgcgaacgacgtcggcaaggaccagcccgacgtctacctgctcgccgccaagcgcctgggtgctgcaccggccgactgcacagtgttcgaagacctgctggtcggcatgaagtcggccaaatcagtcggcatgaaggtctgggccatgcacgacgactcctccgcctccgactggcccgaaatctgccacctagccgacggtgtcctcttcgacttccacgacgccccgcgcgtgctgtgataaaaaagttacgcccccgctggcggggctgtcggcggaacggcgttgttcggcataggtacccctttccgaggccattgtaggcacggcccatgtttcgacactataagttggcgaggtgtttgttcaccgtttaactgttatgtaacacaccttgacagttaagcagaacagttatactgtgttgtataacagctaaacagctggggtgctagtcaaccacaaccgaaaggggcatagatgaaactgatcatctcatccgtgtccggtgagcccatctacgagcaaatcaaaacccaaatccgttcggcggtgctcggcggcgagctgaaggcgggcgaggccctgccttccctgagaaaactcgccaaggagttgcgcatctccgtactcaccgtcaccagggcgtacaacgaactggccgatgagggcgtggtgcagaacatccaaggcaaaggcactttcgtgatggacaagggcaacgaactgatgcaacgtcagctcgaaacccagattcgcgaaagcctggccgaggcaagccggggcgccaaagccgccggcattccgctggacgcattgggccacatgctcgaagaggaataccgcaaggaataacctcaagaaaggaccatggccatgaccgccatatccgaatccgacgcgatggcgttgcaggtcaccgacgtcaccaaacactatgattccggcttcacgctggacgacgtgaccttcgacctgcccaagggctacatcatgggactgatcggcccgaacggcgccggcaaatccaccctcatcaaactcatcctcaacatgatccaccgcgacgccggttcgattcacgtgctcggcctcgacaacatcgccgacgaggagcccgtcaaggaacaactcggcgtggtattcgactccagctacctgtgtgaacagtggcaagtcaagaacattgaacgtatcgtcgcgccactgtattcatcatgggacagtggatgctatcgcaagtatctggatactttcggccttggtggcgcacagaacggcaagaaacatatcaaggatctttcccgcggtatgcagatgaagctgatgctcgccatcgcattgagccatgacgccaaactgctgattctcgacgagccgaccagcggactcgatgtgcttgcccgcgacgaactcatggatatcctgcatgcctacattgaggatggcgaacattcggtactgttcagcacccatatcactgccgacctcgaacgtgccgctgacttcattacctacatcaccgatggccgtctctactacaccggtccgaaagacgagtttgaggaatcgttccgcctgattaagggcggtccagacgaactggcacaactgcctgcggacgtggtgctgggctcacatatgtatgccaccggattcgatgcgctggtccggtcagacaggctttatgctgttgcgtcggtggtttcggggcttgccgttgaatcggcttccattgatgacatcattcgcttgaccaatgcccatgattccaatcgtgacttgagcgggaggtgagcggtcatgggggcaatactgagggtgccgcggtctcggcaacatgcattgaccactgcattgcgcgtcgatatggcctacctgtgcgtcggcgtacagactgtgttctcgttgttgttggcaccgttgttctccgccatctttcaaggtgaagtttatggtgatggtttcggctatcgcatgggtgtcatcatgacggtattcacctgcgccatgtgggtgctcaccatggctgttgctgacctgcagaacggatatcggcttcgtggcattattccgtcttcaaggaagaaccaggtggccgcgcgatatgtggttggattggtgatttccgtattgtcggtagcgatgattgtgttgattgacgggttgcaagtgctggtcaatccgaattggtcattcgcgggcaatctgtgggcggcgccgttgggaggtttctgcaccgcgctgatgatcgcgcttatcgtgcccacgggttatctgtggaccaaactaggcggtcttcaagtcacgatgatggtgatttatgtcgttgtattggctggatccatactgctatctattttgcctgcttcggtgaccagaggattggcccatgccgcgaatgccgtcatcgcgcaacgattgtggctggttattgcggtattgacaacgacggttgtggcatatgggatctcgtatgtaattgcctctcgcatatttgcttcaagggagtggtgacgatgagctggaaatccgtagtaaagcaatgtcgattcgattgtgtcgggacgggtctgttcagcgtggcgaatatggtgtttctgctggttttcccggtgctgtctatcgtggtatcgctggtgatgatatcgacccatgtcgatgaacacgttgccagtggtctgatgggcggactcggaggtctggcatcggtgatggcatatatgagtgcattggggcctgctgcatccgaggaatctgcagggcacagtgccatgcgagggctgattcctgtttcacgcactgcgcaagttgtaggtcggtacctctttctgttggtggttggcctgctctgggctctggatgtggtgatatgcggtggcatcttcattatctttggcgatatagcagatatggggtggattggtgccttggcatcaggtgcctccatcttcgctttggctatcattcttgggtcggtgctgctggcctgtgcatgccggttcacattccgcaagatgatgatggcctttggcgcggtcatggttggcttgtatgccgtcattgcgctgctggctcgattgcctgtcgactggcaatggctattgctgaatattgccgatttcctgacgatctggtggcatacggcgcttgttctcgccgtgttgtgtctgctcgcattttttggctccatgcttatagccatccgcatctaccgagccaaagaactctagccgcgcatttgtccgaccgcgaatgaaaagagaccgacaggaatctgtcggtctctttccgttatcggtgtgttatcagtccaccagatccagagcgattggctggtgcggttgctgggaatcgctttcattggccgtgcggcgcgcgcggatggcggcggctgcgcgcttgacggtcttgataacttcctgcagcaccaccacgccgaaaccgaccgcgatgattttcagccacatgtcgatcggcagcggcacggtgcggaacatcgcgccgccgaattgcaccactagcacctgaagtgcgaacatcagcgcgaacacgccgatcatcaccttattgcgcagcagattggcgaacaggctggcgttgcccagctcgcggctgttgaaggcgttgaacagctggaataccacgaacagcgtgaacagaatggtcgactgctgttcggcggtgccgcccatgaagttcgtccagctttgcgccatgaacaccacggcgatgaacgcgccggagacgatgatgcgctccagcatgccgcgcgagacgatgccggcgtcacggcgggtgggcctgcggtccataagattgtcgcgaatcggctccataccgagcgtcagcgcgggcgggccatccatgatgatgttgacccacagcagctgcaatgcggtgaacggcgcggccagaccactgaacagcgaggcgagtaccacgaccaccgaagacaggttcacggtgagctggaactggatgaatcgctggaaattctcgtaaatgccacggccccagtgcacggccttgacaatggtggcaaaggaatcgtccagcatcacgatatcgctggcttccttggacacctcggtgccggcgatgcccatggcgatgcccacgtccgcgttcttgatggcgggcgcgtcgttgatgccgtcgccggtcaccgccaccacattgccctgggctttcagagcgttcaccacgcgcatcttgataaccggcgtgctgcgggcgatcacgcggatgcggccgatttcgcgggacagttcctcgtcgctcatttcctcgatctggcgcgcctcgacggcgatatgccgctcgtccagaatgccgagttcgttggcgatggccgtggcggtcacgatgttgtcgccggtgagcatcttgagctcgatgcccgccttgcggcagcgctccacggcaccgggcacatcctcgcgcaggggatccacgatggccacgaagccgtcgaacatcatgccggattccaagccggcgcggtcggcagcgtaatcgagagccgcagtgtcggcgtccttatcggaaatatggcggtgggcgaagccgagcactcggcaggactgcgcctggaacttcgcgatctcccgttcgatttcgccgcgcgtcttggcgtcgacggcgcacaggtcgagcatcttctccgggctgcctttggcgaacacggtaatgccgtcgccgtcacgcaccacagtggtcatgctcttggtctccgacgagaacggatacgtgtggagcaccgtcgcgcgctcgcggcgaatccggtagtcgagtccggccttgtgcgcggcgaccaacagtgcgcattcggtggggttgccgatgaattccggcatcgcgccggcctcggcttcggtggcgcccgggaaggtcacgtcggcggtgccgttgacgcagaagttctccagcagcatgcggttcctgatctgctcgggcttctccaaggcgcggcccggtgcattgtacgcctcgatcacggtcatgcggttctgggtcaatgtgccggttttgtccgagcagatcacgttgatgcagccgatggtctcgcacgccaccatcttcttgaccagcgcgttctgcttggacattttgatgatgttcaccgcgaggcacgcggccacgatggtcggcaggccttcgggcacggcggccacgatcagcgttatggaggtgatgaacgcctcggaaatcgtgtcgaacgaggcggtgccggaagccacgaaccgggccacctgaagcacgaacaccagtgcggccacaatcgagcccaccacggcgatcaccttgccgagcttcgcgagcttctcctgcagcggcgtcataccggtgttggcggcgcgcagttcgcgggcgatcttgccgaactcggtgtcgtcgcccacggcggtgaccacggcacggccattgccggcggtcacgaagcagccggaatagagcatgttcgtgcggtcggccaccggggtcttcgggtcggtgaacacggcgtcggtggctttggcactcggcacgctttcgccggtgagcgcggattcgtcggcggtcagatcgttcgattcgatgaggcgcgcatcggccggcagcttgtcgccggtgctgatctgcagcacatcgccgatggtgatgtctcgctgcgacaccagcgtgacctcgccatcgcgcaccacggtgacggtcgtgtcgtcattgatgtcgttcagcgcttcgaatgccttggcgctgcgaccctccatcaccacggtgattgtcacggacagggcgatggcgaagaagatgcccacgcattcgagaatgtcggcgtggccgccggccatggcgcgggtgatgttgacgcccagggtgatggccgccgcgatcataagcatgatgagcatcgggtcggcggccgtcttgacgatgcgggaaagcatcgattccggcttcggcttggtgaaggcgttgggaccgtactggttcaggttgtgcgcggcctgttcgctggtcaggccttgatgtgcatcggtgtccagcgtgctgatgactgctggcgcatcctgcatgaatggtgcgggcgtctgcccgttggccgtggtcatatgttcctctcgtttggttgacacaccgcactgaaacccgcgtaatatcactcgcgtaccgcgcaacatggcggcacgcagccaaacgaatcgttgacgaccatgtatcgcatactccgcggtacatgagtctcgtcatttaaggcaaagccagaccgtaacggaactgccgacggccacgatgttgacttgccacattgcggtttgggccgagcccttcgccgcaatgctgtctactccctcatgggactattcagttgcagaaacagaacctaacaaaccacatggattttcccgttcgccggcagcatggcgattcccgccttcctagaaaaaacaagcaacacgccattggctcgttgcaggtgaaaagccgcaagaaagccgcgcgtgacaaggctcggacatgcttgaacatgcctggaccttcgacttgtgacatcagaaaacaaaaaaccgatacatgctggtaaagcatgtatcggttaggaattgtcagttagtgccgtcagcggactatcacagcgcctgggcggccttctccacgtagccctccatgccgtcgatggccacgacgtccttgaaccgcacgtcggcggtctcaagaccacgcagggcggccggggcggtggtgccggtctcgtgggccagcacatccatgcactcgaagtcggtgccggtggcgtcgaagcccaatgcctcgttcaccacgcgcgggaacttgtaggggctggcggtggagagcagcacgcgcggggtcagcgggtcgcgcggcatctgctcaagcaggtagtagccgcaggcggtgtgcgggtcgatcacgtagtggttctcgtcccaacagtgcttgatggactcgcgtacctgatcctcatcggcccaaccggtgccgaagatctgacgaatcttggccagcagttcttccgggatctcgtacgtgccccacttgttgaggtcgttcatcagcatggagatcagacgggtgtcgccctcggacaagtagtacagcatgcgctccaggttggaggagatgaggatgtccatcgagggggagatggtctggaagaacgggcgctggcggttgtaggtaccggtggtcaggaagtcgaacagcacgttgttcttgtcggaagccaccacgaggtgcttgaccggcagaccgagcagcttggcatagtagccggcgaggatatcgccgaagttgccggtcgggaccacaaactcgacctcatcgccgacgttgatcacctggtcggcgagcagttgggcgtaagcggagaagtagtagacgacctgcggcaccagacggcccacgttgatggagttggcggaggaaagcaccacgtgcgaattgccggcgagacgctcggccagggcgcggtcgccgaagatgcgcttgaccgcggactgggcgtcgtcgaagttgccttccacggcggccacctgcacgttggagccggcctgcgtggtcatctgcagctcctggacctgggagaccttgccttccgggtagaagacggtgatcgcggtgcccggggcgtccgcgaagccggccagcgcggccttgccggtgtcgccggaggtggcggtgaggatcatgatcttctcgtccgcgtcgccatcggccggcgtggtgtgcgccatgaagcgcggcaggatctgcagcgccacgtccttgaacgcggaagtcgggccgttgaacagttcgagcacgtaatcgtcgcccaggggcttgagcggggtgatgcgctcgtcggaccactgttcgccgtaggcgtcggcgatgcactggcccagctcctcggccgtgaagtccggcagcagcgcgcccagcacctcggcggcgatttgctggtacgacttgcccggcagggaggccacgtccaccttggtcttgcccaacgcgtccgaaacgaacaggccgccgtcatcggcgatgcccttacgaatcgcctgcttggcggtcagcgaatcggtggtgctacgggtggaatggaaggtggttgtcacgatgaatccttctgcctgaaagggatgatgaatccacatcagtctagcgtgggccgtgggcagaagggccgtccgtctcgcataaccgaccggtcgcaccggcgaaaatcaccattgccatcgaacggggaccggccatatcatgaaacaggccggctgcaaacgggccatacggtaaggcgacaacggcgaatcaattgtcgcttataccaaagagcacccatgaccgcttcaccccttgcgcagaaggcaaccgatgctttcaacgcgccgatctgcgaaaccgatcctgagatcgccgaactgctggactccgaactgggccgccagcgcagtggccttgagatgatcgcctctgagaacttcgtgccgcgagcggtactgcaatgccagggctccgtgctgaccaacaaatacgccgaaggctaccccggccgtttctaccacgccgaggcgtacggcgtgaaccccgagaccttccgcaccgacccggagatcatccgccagcgcacgctcgacggtgccaagatccttgccgaacgactactggccgacgacgtcaaggccaacggcatctccgtgctgaccggcggcaccgatgtgcatctggtgatggtcgacctgcgcaacagcgagatggacggccagcagggcgaggatctgctcgccgcctgcggcatcaccatcaaccgcaacaccgtgcccttcgacccgcgcccggcctcggtggcctcgggcctgagaatcggcacgtccgccctggccacccgcggcttcggaccgaaggaatacgaggaggtggccgacatcatcggcaccgcgctcgccgccggcccgtccgccgacgtgaccgcgctgaaggcccgcgtcgacaagctcgccgaagacttcccgctctaccccgacctggaccagattcactgattttttgcggatgtacgcagctccctcatcagagggagccgcgcttatatccccggctatcttcggtgcaatatgggtcgaaacgggcaatgcggcccattgtgggttactcttgttttttatgagcgatgaattgagtcctgaggtgttcgacgcggtgtgccgccaggccgatcaggccgcacgcgcacaggagcgtcttgcacaggcaaataccgaagccaaaaacgaactgttgcttgccattgcggacgcgttggacgagcatgctgcggacatcgaagccgccaacgcgctggacatgctcgaatccaaggaaaacggcatggatgcgggcaagctcgaccgcctgctgttcgacgtgccgcgcgtggccgccgccgcccaaggcgtgcgccatgtggccaccctgcccgatccggtcggcgagatcgtgcgcggatacaacctgcccaacggtctgcgccttacccagacgcgcgtgccgatgggcgtcatcggcatgatctacgaggctcggccgaacgtcactgtggacgtggccagcctgtgcctcaagtccggcaatgccgcgttgctgcgaggcggccacgccgccgaacgcactaacgccgccacgttgggcgtcatcgccccggtgcttgaagcccacggtttcgaatccgcactggtgcaatccgtcgaccagtacgggcgcgccggcgccaccgccatgatggaggcgcgaggccatatcgacgtgctcgtgccgcgaggaggagcgggtctgatccaagccgtcgtgcgcaactccaaagtgccggtcatcgaaaccggtgccggcaacgtgcatatctatatcgacaagtccggtgatctcgccaaggccatcccgatcatcatcaacgccaaaacccagcgcgtgggcgtgtgcaacgccgccgaaaagctattggttcataaggatgtcgccgccgaattcctgccgcagatcgccgccgctctggccgaggcgaacgtcgtgctgcagaccgacaccacgtcgtacggcatcatctccggcgcggcaatcgagggccttgacctcaaccacgccgccgaagaggattgggacaccgaatacctggccctcaaaatgggcatcaaggtggtgtcggacctggacgcggccatcgaccacatcaacacgcattccacaggccacaccgaatccatcatcgccgaggattatgcggccatcgaggaattcaccaagcgcatcgactcggccgtggtcatggtcaacgcctccacccgcttcaccgacggcggcgtgttcggctttggtgccgagcttggcatctccacgcagaagatgcacgcacgcggtcccatgggattgcgggagatgaccaccaccaagtggatcggttacggaacaggacaggtgcgcgcatgaacgaggacggcaacatgaacattacggctgacacggcaaacaaggcaagcgaactgcggcccgacatcgacctcaacgatcccaagctcggcctgaagatcgcggccgaacggctcagcatcgtccgctacgtgttccttgtgcagatcgaggacggcatcgcctccgccgcccagcgtgcgtcgctcgaatacgcggacgccgtgctcatcggttggcccgagaccgattcgcccgaagtcgcggacctcgacgatgcccagctcaagatcgtgcgcgaacacatggagctcatggaaggctacatcggcaaatacagccagatggagcacgacggtgaccttgacggcatgaccgacacgctcatccgcatcaccgagcgtgtggccgaggtccgccgcctctaccagccggacttcccgctgcccaccttcgccgaaattcgtcgcgtggtccaggacgaatgggatgaagacatgggcaagatcgatcccagggaagacaatcccaccgccggcgaaatcgaagaggaaaccgaatcagccgatgacgccgccggcgagggcgaccaggcatgagtggtgttaccgacagccacaaaacggctgcgtcagttcagtccgaaaaatcagtggaatccgccgagcccgccgaaatcgttgccgtcacccaaggcgaaaccgaacggcgcatgtctgacctgtccgcgccggccggggccagcagccatggcaaaggcaggctttccgcacgcggcaactggcatacgcgcctgcgcgtcggcatcatgggcggcacgttcgacccgattcacaacggccacttggtcgccgcctccgaagtagcttgggtatacgacctcgatgaggtgattttcgtacccaccggccgacctgtgttcaagctggacaagcacgtcaccaacgccgaagatcggtatctgatgactgtgatcgccaccgcatccaaccccaaattcaccgtctcgcgtgtcgacatcgaccgtccgggcgtcacctacaccatcgacaccctgcgcgatatccgcgcccaacatcccgacgccgagctgttcttcatcaccggcgcagacgccgtggccgaaattatgcagtggaaggacgccgacctcatgtgggacctcgcccacttcgtggccgtcacgcgccccggctactccagtccggacggcgtgaccttgcccgaaggaaaggtcgatacgcttgagatcccggccttggccatctcttcgaccgatgtacgccgccgcgccgaacacgacgagccggtctggtatctggtgcctgacggcgtggtgcaatacatcggcaagcatggtctgtattcatacgaggactgacgattcgtacgaggactagtgtgcatttgtacgagggctggtgaggattagcgcgaatcagtgcgcatcaatcctcaccagtgcaaaggataagcagtcaggccagtcccatcttgattttcaatgccattacgcgagtcgccgccgccgtcactttcgaagcgaaagccggatcggacttcgcccgttcgttgaggccgtccacaattggctttacgtaatccgtctgaccgatgcaggacatgtcgccgcccgcctcgacaagctttactcccaattggcttacatcgtagctgcttaacgcttcggcagacatcgaatccgaaatcaccacgcccgtgtacttcagggcgttgcgaatatgaccgtcgataatcgtagaagaaaacaccgccggattattcgggtcgatggattgatatgtggccaacgacatcatcaacattgcaggatcggccttggtaatcgcctggtcaaaggcacctgcctcggccccgtccaacgtggtggtcgtatccagaatgccttcggtggtgaagtcggtattgccgcttaccgcgcccaacccaggataatgtttgaccgccgcaccgacttgagcgtctcgcaaaccttcaataacggcgatgccatgttcggcgttgccggccgcatccaatccgaaatcacgatccagcgcgccaatcggagcatttgaggcacgattgccaaccactgtgccaagcaccggtgccaaatcgacatttatgccagcagcagctaattgcgaaccccacgtgcctgccgattggcgcaatgcgtcagcggacattgtgccctgctcaacggcactgggcattgtgtcgaaaccggtaccagtcagatgctgtacctgaccaccctcctgatcggtggcgatgatgagacgattgccggccggcgcatatccttggagttgcgcggtcgcggtcttgaccgtatcgacgccggtattccaattgccaatgagaatggccgagccaatgtgttcgtcggcgattgttgaagccaacgaggagggttcggaaccggcgaacaacggcaccatcactaactgtcccacacgttcctcaagcgtcatggcggataccgcacgttgggcttgtgccgccggatcgtcgttcttcttcggggaaggaacgtcggtgcgcggtaacgcactcgtctgggaggtctggggagtggtggtgttgccgtttgatgtggatttggcgaaccatccgacatgccatccgtagactgccacaccggccaacaccaccgccaaagcacatattgccgccacgattggaatgctcctgtgccgaagttggcgtgtggcgtgtgctgagggacgcatatgttgtggccgttgtctgttcatagcggcaagcgtagaacagagcgtagaacaggatgttgcctcattctgtgctcagggcataaccgacctcccgccctttcgataggcttgagttatgtcttttaacgatcctttctcagtactgttcggcaatggcggcgattcacgacgcaacaatgcgaacaatgacgatccgatcatcctcgatgtcgaggccgatggggacggtccggcccacaacaccaacgctggcccctccgggtcatcccgccctccacgtggtccggccaatccgcgtatcacccgtaagccagcgtccggtggctcaggagccagccgtggcagcaagattctgatcggcgtggtgctggccttggccatcatcgtcggtctgttcttcggcctgtcccgattcatcaccgatctgatgtggtacggccagctcggcttccagtccgtggtctggacccagctcggggtgaaaatcggtctgtgggtggcctacgcgctgctcatggccctgaccggcttcgtttccgcctggctggccattcgagcacgccctgattcggccgacggttccaccattcgcattaacggcgatgtggtcgaggtcggcaaatccgtcagctcgaaaaccgctcgccgcgtggccgtggtgatttcgctgatcgtcggcgtcatcttcggttcccagtttaacgcgaactggagcgagattctgctcatgttcaacgcgcagtcgttcggcaccaccgatccgcagttcggtctggacaacggcttctacgtgttcgtgctgccgggcctgaagctcgtgctcgccgccgtggccatgctgctgggcgtgggccttgtgttttccgtggtcacgcatgtgctgatgggcggtatccgcattaccatgccggttaacggacgcggcctgttctccattaccaagcgttgccgtcgccagcttggcatctggctgatgctcaacatgttcgcttgggcagtgcgccagatgattggcgtcttcgaccagctcaccgtgcagggttcacgcatcaccggtgcctcctacaccgccgtacatgccaacatccccgtcaccttcatcatggccgtgctgaccgccatcctcggcgtggtgctgggcatctggctcatgcgctcccacacgctcgaaggccaggcgtccatcggcgtgcgcgcttccgccgcgctcaaggcctggcgtgtgccggtgacctccattgccgtcgtggtcgtggtgggtcttgtgctcaccgtggcatggccggtgctgttgcaacgcttccgcgtcaacccgaacgcacaggagatggaatccacctacatccagcgcaacatcgacgccacccgcgccgcctacggtcttgacaagctcaagaccgagcaatacaaggtgaccgacaagggtgagcagggcgctctggccaaggaggccgacaccaccgcgcagatccgtctgctcgacccgcaggtcgtcagccccacgttcaaacagttgcagcagtccaagcagtactacaccttcgccgacaccctggcggtcgacaagtacgagattgacggcgtctcccaggacaccgtgattgccgcccgcgagctcgatctggccggcaatgacaaccgcaactgggtcaatgaccacaccgtgtacacccacggttacggcgtggtggccgcctacggcaacaaggtgacctccgacggccagcccgaattcttcgaatccggcatccccacccagggcaagctcaccgaatccgaaaagtacgagcctcgcatctacttctcgccgaacaccaccgaatactcgattgtcggtgcccctgaaggcacgcaggcttgggagttcgactacccgaccggttcggaaggtgctctgaccacgttcaagggcgacggcggcccttcggtcggcaacctgttctccaggattctctacgcgatccgcttcggctccgatcagattctcttctccgaccgtgtgaccagcgaatcgcagattctctacgatcgttcccccaaggagcgcgtggccaaggtggcaccgtacctgacgcttgacggccgcgtgtatccggccgtggtcgatggccgcgtcaagtggatcgtcgacggctacaccacctccgacgcctacccgtactcgcaaataaccgacctcggctccgccaccaaggattccaccaccgtctcttccgcaacggtctcgtccctgggctctcagaaggccaactacatccgcaactcggtcaaggccaccgtggacgcctacgacggttccgtggacctgtacgtgtgggatcaatccgatccggtgatcaaggcatgggagaagatcttccctggccagtaccaccagctctccgatatctccggcgacctgatgagccacatgcgctacccggaaagcctgttcaaggtacagcgcgagctgctctccaagtaccacgtgacctctgccagccagtactactcaggcgaagacttctggcagacgccggtcgatccgaccgaatcccagtcccagcaggaccaggacatcctgcagccgccgtactacctgaccttgcagaccggtggcaccgaggaaccggtgttctcgctgacctccacctacattccggctggccagtccacccgtgagatcctgaccggcttcctgtcggtcgactcggatgccggcaatgagaagggcaagataggctcgaactacggcaccatccgattgcaggagctgcccaaggattcgaacgtaccgggccccggccaggcgcagaacaacttcaacgccaacgccgatgtatccaaggaactgaacctgctgcaatccggcgacacgcaagtggtgcgcggcaacctgctcaccctgccgctcggtggcggactggtgtacgtgcagcccgtgtacgtcaagtcttcgggtgcgacttcattcccgctgctcaagaagacgctggtcgcgttcggtgatcaggtaggatttgcggatacgttggatgaggccttggatcaggtgttcggtggtgattccggcgcggccgcaggcgatgccgagaacgtgtccggtgacggatcgtctggtgaccagtcgtccggcatatccggtgaccaatctggttccgataccaatggtggccagtccggcaccacggacggcaagtcggattccggctcgtcttccgaccgtagccccgaactccagcaggcgctgaacgatgccgcccaagccatgaaggacagccagtccgccatgaagaacggcgactggaccgcctacggcaaggcgcagaaggagcttgaagacgccctcaacaaggccatcgagctcgacaagtagttccgacaggaattggctcccctcagggtgaggggagccatcgccgaaggcgactgaagggagtcggttacctcaactgacatagcccgtccttatcataaggacgggctatttgcgtattcaaaggaacctcatgccatacaccttccgtccggccgtcgaatccgacgtccaagccatcgccgacatctacaacgcctcagtgatggccggcggtgcgaccgccgacctcaccccgcgcaccttcgaccaacgccgcgcctgggtcgaatcccatacgccgccctacggcgtttttgttgtggaatcggaagacggttcaatcattggcttcggtgcgctctccgtgttctatgaccgcgcaggatatgacggtgtcaccgatttggcctattacatcgatccggcatggcaaggcaggggagtaggcacgttcatgcttgacaggctgctcaccgaggcgctggcccgccacatgcgcaaggcctgcggcatcattttcgccgataacgccggctccattgccctcatgcaccgcttcggcttcacccaattcggactcatgcccgccgctgccaccgactctaccggcaccatgcgggacatgtcctactggtatttggacctgcagccttgcagtaagtcatttcagtcaagaaaagtgtgaggatgccggagcaaacgagcttgacggcggcgttgagtacaatcttgacggttggatccggccgggcatgggccagtgcgcgaggcgaacgcgcgcatgacgtacggaacgtacagaacgtgcatacgggaataaaggaagacggacgaggagcggattatggcatcggatttctggctgattgcgggactgggcaaccccggcaaaaaatatgaggacacgcggcacaacatgggcttcatggccgccgacgtgctcgccgaacgttggacggtgaacttcgccgatcacaagggcttggccatgctcggtaaaagcgtgatgaacctggacggccgcaccgtcaagttctttctggccaagccgctgacttatatgaatgattccggcaatgcggtggcttccattagcgcctattaccagatcgagcccgaccatattgtggtgattcacgatgacatggacttggaattcggccgtatcaaggtcaaggcaggcggctccgcaggcggccacaacggcatcaagtcgattgaccgttccctcggcacgccgaaatacgcgcgtgtgcgcatgggcgtcggtcactccaagcgcggtgcgaacgcgcatgacaacacggtgaactgggtgctgggcggattcggtccggaccagcgcaagcagctgcccgaattcctggctgacggcgccgacgccgccgaggacatcatcttccacggtcttgccaagacccaggagaagttcaatggccggtgaggcgacgcacccggacctgatcaacggctcactggcaggcatcctgtctgagctggaacaggacaagaccttcctgaagctcgccgccggcgacatcgaggcttcggacgacgtcgacaactccgtcctggccggcatccccgaaggcttgcgcccggctttggccgccgccatcgggcagggtgtggccggcaaacccggcaagccggtcgtgctggtcgtggcctccggccgcgaagccgaagagaccgtgggctcgctgcgctcctggtatgatggcgacccgaacgacatcgcccagctcgaagcctgggaaaccctgccgcacgagcgtctgagcccgcgcgcggacaccgtggccagccgcatggccgtgttccgcagactcaagcatccgagcgataccgattcgatgttcggcccgattcgcattctcgtcatgccgatccgctcgctcatccagccagtcgtccaaggactgggcgatgtcgagccgctcgtgttcaccgtgggggaggacctgcccctcgacgaagccgccaaacgtctgatcgaaaacgcctacacgcgcgtggacctggtcatggaccgtggcgagttcgcggtgcgcggaggcattcttgacgtattcccgcccaccgcaccgcacccggtgcgtatcgaattcttcggcgacgaaattgacaccatcaaggaattccacgcctccgaccagcgtacctacggcgacggcctcaagaccatctgggccaccgcatgccgtgaactgcagctgaccgacgccgtgcgcacccgcgccaaagccttggtcggttcgattcccaatgctgaggacatgctcgaatccatcgccaacgccattccggtcgaaggcatggaatccctgatgcccgcactcgtggaccatctggaaccggtgggctccatgcttcccaagcacgccgtgatcctcctgagcgacccggagaaactgcgccgctccgccgaagacttggcaaaaaccgcgaacgagttcctggccgcaagctggcatgtggccgcctccggccacggcgccggcgcgcccatcagcttcgacgaagccagcttcctcgactatgcggaaaccatcagctccctcgaatactccgaacatccggtgattcgcctcaccagtttcggcgtggacaccacgttgaccggccatgtgcagctcgacgcccagaacccggccgaattccgaggggatgaggccaaggcctcccaaggcatcgaaggcctgctcgatgccggcttccacgtcaccatcaccgccgctgcggccggcaccttggccaggctcaagcgtgcgatcaacactaccggcatcgccaatttcgacgtcatccgctctcaggccatcgacggcttcgtggacaaagccgccaaaatcgccctgctcaccgaacgcgacctgaccggccgcacttcagccgtggccgtggccaaaacgccgaaacgccggcgcaaggccatcgacttggtggagctcaaaaaaggcgattacgtggtgcacgagcagcacggcattggccggttcatcgaaatgcgtcagcgcaccatcggcaccggcgccaacaaaaccactcgcgaatacctggtcatcgaatatgcgccttccaagcgcggcgccccggcggacaaactgttcatccccaccgaccagctcgaccaggtcagcaaatacatcggcgccgaagcccccaagctcaacaagctcggcggctccgactgggcggccaccaaggccaaggcccgcaagcacgtccacgagatcgccgacgacctgatcaagctgtactccgcccgccagcgcgccaagggcttcgcgttcagcccggacaccccatggcagaaagagctggaagacgccttcccctatcaggaaaccgccgaccagctcaccaccatcgacgaagttaaatccgacatggaaaagcccgtgccgatggaccgcctcatctgcggcgacgtgggcttcggcaaaaccgaaatcgcactgcgtgccgccttcaaggccgtgcaggacggcaagcaggtggccgtgctcgtgcccaccacgctgcttgtccagcagcattacgagacgttcagcgaacgattcgagggtttcccggtcaatgtggcggccatgagccgattccagaccaccaaagagatcaacgaggccatcgaggggctggaaaccggcacggtggacgtggtcatcggcacgcacaagctgctgaacccgaaaatcaagttcaaggatctgggactcgtcatcatcgatgaggagcagcgtttcggcgtggaacacaaggagacgctgaaagccctgcgcaccaacgtggacgtgctgtccctgtctgccacgcctatcccgcgcacgctggaaatggccgtgaccggcattcgcgagatgtccacgctcgccaccccgcccgaagaccggttgccggtgctgacctatgtgggcgcctacgaggatgcgcaggtcaccgcagccgtacgccgcgaactgctgcgaggcggccaggtgttctatgtccacaatcgtgtgcaggacatctcgtccatcgccgacaagatccacacgctggtgcccgaggcgcacgtcggcatcgcccacggcaagatgggggagaagcagctcgaccagatcatccgcgacttctggcatcgcgacatcgacgtgctcgtgtgtaccacaatcatcgagaccggtcttgatatctccaatgcgaacacgctgatcgtcgaccatgccgaccgtttcggcttgagccagctccatcagctgcgtggccgcgtcggtcgcggccgcgagcgcgcgtacgcctacttcttgtacgacccgtccaagccgatgaccgagcagtcccatgaccggctcgccaccatcgcgcagaacacggcgctcggctccggtttcgatgtggccatgaaggacttggaattgcgcggcaccggtaaccttctgggcgacgagcagtccggccatatcgagggcgtgggcttcgacctgtacgtacgcatggtgtccgaagccgtggaaaagtacaaggagcccgaagaggacgtcgagccggtggccgtgtccatcgacctgcccatcgaagcgtcgattccgatcgagtacatcgattcggacaagctgcgtctggaagcgtaccgcaagctcgcctccgcccgcaacgaggccgatctgaaggatttggaagaggaacttaccgaccgttacggcaagccgccggtcgaattcgagaccctgttcgacgtggcccgtctgaagttcaaggcccgcaagctcggcatttcggagattctcgcgcaatccaaccgcgtgcgcatcggtcgcatcgacccgcccgaatccatccagatgcgtatgggccgtatttacaaaggcacccaataccgtccggtcacccaccagctcatcgtccccaccccgttcaccggctccctgggccaaggccccatgagctccgaccaggtagtcctctggaccaaccagttacttgatgatttggcatggaccccgtcgtcaagcaaacggcagagccgtttgtagacggggtgcgaggcggcagtcgagccagctatggctcaccgggcaacatccggtgagccatattcatattcatgccgtcgtttgtgacgatgattcaccccagacggaatcgttccgactgtccagcgagcgagattaagtgactgctatgagcgaaacgactacgaaccgcacgaaccagagcgcgaccacggcaacacttgccggctatgagattccccgcctcggcatgggcacgatggcgctcgccatcgaggggcgcccctccaaccgtaatcaggcaatcgagaccatccatgccgcgctcgatgccggagtccgttatttggacacggcttggtcctattatctgcccagcgcacccggcaccggcgaaccggaggatatgggctatggcgaatatctggtccgcgatgctctgcactcgtggcatggccccaaagatcaggtgctcgtagccaccaaaaccggctggctgcgcacgcttgacggcaacggcaactacggctggcaggccgacgcccgacctgaaaccatgatcgccaatgccaaggaatcagcccgccgcctcggtgtcgatacgctcgatctgctctactcgcactgcaacgatccgcaggtgccgtacgaagaccagatgggcgcactcaagcagctcgtggacgaaggtgtggccaaagctgtcggcatctccagaatcgacaacgcggacatcgaaaccgcccacaatattttgggagatcgtctcgtggccgtccagaaccagttctccccggtccaccgcgaccctgagcacacgttggaaacctgcgaaaagctcggtttggcttttgtctgctggtcgccgctcggtggattccttgacccgttcaacgagcatctgttcgaccggttccgcgaagtcgccaagattcacgactgctcctaccagcgcgtcacgctcgcgtgggaacttgcgcaataccaatatctgttcacgattccctcggccagaaacccgcaggagattcaggactcgttcaaagccagcgaactgaaattgtccgacagtgaaatcggctacctcaatggcaaggatgttgactgagcgatttcgtccgtactgccttgcaatcaggcggcacactggcattgtgagcgctaacgctaaattttgggcgtgttgttcacaacgtccacaaatcgcactattcttaagaatgtcattcaagatacacaaccgttttaaggagtagttgtggcagtaattgaaagcgtgtacgcgcgtcagattctcgattcccgcggcaacccgaccgttcaggtcgttctggacaccgaagacggcgcccagggcctgggcctggttccgtccggcgcctccaccggtgaggccgaggcttgggagcgtcgcgacggcgacaagtccgtctacggcggcaagggcgttcttaacgcggtcaaggccgtgaacgaggtcatcgctccgaaggtcatcggcatggacgctgctgaccagcgcgctctggacgacctgatgatcgagctcgacggcaccccgaacaagggcaagctgggcgccaacgccatcctgggcgtctccctggctgctctgtacgcttccgccgagtccgccggcctgccgctgtaccgctacatcggcggcaccaacggccacatcctgccggtcccgaacatgaacatcatgaacggtggcgctcacgctgacttcgccaccgacattcaggagtacatgatctccccgtacggcttcgacacctactccgaggctctgcgcgctggcgttgaggtctaccacaccctgaagaacgtcctgaagaaggaaggcctgaacaccggcctcggcgacgagggcggcttcgccccgaagatgaagtccaacgaggactccctcaagtacatcatggacgccatctccgccgccggctacgagcctggcaagcagatcggcatctgcctggatgtcgcctcctccgagttctacaacaaggagaccggcaagtaccgcttcgacggtgaagagcgtgactccgcctacatgctcgactactacgagaacctcatcaacgagtacccgatcgtctccatcgaggacccgttcaacgaggaaggctgggaagactgggctgccatcaccgctcgcctcggcgatcgtctgcagttcgtcggcgacgacctgctggtcaccaacccggctcgtctgcagaaggccatcgacctcggcgccgccaactccctgctggtcaagctgaaccagatcggttccgtcactgagaccctcgacgccatcgaactggccaccgccaacggctacacctccatggtttcccaccgctccggcgagaccccggacaccaccatctccgacctggctgttgctaagaacacccgccagatcaagaccggtgccccggcccgtggcgagcgcgttgccaagtacaaccgcctgctcgagatcgaggaggagctcggctccaccgctcagtacgccggctacagcgccttcaaggcctgcaagaagtacctggccaagtgagctgaaacgcccgtaaaggcgtgagtttccactgaagctcgatacccgtcgtattcgtcaagtcgaatgcggcgggtattttcgtgtgacatgagcaagtcgtcccgtaccggcaaacctggcaaaaccggcaaagcacgagttaggaaaaaagggtcggcggggcctatagcgttcttcgtctccctgttcattatcgcccttggcaccatccagctggtctccaccttccacacctatgccctgaacctggccgaactcaatggtctcaagcgtgaggaggcttcgctgatcgccaaaaagcaggagttggaaaacgacatcaagcgttgggatgacaaggcctacatcaccgcccaggcccgtgaacgcctcggcttcgtattccccggcgaacaggccgtgcgtgtgcttcatcccgaagccgtgaccggctccgatagcgaatcccagaaaacggaagattccagtagcagcaacaaaaaagtcctgccatggtacagcgaactgtcttactcgctcaaaaaggccgatgagcctgtgaccgatagcgagtccggcaaatccgatatttccggttcctctgactcgtcatccaacgactcatccaagcggtccgataagtcagaccagaacacccaatccgatcagaacacccaacagaatacccaacagaacacaggggagggaacccaacagtgaccatcgatatcgccgccaaggccaaggcccttgtcgataccgtgcttgccgagcccgccaacgatcatgacatcgacctggtgcagcgtcagctcggccgatacccgcgcggcatggtcgccgtgggggcgcgatgcgtctgcggtaggccacttgccgtaatcacccgtccggtgttgcccggcggaatccctttccccaccacgtgctatctgaccggtccggaagccgtcaaggccgcctcccatgtcgaggccgccggcgtgatgcagcaatacaacgacatgttggcctcggacgaggagctcaaggccgcatatgagcaggcccataacctgtatctggcattccgccacgaactggcaggacgtcttggcgacagtgaggagcatattgaaggcacttcggccggcggcatgccggtgcgcgtcaagtgcctgcatgccctgctggcccaatccctggttatgggaccgggcgtcaaccccattggcgatttggtactggaacgcgtcaaagacgaattcgatccgaccgtctgccgctgcacgctggacgattgatcaacagatgagccagcgcgaacagtccattcatacgcactaagggatacgaggagaaggcaatgagcaaggaatccgtaaccgtcgccggcattgattgcggcacgaactccattcgactgaaaatcgcacgtgtcgatgccgatggcatgcatgaggtggtgccgcgcatcctgcgtgtgatccgtctcggccaggatgtggacaagacccatcgttttgccgacgaagcgttggaacgcgcctatgtggccgctcgggaattcgccggtgtgattgccgaacatcccatcgacggcctgcgtttcgttgccacctctgcaactcgtgacgcggaaaaccgtgaggagttcgaggatgagatcgaacgtatcctcggcgtgcgccccgaagtcattcccggcaccgaagaagccgacctgagcttccttggtgccacttccgtggtcaatcgcgacgatctgcccgccccctatctggtggttgatctcggcggcgggtccaccgagctggtcatcggtggcgacggcgtcagtgcgcccactacccaggttcagggcgcgttttccatgaacatcggttccgtgcgcatgaccgaacgtcatctgaccaatgatccgccgacccagacacagatcgatgaggccgttgcggacgtcgatgaacatatcgatgaggccttccgcaccgtggacgcaggcaaggcccgtaccatcattggcgtgtccggcacggtgaccacgatgaccgccttggccatgggattgaaggaatacgaccacaccgtggtcgacgggcatcggttgagccttgaagacgcctatgccgtggacgacaagttccttaggatgacgcgcgccgagcgccgcgaatacaagaccatccaccccggccgtatcgatgtggtcggcggcggcgctgtggtctggagccgtgtgctggcgcgtgtcagcgaagccgccaaggccgatcatggtgaagccatcgattcgttcgttgccagcgaacacggtctgctggacggcattgtgctcgattatggtcgccggttgctggctcaatagcgtaagtggtaagtgcctccagcgggctgagccgttaagcaaacagcccggtgggctgtttgtaggcgaggggagcggctatgccgcgacggctgcacgaagtgcagcaacccgcaagcaatgctcagggcaggagatagcttataatagaaaagttggcctccgtggcgaaatggtatacgcagtcgacttaaaatcgatcgcttcggcttgtgggttcgagtcccaccggaggcaccttgaaatcggcctgtggccgatgccgttttgcggctgtgccgtggtctctccccagtcggcttcgccgacagccccctcgtcagagggggctcgcagctcactatgtggagagctcataaggccgaaacaaaaggccgttaggctatgtggcgttgtgacgatgtacctgatgaaacgaggaatccacatggcttcacgctggaccgatgtcgaacgagtcgaacaaggcgccctgcccaccatgcttgcccaagccgtcattgcgggcactgcactcaccgttggtgccatcgcctgctcgggattctatctgtccatgatcggcaatgtggccgcactcctgccatgggcgactatcgtgatactgatcgccgtggcgttcacctacatcgtcggcttcgccctgttgtggtgtgccgaagccctgaccctgcgtgccaacgacaaactcaagccatggctgtacggcgtcgtcggattaatcggctacggcgtgtggggcatgttcgtgatgagcgcgatgatgaacacgctgaaccagccgctgaacggcgtggtgttgtcgaacggcgatgtgatggccctgaccgtcaactacgcggtgttcggcttcatcgccttcctgttggcacaggcgtacgcgcccaaaatcgccaccaagaagggactgaccatcgggctgatggtggtgcagatcgtattggccatcatcggtatcatcgtactggtcatgatgttctccgcactgtctcactgactgacttatcgctcgccggcacgacgcgcgcggccatcatcgcacaaggcgaaagcgattccgggcgctgggctgggatacgatatcgtgatggcatgacgcctggtaacaccggcatgccgaaccagcaggggagaaggagccaaatgttcagtgtgcttgacatgttcaccatcggcgtcggaccttcatcctcgcacaccgtaggcccgatggtcgcggcacatgctttcgcctcctcgttgcaggccgaccatttggtcgatcgcaccgcacgtgtcaaaatcacgctttatggttctctggcgctgaccggtctcggccacggcaccgatcgtgctacgatggccgggctcgaaggcaatctgccggccaccgtggataccgaccacatgatgcacatccgcgagatctgcgcgttggacgatactctgaacctcgccggcctcaaacgcatccatttcgactacgaccgtgacgtggtgttcgaacaatggaagcgcatggccgcgcaccccaatggcatgcgattccaggcgttcgacgccgccgcaagcttggtcgacgaacaggtctggtattccatcggcggcggattcgtgcgcaaaggcgctcccgaagacccgatgatcggcattcatgaacgccctccggaaggcgcctcctttgccgatgcggacgagtcatcatccactgatttcggcgtcgaggcaccctacccgttctcatcatgcactgaactggtgtcgttatgccgggaacatcatctcagcatcgccgaacttgtatgggccaacgaaaccgcttcacgctcgggcatccaggtccgatccgatattgatgccatctggcgtgttatgcgcgcctgtgtggaccacggatgcacctcggcggaacccacattgcccggtggccttgacgtaccccgccgcgcgccgaaaatgtatcggcgtctcgcctcgaattccgatgtgctgcgccgcgacagccggcgcaaagacgccgtgctcgagtcttccgacgccgcatgggtggatctcttcgccttggccgtctctgaggagaatgccggaggcgggcgcatcgtaaccgctccgaccaacggttccgccggcatcattcccgccgtgcttcactattactggcatttcgtggacaacgccaatgaacagggcgtggtcacgtttctgctgactgccggtgccatcggatacctgttcaaacgcaacgcctcaatttccggtgcggaagtcggttgccagggcgaagtcggctcggcctgttcgatggcggcggccggacttgccgcagtcgtgggcggcacgccggaacaggtggagaatgctgctgagatcggcatcgaacacaacttgggtctgacttgcgatccggtgggcggattggtgcagattccatgcatcgagcgcaatgccatggccgccaacaccgccatcaacgccgtgcgtatggccatgctcggcgacggctcacacatcgtgacccttgatcaggccatcgaaaccatgaagcagaccggtgaagacatgatggccaaatacaaggagacctccaagggcgggcttgccgtcaatgtcgtcgaatgctgattgacatgtccggtattcaccagcatgatgaccggaattgacgtatacggccagcgtgtcgtatcgcacagggatgaaggactaccgccgattcgccgatggtgctaaggtagggcgcattgtgtctttgaaggaggactaatgacagatcagatgcctcaggtgaacgccgaattcggcaccacgcccgttatcgagttcccgacgcccgaagccccgaagggcctcaaggttgtggagctgaccgagggagacggcccgatcgtgcgtcgcggcgacaccgtcaccgtgaactaccacggcgtggtgtggggtaaggacaccccattcgactccagcttcgaccgtcatcagcccgccagcttcggcatcggcgtgggacaggtcatcaagggctgggaccagactgtgccgggccataacgtgggttcgcgtctggtggtttccattccgccggaatacggctacggttcccgcggcatcccgcaggccggcatcggcggcgaggacacgctggtgttcgtcatcgacatcatttccacccgctgaccataggtcagcacatgacgaacgccggggtcatagccggcgttttgtcataaataacgaagattgtttcagcatcgacaacggttcaggaggacgatatggctgaggacaaggtctacctgctgacgcaggaagcatacaacaagatgaaggaagagctcgcccatcgtgaaggtgagctgcgtgaggaaatcgcgcacaagatcgccgtggcgcgtgccgagggcgacttgtccgagaacggcggctaccaggccgcccgtgaggcgcagagcaagaacgagggccgcatcaccgagctcaccgtcaagctgcgcgattccaagatcatcgagaatgctccggaaggcaccgtgggcgagggctctgtggtgaccatcgagctcaacggcaacgagatgacctacgtgctcggcagccgtgacatcgtggccggcaccgactacgacatcatgaccccggattccccgattggcaaggccatcgagggcgccaaggtgggcgacgtcgtttcctacaccgcaccgaacggccgcgagctgtccgtgacggtcaaggccgccaagccgctggcctgagttaagtgactggtatgcccccgtaggcgggggcatacttatatgtcgtagcgcttattgccacagcgagacgatcaccatgtagatggccaccatatggcaggcatatccggccaccgttccgcagtggaaaatctcatggaatccgaagacgcgaggccaagggtcgggcttgcgcaaggcgtagacgatggcgccgaggatgtagcaggcaccgccggcgcacagcagcaccaccacggctggccccgcatacggcgaattccagaacatcaccatataagccaggccgtagatgccgaagatgatgtacaccaccgtatacagccagcgtggtgcattgatccagatcacatgaatcacgatggcgatggccgtgcacgcccacatcgatatgatgatcacattgcgccagaatggttccagcgcaaacgaaaccggggtatacgtgccagcaatgagcaggaagatgttgacatgatcgatacgccgcagcacatcggtgacgcgcgggctccaatcgcccagatggtagcaggccgaattggtgaacagaatcagcgacgctgtcatgaacacggcacacgcccacttcagactcgcgccatgtgccaagcatataagcacgatgcctgccgccaatgacaggggagcggcaatcgcgtgaatccagccgcgcatcaacggctttggccgtccgtgcacgtcgagacgaatcttgcgttccacttccgcaggggcaatgccctcgattttcagtgcacggttctccgctttggcgagcttgtgccgggccttctcctcggctttggctcgaatggcctcggccttgaactgggccttggcccgtacggcatcagccttggcctgcaacgcctgttcgcgcgcctcgatagccgcctgacgcttggatgcgatggtggcatcctctgcaatcgtcgcgctgttatgagcgtcgtgatgcatcgtcttttccgagtcgccggttgttgatgccatggtgatgcccccgtttcacgagctgacgatacgcttcttacgctgccgtaacgctacgttagcgtaacttttatgcttgtcaataccgactcgcacgaacactatcacccaatggcggcgatactatggaatccgaagatgagaacgtcgcagcaataaagggctcggcgatggtgtattgcacggagtgtgggtttgccaacgagcaaggaaatgccttctgttcgcagtgcggaagcccattggagcagcccgaggccaatccggcggcccctgcttctcctgaacctcccgccgggcgtcctggcgtcgatcacaccaaagcggtggtgattgtgctcatcgcgctgatttgtgtcgtggcgttagtcatcggcttgttcatcacccatagcatgggattgtggggagctcagccgcaggcgcaaacatcggcacagtcgaccggggccgatgcgtcggattccgccgatgatggcacgacggattcttctgacgccaagtccaaggccaagaagaacacgtctgatagcgccaaagacaagaacagcgacgattcgtccaagaaaagctcgacggagaagtcgaagccttccactccggtgatcacatccagccagttgtctgacatcgcggattcatactcgtcctccgatgtggccgtctccgccatggtcatcgatggaacatccgccgactcctcagaggacgccaccatcgcgaccacgtcgcagtccggcaagcaattcgtggctgccgatttctatctgccggtctatcttgcggcccaggacaatggcgatgacaacgccaaagcgcaggcaaacgcgatgatgggttccatggacacagcaatgccggcaatatggtggcggcttcggatatcaaactgtacgtgatgcttgccgtgtacgataagcaacatgccggcaccttggccacgggcgggaagccgtgcaacgcgattggcgcggtattgaagatgcgatgtcgtcatagtcgtcgtacttgcccgtgtggcttgccgcgacggcggcggtgcgtctgcgtatgatagggatatggctgatttttcacatatccttgcaacgcgccccgacttcgacgacgaggaccgcgagtggctgcatcatcttgtcgccgattggcaggtgatcgccgatttgagctttgccgatctgctgctgctggtacaggatggcgatggcaaatacgtggtggccgagcaatgccgtccatccaccgttatgacgctgcgggcggaagacgtggtgggaaacgtcatgccggacgacatggtcggcgaattggacgccgccatgctctccagcgtggtgttccgctccacggtattgagaaccgtgggcaaggcgaccgtctgcaacgtgtacgcgccggttcggcacaatggcaagaccttgggcttggtcgtgcgtgagaccaatatggccacacgagaatccaacggccgatatgagtcggaaagcatcaacgccggcaagcatctgtacgagatgattccgcgaggccaattcccctacaaggattcggtgatgagccaacgccatatcgctcgcgtggcggacggcttcatcatcctgaccatggacggcgtggttcgatacgcagccccgaacgccatcagctgctttaggcgtctcggtctgctgaccaccatgcctggccattacctcagcgaactcggcacacagctattgaaggagaacgaccctgttccggaaaccctgccgttggtgttgacaggcaaagccgcggtcgactccgaactcaacgccaaccgttccgccgtctcgatgcgctcgttgcccttgtatgacaacaacggccgtatcggagcgattctgctatgccgtgacgtcaccgagctgcgccgtcgtgagcaggagctgcagaccaaggacgctacgatttccgagattcaccatcgtgtcaagaacaacctgcaggccgtctccgcattgctgaggcttcaggctcgtaagaccaagtcggatgaggtcaagaaggaattgcaggaggcgcaacgccgcgtgcagaccattgccatggtgcatgagggattgagccagaccgccgacgaggtcgtcgacttcgacaaggtgatcgccaacctgctgcgcatggccgtggacctagccacgatgaaagaccagcacatcgatatcaactacatgggcaagttcggcatgatgcccgctcaggatgccacgccgctgtccctcgtgctgaccgagctcatcaccaattcggtggagcatgggttcgaaggccgcaaggatggccatatcacgatttccgtgggccgctccggcccgaacctcaatgtggtggtcgaggatgacggttccggtctcggctccgaagaacagggtggattggctcgttcttccggttccggtttgggcacgcagatcatcaacacctttgtgaccaatgatttcggtggttccgtgcattgggagccgcgccgcgaaggcggcacccgcgtggtgcttgatatgaagctcagggctgctcaggacgagtgatgcgaagcccgaaatgaggaaaccctcccaagcgggagggtttcctagtatgacgaagcgataatcaaaacatcagatttgcatctgcatggcctgagaacggcgggcgcgcatggcgcggcgcttcagcgcacgacgctcatcttcgctcaagccgccccacacgccgtaatcctgattggtgtccagtgcgcacttcaggcatgcgtcaatcactttgcaggtgcggcacacggccttggcctcctcaatctgctgataggctgcaccggtgttgcccaccgggaagaagagttccggatccttgtcacgacatgcggccttggctcgccaatcaaaagcgctgctcattgcttgcctcccttaaaagccccgtggctggtgttgttccttaagtccagtaccaaggtaaccacgaaccgtggtgattttcaagaggttttgccgagaaaaaaccgaagttttcacgaagcgcactgcaccagacatgccgatgtgccctcgatgagcacggcccggcccgcgttgtcggcatcgatatgactcatcatatccaataggcgagcggggactccggccataagatcggacgttctctccccgcacgggaacacgattctggtattgcaatgctccggtatacgtatcgggcgaatcgtgctgacggcgaataccacgctgacggactcatcggccaacgcatgtgtgaaagacagcgcctgctcgtcggtgcggaatgggtcgaacaactcatcggcgtcgtcgacgaaccacacgatatgcggaggcggtggtgcatccgagctggcatacggcgtgcagcggccgccatgaagccattgcgagctccatacccgacgatgcggggaactgacacgtaccgccaagccatcagccatgctggcgtgtcgagccaatgttttcagcaacgtggttttgccgcgcccctgcgggccgatgacaccgatattgccaccggtgagggataccgtcgcctctcgcaggttgatgccatcgtcggcaagtccaaatcgaatgcgttgcggtgcgtggtcggccacagtccggtcttttacgtgccgggggagtggcgcggtaaacagggacggttgcggcgggcttccgacgaaccgcgatgcgaacgcgatctggcggcacaccgcatcgatatcgcgtgccgttgcacagcggaatgccgtcacctgttcggaatcgttgcagaacgccgcaccgggcattgccggactgaggtcggcggcacgaccatcgccaagcagctcgcatgattgcagacggtcccgaacccgtaaacaaatgctgacggacatattcgccttcatatcggcactgacctgacccatgggattctgcgtacaggcgatcagatacatgcccagtgacctgccgagcgaggcaatacgcaccagacgattcacataatccgggagctggtccttcagggcatggaattcgtcaatgaccacgatcaggcgcggtggtggattgaccatatcgcggatatcggaagcatggacagcggcggacagctgttcacggcgtgtcagttcggcttccagcgcacgcaacgcgcgtacggcatgcgccagatccagatcgcatacgctgcccacggtatgcggcaaccgttcgagtttgcggaacgcggaaccgcctttgaaatccaagaacacgaaattcagatgctcaggcccgttcatcgaggcgagcgccagacaccagctttgcagcaacacggattttccggaaccagtggtgccggccaccagagcatgcggcccctgacggttcagatcgagcatcagcggctcgcttccggtcatgccgatcggcaccgcaaggtcaaggggttcaagccagcggcccacaatggcgcgccatggcaggcgtgcgaagtgcagcagcgattctatcggctgcgacggcgcatgacggaggtctgcggcgcggtcatcggcgtcgcccgtgataccgacatcgatcgttgcctgttgcggatcgggagccttctccgggcctggaggcgaggggagcgtcagcagcagggacacgagacaggcgaatatgcccggtgcgatcatggcggcgaacagccattgcccgtgcaacagcagtatgaccatcatcaatgcctgcgcgatcatcgggcatgccgcggcaaacatggtcaggcgggcgcgcaatggcggcgcgcccaaacggtgcttcgcccgggatacggcggatgccgtatggacggaatgtcgcttcgaatcgttctgctgtgatgtcatgcttccagcgtgggggaacgcatgccgaaagcgcaagccgaatcaaggtatgtggttctagcttgccgagttatccacatgacattttgcccgtgcatgattggcggtgtaggcaacggtgacgatcatgcgccgatgatgaagccgatgggctccgggaaagcgtcggtcagccttccgccagattgcccacggtgccggccttatacgtgccgtcggcaagttgattgaacagttcggtgttcttggcgtcgtcaagcagcaccgaggaaccaacgccatcaacgtaataatcggggtcggaccagtacacgctgccggagatgccattcgagccggtggcgcttttgaacgccaacgccatggtgagcaacgtgtaagggttggtcttctcgtccacggtgagtgcgctcatcgcggcattggacactgccacgattttggacggattggtcagggtctcactgctggaagccttcttgacgatggccgagatgacctgtcgctggcgttcgttgcgtccgaagtctcctcgcgcgtcggcatatcgcatacgagagaaggacaatgcggtggaaccatccgccgtatggcatcccgccttccagttcagtccggaataggaatcctgaacatcctcgtcatagcacagttcgataccgcccaaggcgttcaccacgttctgcagaccgccgaacttgatctgtgccacatgatcgattttctggccggtgatctgctcgacgttgcttaccaaagccttcttgcccgcaatcagcgccaccgcattgattttcatgtactggttatcgacgttcatgagcgaatcgcggggaatggaaaccaacgaactcggcccgcttttgggcttgatcagcaccagaatcgtatcggtcctgaagccagagatattgtctacgccgccgtaatcggtggaaccgtcacgctcatcggagccaagaatcagccaagtcgaggccggcgtgttgggggtgtcggtcagccagtcgctccgattcagtttgctgtccacccattgccaggcaccgaaaacggaaagaatcaacgccgccaccagtaccgcgattgcgcatagggtgatgcgtaaggctcgcggacggcgtgccgttaccgttttcgccgttgccgccgccggccggccaagatggctgaacttcgtggacacgtttgctgctggcgatgagggccgggaaaccggcatatccgacggattgcgcacggcgttgcgggatgagccggaagacatccgcgctcgcgacggcggaatgctgcgcggtgcggcggcatccggagccgtgctgcgagtggcgcgtccggttttcggagaaaaactgggcggagtccgcctgccgttgtccgcgacgttggcgcttgccgtggcgttggcgttcagttgaggctcttcgatgtcatttcccgtgacggacggacgggccgatggagcttgacctgactggcgcgaggttcgggcgggggcgaaggagcgtggcacctgcccggaaggccgggtgcgtcgatttcccgcaggaatgaagcttggcgggttgatatgcggatccgccccacctgattcctgcgtcataacccctcctgaaactgtcgattgtctgaatgacactttgacacagcatccgccgggtgttcctgcgctatggtgttcctgcgcaggaacggcacaatatcatgtgcaacggcgtcagggcatcgcgttcacgccatagcacacagttccataaaaatgatgtaatgacacgagaaagaatttgacaaaaccgaaattgcatgtgtgtaatttagtccgtatgaaaagctcaataggcaaggagaatcgcatgtggggtgtggtcgacgattcagccgaagagccatggcacgaattgtggggactattccgacctgatggcgatgtatcttggcagcacaaggcgttgtgcgcgcaaaccgatccggaggcgttcttcccggaaaaggggggctcgacccgtgatgccaaacgtgtgtgcgcaaaatgcgaagtgcgtgagcaatgcctgaaatgggccatcgaccatgatgagcgattcggtatttggggtggcatgagcgagcgcgaacgccgtcgatataagcgagagcaccgggagcgggcgtagctccacacacccccttcaagtctggtgcgtacactgggagtttatgagtccgacaggtaatagcgatattcatgaggcgttggccgacgccatgtcttctcgaccatatacgcataggcaggatgtggataccggcattacggctgtgatcaccgttgaggaggatatgcgtttcctccggtctacattgcgttcggtattgacgcagaatgttcttccgggggtcgtcatcatcgccgacgcgaccgggcgcaccagttcgaggataaccacctcgttcgaggtcatcccctcgccatcggggccggtgatggaggtgccgcagtccaagcatgtgaccattcacatcgtctcggccaagggcgcacgctccttcggcgatgcggtcagccgggcattggatcgtgccgatctggatgacgctccccgcgcattgtggctgctccatgatgattcccgcccttcggatgactcatgccttgaacgattgcttgaggcgtggcgcaatacgccgggcgccagtgtgctcgggtgcaaacagtgcgattgggaaggctcccatctgcatgatgtcggtatgtatgcgggtcaccacgccgtgcattccctggtggtcgatggagaacccgatcaggagcagtatgacgggcggcaggatgtgtttgcggtgtcgctggcaggcgcgctggtgtccatgtcgcaattcacgcgactgcggggcatcaatgcctggctgaccacctacagcgaatcggttgatttctgccgccgtgtctgcctgagcggcggacgcgtggtggttgtcccgcaagcggagatatcacatcgtcgcgcacggtatgagggcattcgtacgcgaggcggggaaccgcttaaggacgatcacacggtcaatcatgcgatgacggtgcatcgctcccaacagcggtatctgtacacggacctggccatgtcgtcctggtttatcgtctggctgtggaggctgctccgcagttttggcatggccatatccatgatgttcggcaagaagccgtatgaagcatgggtgcaattgtgcctgccatggctggccttggccgatatcgcgggaaacatgaaatcacgcagtctggtggccagacaatcgaaggtcgccgcatcgtccctgcatgtcttgttcgcagacagccagcagatcaagcagttccatgatcgtcgggatgcattccaatcccagcagggcagagtgctgctcagtccgctggaacgtgcccatctgcggacacgcaccatatatcgctggagtgcggccgtggtgatggcgctggtgtgctttgcggccatcgcggtgatgtattggccggtgttccgttcgatattctccggcggatcgttgtattccgatgtgttgcttcccaccggtgccagcttcacgcaactggtgcagtccgccaccacgccgtgggtgtttggcagcggcaccggcattcctgcgccgcccacgccgtggctgctggtgctgatgctggcctcgttggtcacgctcggccatgtgaccgccgctttggcgatgatactgtttgtggccgcgccgctgagcgcattgtcgttctgggcgctggcgggcgtattcacccgctcggacgtggttcgtgtgctgggaggactgctgtgggcatccaccggcattatgttcggctggtatgcgcaggccaatatgccgatgcttaccgtaatggtgttcctgccggccgcgttcgcattcgtgttccgtgccgtgggcatgtaccataccgaagacccgctcaagccgcgcacatccgttcaggccgcggccatcgccgcactgtgcttcatccctgtggtggccgctgaaccgcagctgctgttcgcgctgatcgtcgtgttcctgatgttcctgctattcgtgcgtcgcaagcgcgccatgctgttgctaattccggttcctgccgcctttgcggtggctcctacgctcgtcaatgcggtgcgttacgccgatttgggcatgtggcgtcaactgttcggcgacatcacggtgccaacgtcatccgccaacgggtcgccggcgtcgctgagtctgcttgaggccgcacagcgtgcgctgggatggcgaatggggtcgactgattatgccgatttggcggtcactgtgctgtttggcgtcatcacgctgcttgctcttgcttcgctggtgctgccgttcgcgttgcggacctcgcgactgatgtgggtggtaatcgtctgcggaggcgcgctcgccctggtctccagccgtgtggccataaccgtggatgccgatggtgtcgtggccggttccgcgcagccgggcatcgcgatgatgatattgggcttcctcgcctgcgtgtgtctcgtcgctggtggggcggtgaagcgattccaaccgttgcatgcgtctggcagtgatcccgcatcgaaaaaggaccgtctgcatgtgctcatcgtgtctggccgtgtggtgcttgctctgatactggtgtgctgcattggcatccaatgcatgtatggcatcgaacgtcataaggatgcgggactgggcgtgtctgaaaacggcctgcccatggtcaccaccgattatctggaggccggtgccgatcatcgtgtgcttgccgtgagcgcggagacccgcaacatcgtcaactatgcggtgatgcgcacctcgcgcggcgatttgatcgacagctctccggtccagcgggcgcgcctgctgtccggcaagcatgatgcggttgacgaacaactggcccaggcctgtgcctcgctgctgtccaatcccgacgaagaggccatcgcggccatcagcgcgcttggattcggcggcatctacgtggttcccgagaccggcgattccttgaacgacatgccgtatgaacagttgagcgcgaatatcgccgcatcgaacggcacccagtccctggtctccacggatagcggcagctactatcgtctgacgctgcgtagcagcgcctcacagcaggtggatacctcatggcagcaacgtgcacagcatagtgtctggaggcacgcctggctgatatgcctaggtgtgatcacggcgttgtactgcttggtcgccatgcctcgcagacgaccgtcctacggattggaggagcaggcatgagcaacaaaacttctggtttcaaacgtgcgatcggcatcgtgctcggtgtgatcaccatgctggtgttgattgcgctgttcgtcgttctcgtcatggcccccatccccaatatctgggtggataaggtgaccgcttccgataatgccatcgaccagaccgttagtccgacccagtccgaaacctactgcccggcacctataggattggccgataccggcacgtacggcgacagcgccttccaggccactgtcggcaatctgagcacacaagcgcgctatgcggcgttcggctccgtctacagcgccactgtctcggcgatcggacaaaagtccagttcagatgacgtaactttgaaagacgccgattcgaccgacgattcctcggtgaaaaccggtgctcagaagatcaatcagggagctcgtctgatcaatacccgtatgctgcaggccgcagctggcaccggcaccgtcggcaccatcgcatcatgggccgatgatggcgatgtgagaggcatatcggcggcatcctgcgtatcgacctcgctcagccagtcgttcctgctctccgacagcacgaccggtaccacacagcagctcatcgtctcgaatctctccaccaagccgaccaccgtcgacattgccgtctggggttccgagacagccgggaaaatggcattgtccacccaatccacgctgtctgtgccagccgagggggagtcctcgatggaactgtccgccgcggtcgatgggcagcatggtctgttcgtgaccgtttccagcaaggagactcctatcgcgtccgtggtgcgcacggtgaccatggatggtctgacaccgaagggttctgatttcgcgctgccgctgccgaccgcatccaatgcatcggtggcgccgtccatcactgccggcgatgcggtcaccgcttatctgttcgccaaggcagacaccagcaccgggctgtcatggattaccgccaaaggcttggttcccgccaaagatgccaccgtcactgctgataaagtgacggcgatcgacttgggagaagctcctgatggggcgttgggcgtgatgtccaccgcagaggacgccgtgtcgttctccgtcaaggccacacgctccggtgactccggccaagccgatttcgcattggtcaatgccggcgagccatccgaattctcggggttggcccttcccgacggagtaaaggcctccatcacgctggccaatacgtccaatgcgcgcaggacggtcaccttgcgcgcctacgatgatgccggtgcttcggtaacctccaaggaaatcacactggatgcgaacgcagcacaaacgattgaagccggcaatctttccggcgatcatggcaccgcggtcgtgctgatgttggaggactcatccaagaaagtgagctggggagcgcggttcagtcacgattcgttgcaagacaaggacatcgccggattgtccgtcatcgacgcttcaacgctgatgcccgccacggttcatgtctgggctcggaacgattcctccatcgtcaagtagaagggtatgctcgccgaagcgtcagtttgatgatgtttcggcggcgatatagctgcgggccgtgccactaccttattacaagtgacacggcccgcagtgttgtcacaggccccagtcggggtcgatttcctcgggcctgcgcccatacaattccgctatgcgggccaccagctcatccctgacggccaattgcagttcgagcttggtaggtgcctcggtctgcaacggcatgcggtagagcacgactcgtgcgggaatgccgtggctggcggggaagcactgggacgtcatattcggctcggtctgccaaggcgtcggatccgaaggcggcacatcctccaccgcgaactggagcggacgtatcagttccggccacgcttggccgagcctgcgaacctgggccgccaccatatcgtcgaacatgccggtgcgagtgcggtaacggggcagacgggtgccgaacatcggggttcgtgtgccgcgaccgtggcggttgcggtagattcgtgcgttccaaggtggctgaagcatggttcccaccatagggcatggcggaggcaacatgcgttaggattggttcattggctgtgaacattcgtcaacgagggaggcacgacaaatggtggtacgttcgtggtccgaacttgatttcgataatgtctgctccaacgccaaggtgttcggtttcgatttggacaacacactggccagctcaaaacagctgatgaagcccgcgatgatcgaacggttctgtgcgttgctcgaccatacggtggtggccctgatctcagggggcggcatggcggtggtcacctcgcaggtgctggatgtactcaccccgaatgccaggcgcggcaatctgcatgtcatgcctacctccggctcccggtattaccggtgggatggcacgcaatgggccttggtgtatgcgcatgatctgtccgaagccaccgtggccgctgtctcggaaagtcttgagcgacatgcccgggaactgggattgtgggaacagcaggtatgggggcctcgaatcgagaacaggggcagccagatcaccttctccgctcttgggcagttcgcgcccgtagcggccaagcaggcatgggatcgcgataacacgaagaaacaggcgctggtcgaagcggtcaaggccgatctgccgcatatgcgggtcagggccggcggatacaccagtgtggatgtcagcgaatgcggcatcgataaggcctatgccgtgcgcaagctgacgcagacacttggcatacgggccgatgaaatggtgttcgtgggtgatcgcatgacgcctacgggtaatgactatcccgcggttgaggccggtgcgatcggtgttcgtgttgagaatccgcaagatacggtacaactgctggatgcactgcttgcgcgattcgatactccagctcgatagtgacgcgttatggacgggccgagcgtatacaagtggtggcatgcgatgtgggcacaggtctgcaatctgctgtttccacgcggctgcgctgggtgtgacgcgccggatgaggtattgtgtgcggcatgctgggccctgttcgcgcaatgccgggaacgggatgcagacagtggtggcggagcccgtatatggtccgcatcgatttatcagggagcggtacgtcgtgccattctcgactggaaggaccacgacgataccgagcttgacggcccgttcggccgcatcatggtgtcgctgctgaacaagacgccaataccatcatcatgcttgggtcatcgcgtattggtggttccggtgccatcatcgctggcgtcaatgcgccgaagaggacgtgcccatacggcaccgttggccaaatcggtggcaggggcattgcgtgggtgcggcgtcgatgcgcgaccatgcaatgccctgagctcctccaccaaggcacgctccgtgcagcaggtctcttcggcacagcgtgcccgtcgtatcaccggtcatgtcagggtgaagcgtgatctcatcggccatggcgacgcggtgcttctcgttgatgacatcgtcaccacaggtgccaccgtgcggcaatgcgttcaggcgtttcagcaggccggcaccaaggtggtgggcgtgctggtattggcggatgccgtggtgcgacggtccgatgacgatatcaacgggtgaatgacatcggttacgatgccccagatagcaggcgaagcgccgttgctcggcatgtaatcggggtatcgcggattctcggcgtgcaatatggtgatgccggcccgtgaaaccagccgcttgatggcgatttcgtcgtccatgacagccgcaaccacatctccggggactggtgttaacgaacgatcgacaatcagcagatcgccgttgtgaataccggcattgatcatggaatcgccggccatctgcataacaaacagcgtggcctcgtgcgccatggcctgtgactcggattgctgtgtcatgctgcgcctcccaccctgtattcgaacatctgttcgaatacagtatacggtaggacgtcggacaatatcagcgttcggcgatgtgatatttaggcaggatgatttcgaaatcggcacctcgcgtgtcgtcgaccactttgacggtgccaccgtgcaattgggccgcccagcgcgcgatggacaggccaagaccggtgccgcccgactcggtgccgggacccgtcttgcctttgacaaagcgccggaagatgtccaaacggtcggaaggcgcaatctgggagccgaaattcaccacattggtcacgatggtgccttggttttcgtcctcgtgggcgtcgaccagcacggtggtgccgtcggccgaatgtttcagcgcgttggcgatgatgttggtgaatagctggcgcaggcggtcctgatcgccttccatcgtgatgtcggccggcacggtgacgcggatgtcgtgggcgtggccaccatcggcgatttccaacggctcgatggtctcgtcaagaaagtcggcgaagttgaacttttcgatattcagactcgccgcaccggcctccatacggctcaggtccagtaggaaggcgatgagatcggagagacgctgcgtttgggtgaggatgctctccagattggtgggagtgggctcggtgacgccgtcggccatgttctcgaccatcgcctgcaaagcggaaacgggcgtgcgcagctcatggctcacattggcgatcatgtcgcggcgcattttatcggcatgctcgagttcgccggccatctcgttgaacgagcgagccagcttgccgacctcgtcatgacgatcctgatcgatatccacgcggaccgtgtaatcgccatccgccatggcttcggccacatcgcgcatctggcgtaggggagcggtgatgccgcgagagaagaaataggtgatgcccaaggccaccaccaaagtcagcggcatggcgatccaaccggaccagccgaatttcaggaggaaccagcacatggcaaacgcgatggcagtggcgataacgatcagtgcgctgagttccagcttcagagatgagaacaaatcaaccggcttgacgcgaggtttcatcgcatcaagccgggattgctgttgttttttggatgccatcacgcggtcggcggctcgaaagcgtagcccacgccatgcacggtgcggatggtatcggcaccgagcttatggcgcagcgccttgacgtggctgtcgacggtgcgggtgccggatgcgtcgacccagtcccagacctcttcgagcagcttttcgcgggtgagcaccgacttcgggcggcgggccagcgtggccagcagatcgaactcggtgggggtcagatgcacctgttcgccgttcacggtgacgatgcgctgggccgggtcgatgaccatcgaaccgaagtcgagcagcttctcgttctccgagttcttggcgatgaccttcgcacgctccacgcggcgcagcagcgccttgcagcgggcgataagctcgcgcatggagaacggcttggtcatgtaatcatcggcacccgctcccagaccgatgaccttgtcggcctcgtcatcacgtgcggtgaggatcagcaccggcaccggacgttcggcgacgatgcgtttggtggcctctagaccatccataaccggcagcatgatgtccatgatcaccagatcggggcgtagctgggacgcggcctggacggcggaagcgccgtccccggccacgcgagcggtccatccttcagcggtgatgcgctgggcgatggccgtggcgagcgtgggctcgtcctcgaccaccagcaccgtgcgcggtgtcgtattctgacgcgctgtggtattgagcataaataaaccggttacctttcagcctgttgaccagttcagtcttccggcttcaagaatacaactcccagagccggaacggtgatcttcgccgagaacggacgtgaatgatattcgccctcgaccgcttcgaaggtgccgttgtggatgtcggagccgccgtacttggcgtcatcggtggtgaacacttcggtccacttgccgccggtgggcagcgccacctggtaatcggaccaggcctcaccggagaagttgaccaccacggccaaggtctcgcccttggtaccgatgcgcaggaagctcagcgtgttgtggtcggcatcgtcgctggtcagccactggaagccggccgggtcgaagtcctggctccatagtgccggatgcgccttgtagaaggcgttaaggtcggcgaccatggtctggacctgacggtgctcctgccagttcaggcaatcccaatcgatggaggcgtcgtgatcccactcgccccactgggccagctcgttgcccatgaaggagagcttcttgcctgggtgagcccactgataggcgaacatcgaacgcacgccggccagcttctgccagtcatcgcccggcatcttgccgtacagggaacccttgccgtacacgacttcgtcgtggctgatgggcaatacgtagtgttcggagtaggcgtacaccatggagaaggtgatctcgttgtggtgccacttgcggttgatgggctcctcgtgcagatactcgagggtgtcgtgcatccagcccatgttccacttcatgccgaagccgatgccgccggcggaagtgggggcggtgatgcccggccatgcggtggactcctcggcgatcaccatgacgccggggttgttcttgtacgcggtggcggtggcctccttgaggaagtcgatggcctccaggttctcgcgtccgccgtagatgttcgggcgccaatggccgggttcgcggctgtagtcgaggtagagcatggagctgacggcatccacgcgcagtgcatcgacgtgcaggtcctcaagccagaacagggcgttggccaccaggaagttgcgtacttcgcggcgtccgaagttgaacacataggtgccccattcagggtgttcgccgcgcagcgggtccgggtcctcgtacagcggggtgccgtcgaagcggccgagcgcgaaggcatccttcgggaagtgggcgggcacccagtccatgatcacgccgatgccggcctgatggaactggtcgaccaggtaacggaagtcgtcgggggaaccgagacgggagtcgaccgcatagtagccggtgacctgatagccccaggagccggagaacgggtgctgggccagtggcatgaactccacgtgggtgaagccttcctgcttgacgtagtccacgagctgcttggccaggtcgcggtaggtcagtccctgcctccagctgccggcgtgcacctcatagatggagaccgggccatcatgcgggttggtggtgcggcggtgctgcatccaggcgtcatcgttccacttgtaggtggattcggtgacgatggaggcggtgttcggcggaacttcgtgctgacgctccatcgggtcagccttcatctcccacgtgtaattggcgttcaggatctggaacttgtaggtctcgcccgcgccgattccggggatgaagatctcccacacgccggaggagccgagctcgcgcatggcatgacggcggccatcccaagcgttgaagttaccgactacgcgcacggcatgggcgttcggggcccacacggagaatgcggtgcctaccacctgttcgccgggcgtgccgtctgcgccgcccatcggatcgtcatagcgcagcacatgcgcgccaagcgtctcccagagcttctcgtgacggccctcgccgaacagataggtgtccatgtcaccgactgtgggcatatagcgatatgggtcgtcctcaatgagcactgcgccgctttcccactcggtcctgacacggtagtcgggaatcgtgggctgcttcttagtgccggaagccggcacggtaaccacgaacacgccgttgtattcgtgggtcatcgggtattcgccatcctgggtgaggatggtcacggacttggcaagcggacgcagcacgcggattgtggcggtgtcggcatgcttgccgatgccgagatgcccgccgagaactccgtgggggttgtagaattcagcattgctcgtcgcatcgaggtcgccttgggcgacaggcacggtgacggtatcttccttgattttcgtttctttggccatgtcccaaagtctacgtgcgttgaagtcgaaaacgctacattggcgcgtcgaaaatggcgaattcttgcccttttcgttgtgtttccgtggttgtgagcgctctcataggggtggtccagaccgcatggcataattattcgagttttcgtgtgtaagccgtcagttctcggagggtacatgtcttacaaagtcggcgatatggtcgtctatccgcgtcatggtgcagcgaaggtggaggccattaccgagcggacggtcaagggagtgacgcgcgaatatctgcagttgtccgtactctcttccgatggtttggtcatcaacgttcccgtggacaatgccaagaaggtcggtgtgcgtgacatcgtctccgcatccgaagtggccaaggtgttcggcatcctgcggaccccgatcatcgagaaagagatgaactggtctcgccgttacaagctgaacgtcgaaaagatcgccaccggcgatgtcaacaagatcgccgaagtggttcgcgatctcgcccagcgcgatgtcgacgagcacggcctgtccgcgggcgagaagcgcatgctcaccaaggcccgtgccattctgacttctgagatcgccttgtccgagaagatcgacgaggcggaagcccagcgtctgctcgacgtgaatctgggctacgagcccgctcagcccggtgacgacaagcatcacaccgccgagcccgaagaggccgcggccgatactttggctcgtgttgaagccgagaagaagtccaagaagaagtgatttgattgttttgaggccccggtcgtgtccttatgcgatgcgccggggcttcgtgattcataatcgtttgctgccgttcgtctgggcaacgccatcgaaggggactgcatggggtctgtaggagtgctgatagggcaaggttttgacgctcaccgttttgcgcctgctggctcaggccgtgaactgtggattgccgggctctactggccggtgcctgattcatgcagcgaggccgatgccgccaaatacgaggggatcgaaggcgattccgatggcgatgtggccgcgcacgctctgattgacgcgttgcttgccgccgcccgattgggagacattggttcactgttcggtgtcggtgcggacgcgcatggtgccggaatgcatggcatcgatatgttgcaagaagttgtggcgcatctggcatccaacgggtatacgccggaatcggcctcggtggcgatcatcggtaaccgcccgaaaatcggcacacgccgtgctgaagccgaagccgccctgtctgcggcggttggttgcccggtatcggttactgccaccaccaccgaccatatgggattcactggccgcggcgaaggcatcgccgccatcgccaatgccttggtggagaagatataacaaagcccccgctatgaattcgccagcgggggcaagaaaaaatggatgagattacttccgcatcgtctccacggctttggcgatagcccagaacagggtggaaagcgtcacgatgatgaagctcgggggagcggggaacatcgccgacagcacgagtccggcccaaatcgacaccaagcacagcacgctggcgatcaccattgccttgaatggggagccggccagaatattggcggtggccgcgggcgtaatcaccagtgcgaaaatcagcaaggtgcccactgccggcacggcgatggtgatcacaccggccataatcgccataaacgccacgttcatcagcccgatcggcacacccttggcctgtgccacctgctcatccagcgagctgaacagcagcgggcggtagatgatggccaacaatgccagcagcagtacgtcgaacacggcgaagccgatgatctggccggtggtgatggtcaggatcgagccgaagaggatcgactgcatctgctgggaggcggaactcgacaatcgcgcgaagaacagacccaagccggtggcgaaggccagcacggtgccggtggcgatttcacgctcggaaacgcgcttgcccaaagcaccgatcaccagtgcgccgcccagtgcgaacacgcccatgcccagtgacacgggcaggccgagcaacaccgcgccggtcgcgcccggcagaccgatatgggccagcgcatgggccgcgaaggtggaacgacgggcgatggtgaagtatcccatgacaccggcggctagggcaatgcacaggccggcgatgaaggcgttggtcatgaatggagcggacagtgtatccagccattcgggatcatacgaaaagttgatggtgctcatgtctctgtattttctccatgcctgagctgcagtccgttgatgggctgtgggtcggctcgcttgatgttatcgattctcggcgctgatggcggcactgccattggtggcattgccgtgctcgtgatggtgcaattgcgccacttcggctgccgtgtgcatatcctgcggctggtcctggagctcatccggcgtcggggtcacgaacatgtctccctgcggagtggtgaccacctgcacctgtgtgccgtagaggtgggtgagtaggtcggagtcgagcactttgtgcatatcggcgtagtgcgggtgaccgtcgagcaagtagacggcaccggtcagaatcggcaagagcatattgagatcgtgcgcaaccacctggatggtcatgttcagttcgcggttcagcttggccagcacgtgtacggtggcgcgctgactggccagatcgaggttggccaacggctcgtcaagcatcagcagttgtgggtcgcacaccaacgcctgggcgatggccacacgctggcgcaaaccgccggacagttcggacagacggtaccgcgccttgtcggcgatgccggtgaactccatcgcctcgagcgctttggctttctgggccttggtgatggggtggatgccgaatcgggtgccggtcaggcccagcaacacggattgttcggcggtgagattggaatcgacattcgccacatagctctgcggcacatatccgatgcgtttgttcatctcgcctgcgggcttgcccagcacggtcaggctgccatgacagagcggcaaaaggcccagctcggccctcatcatcgtggttttgccggtgccgttggtgccgacgatggccgtgaccgaaccggtgggaatggcgaaggtgccatgctgccagatgatatggtcgccacgcttgatggcggcatcgctgaacacgatgcaatcggaagtttcactcataacgcccgattgtggcaaacgatgctgacaatcgttctcaatatcgtgtacggatggtgataaccaaagagaagggttgtgcggccatctcgacaatggtcgcacaacccttctcatgcaaggcgtctattggcattggcacgaatccgatgccggtgtcctttgcttctaactatttgccggagtcggtctggtcgttgccggaggcatcgccggaatcgccattggcggcatcggcctttgccgaatcctgagatgagtcactggatgcggccgccttgcactgacggatgtacttggggtccgtgctggaaccggtgctggccttggagtcttgcgcattggcatcatccgtggcggagccttcggcgctggaatcatcggaattcgcgttgctgtccgcggtatcgccgtccgtggcgtcttcgcagccatagcttggatccaccgcgtcgatgatggtgttgatgagctggttgatccaggcgttcagcgtgtcggcgtccttgggcatttgttcggagacgtcgactaccggcacatcggcgcgaccggcagcgccagtgatcatattggtcgcgtcactggcttcctgcgtgttgttgaccagcacatccacgcccttgtcttcgatgagtttctggaaagactgcaggtccgcgggtgccggttcgccgccggaagcggtcgattgcgtataccccttgggcgtctgatctttgaacccaagatcggccatcagataatagaccacgggttcggtggctgcataggtgaggtcggagtgggacttggtgaactcggacgcccatgtttccaacgatttctcgtccgcctgccatgccttgagccgcttctggaaggctttcttcttgctggggagtgcctttatatatgcatcggtgatggccgtggccatgctggatcgagcgtctttggagaaccacagatgcgggttatcgccctcgacggcacccatgacggaagcggcggatacgatattcgtggtcttggtcatcgatttggtggcccaggaatcgtagcccgcaccgttggccacgatgatttgggccttggacagcttggcgacatccgaggtctttggctcgaaatcgtgggcatccacattggtggagttcacgatggacgtgacttccacatcatcgccgcccagctcggcggccagcgagccccattgattgagggaggccaccacattgatcggcccggtcggtgcgggaacgctggtcttgttgtccggctcggtttcagcgggggaggtggctgcgcatgcggtggtcgcgaacaacaggacggcgctcaggccggctgcggcgagtcgcgtaagtcgtgtgatttgagtccccatggcacgccttcttcgtgagagcgaacgatatataatcctgacttgttccaacgatagcctatcgtttcgatagaatgcaccgaaactacaggggagggcgttgatgtccacaaaaatcgacggtaagcagattgcggccgaaatcaagaccaaccttgccgagcgagtgaacaagctcaaggcgcagggcatccaaccggggctgggcacgctgctggtgggcgaggaccccgggtcgatgaagtacgtggccggcaagcacgccgattgccaggaagtgggcattacctcagtcaagaaggaactgccggcggacgccagcttcgacgacatcgccgctgccgtacgcgaactcaacgaagatccggcttgcaccgggttcatcgtccagctgccgttgcccaagggcatcaacgagaacgcgatcatcgacatgatcgacccggccaaggatgccgacggcatgcacccgtacaaccttggcgaactggtgctgcatgtgcgcggcgacatttcgacgccgctgccttgcactccgcgcggtgtgctcgagctactcgacgcctatgacattgatctgaacggcaaggaagtgtgcgtgcttggccgcggcatcaccattggccgcacgattggcctaatgctcacgcgcaacgccgtcaacgccaccgtcaccctgtgccacaccggtacccgggatgtggccgaccacatgcgccgcgccgacgtgatcgtcgccgcaatgggttcggccggattcgtgacgcccgacaaaatcaaggacggcgccgtgctggtcgatgtgggcgtcagccgcgtctacgacgaagaagccggtcgctaccgcatcaagggcgacgtggacaaggcctgctacgacaaggcctccgcctacacccccaaccccggaggcgtgggtcccatgacccgagccatgctcctagccaacgtcgtggaaatggccgaacgacacgcctagagtttcctaggaaatttgggcagagttgcttgtattgtgagtatctgtatgcctgtagggtgtgcgtataactgaatatcgagaaattatccatccactattagaaaccatatatttacatggcagagaacaacactgaagtcaccaaggttgccatcaacgacatcggcaccgaagaggacttcatcaaggcagtcgattccaccatcaagaacttcgatgatggtgatctggttgagggcaccgtcgtcaagatcgatcacgacgaagtcctcctggacatcggctacaagaccgagggtgtcatcccctcccgcgagctttccatcaagaaggacgttgatcctgacgaagtcgtcgaggtcggcgacaccatcgaggcccttgtcgtcaccaaggaagacaaggaaggccgtctgattctgtccaagaagcgtgcccagtacgagcgcgcctggggcgacatcgagaagatcaaggaagctgacggcgtcgttgagggcaccgtcatcgaagccgtcaagggcggcctcatcgtcgacatcggtctgcgcggcttcctgcctgcctccctcgttgagatgcgtcgcgtccgcgacctctccccgtacatcggccagaagatcaaggccaagatccttgagctcgacaagaaccgcaacaacgtggtcctgtcccgtcgccagtacctcgaggagacccagtccgaggtccgcgagaccttcctgtcccagctcaagaagggccagatccgtgagggcgtggtgtcctccatcgttaacttcggcgctttcgtcgatctcggcggtgttgacggcctgatccacgtttccgagctgtcctggaagcacatcgaccacccgtctgaggtcgtcaaggtcggcgacaaggtcaccgtcgaggtgctcgacgtcgatctcgaccgtgagcgtatctccctgtccctgaaggcgactcaggaggatccgtggcagcgcttcgctcgcacccacgttcccggccagatcgtcaagggcaaggtcaccaagatcgtccagttcggtgtcttcatctccgtcgaggacggcatcgagggcctggtgcacatctccgagctcgccaaccgtcacgtcgagaacccggagaccgtggtcaagccgggcgagaccgtgttcgtcaaggtgatcgacgtcgacctcgatcgtcgccgcatctccctgtccctcaagcaggccaacgactccgttgacccggcttccgaggacttcgatccggccatctacggcatgccggccgagtacgacgagcagggcaactacaagtaccccgaaggcttcgacccgaacaccaacgagtggatcgctggttacgagaagcagcgcgaggagtgggagtctcagtacgccgccgctcacgagctgtgggaggagcacaaggagttcgtggccaaggagctggagaacgctgccgaatccgcagccgccgacggccagggcccgaaggaagagaagccggtcgaggagacctccaactactcttccgctgctccggctaccggtaccctcgccgactccgatcagctcgccgccctgcgcgaccagctgctcggcaagtgagtttgccgcgaagctagcgcttagcgtgtaaagaaacccggtccgattgggccgggtttcttgtgtttttggagttatccgccaatgactcccctcagtctcgctacgcgagccggctcccctccctgaggggagctgtcggcgatagccggccgaggggagcgccagctatcatgggcaccatgatgcgaataggactgaccggcggcatcgccgcgggcaaaagtacggtggcggcgcaactcaagcaactcggcgcgttgcatatcgactacgatgcgctggcgcatcagatcgtcgaacccgggggagtggcgctgccacagatcgtcgccgagttcggtcctgatgcattgctcgccgatggcactatgaaccggccatggattgccgatcatgtcttcggcgcgaacgccgcgccgggcgcacgtgaacggctcgacgccatcgagcacccattgatctatgccgaggcggcgcgactggagcatgagcaccccgaggcagccatcatcattcacgacattccactgctcgccgaggtcattgacgatattccattcgcctttgaccatatcgtcacggtcgaagctcccgtgtgcatgcggctcgaccgtatggtcgaggaacgcggcatgagcctggaacaggccgaggcccgcatccgccaccaatccagtgaggaggagcggcgggccatagccgatatcgtcatcgactccacccatccattgcccgagatgctggcccaagtgggtgagatatacgcaggatggtgcgcaggtcgctaagatgaggccctatgggattcaatatcgagcgcgcggacaagcctttcgtcgtcaaatcgccatataagccatccggcgaccagccgcaggccatcgccgaactggccgaacgcatcgaaaacggcgagaatgatgtggttcttatgggtgccaccggtaccggcaaaaccgcaaccaccgcctggctgatcgaaaagctgcagcgaccgaccctgattatcgagcccaacaagacgctcgctgcgcagctatgcgccgaattccgcgaactcatgccggacaacgccgtgagctacttcgtgagctactacgactactaccagcccgaggcatacatcccgcagaccgacacctatatagaaaaggactccaacatcaacgacgatgtggagcgcctgcgccaccaagccaccgcaaacctgctgacccgccgcgactgcgtggttgtggccaccgtctcctgcatctacggcttgggtacgccggaagaatacgccggtcgcatgctcttcctcaaagtcgggcaggaaatcaaccgcgacgacctgctgcgccaattcgtggccatgcagtacaagcgcaacgacatcgccttcacgcgcggcaccttccgcgtgcgcggcgatacggtcgaaatcatccccgtctacgaggaactggccgtgcgcatcgaattcttcggcgacgagattgaccgcatctccacgctgcacccgctgaccggcgacgagatcgacgaggaaaacgaagtccacatcttcccggcctcccattatgtggccggccccgaacgcatggaacgggcgctcaaaaccattcgcgaggaactcgacgaacgcctggcagaactgcgcaaacaaggcaaggagctggaagcgcagcgcctcaacatgcgcaccacctacgatctggaaatgctcacccaagttggcgtgtgctcaggcgtcgaaaactattcgcgccactttgacggccgcgccgctggcaccccgccgcacacgctgctcgacttcttccctgacgacttcctgctggtcatcgacgaatcacacgtcactgtgccgcagatcggtgccatgtacgagggcgatgcctcccgcaagcgcacgctggtcgaacacggcttccgcctgccctccgcgatggacaaccgaccactcaaatggccggaattcctgcagcgcgtcggccagaccgtgtacctgtccgccacgccaggcgactatgagatgggactgtccgatggggtggtcgaacagattatccgcccaaccggtctgctggacccgaagatcgacgtacgcccggtcaaggggcagatcgacgatctgctcgccgagatcaaggcccgtgtggccaagaacgagcgcgcgctggtcaccactctgaccaagaagatggccgaggacttgaccgactatctgctggaacgcggcatcaaggtcgaatacctgcattctgatgtggatacgttgcgccgcgtcgaactgctgcgcatgttgcgcgaaggcaagatcgatgtgattgtcggtatcaacctgctgcgtgagggcctcgatttgccggaagtatcgctggtggcgattcttgacgccgacaaggaaggattcctgcgctcctatcgttcgctcatccagaccatcggccgtgcggcccgaaacgtgtccggcacggtgatcatgtacgccgacgagaccaccgaagccatgcggcaagccatcgacgagactgaccgtcgccgcgccaagcagattgcctacaaccaggagcatggcatcgatcccaagcccctgatcaagaagatcagcgacgtcaacgacatgctcgccaaggaggatgtggacacccagaccttgcttgaaggtggctaccgcaacgcgggcaaggccggcaacacgcacctgggcgtgccggtactcgatcccaacgaggcagacaaacgccacgaggagatcctgaaggccggcctgcccgcgcaggacctcgccgacctgattcgccaactgagcgaacagatgcacaccgccgccgaacaactccagttcgaactcgcggcccgtctgcgcgacgagatccgagacctcaaaaaagaactccgtcaaatgacggaagccaacaagtaaccaaattcccatacccgaggcgggcagtcaggggatgcgttgttcgaccgtaaagacttggcctgagcggcccggagcgtgtcgaacaacacatcccctgactgcctggcgatcagcgctaccggaacggcccccaaaaccgtcacatacataagttagtgtagggaatcatggcagaaaccccactcgcatttgaaatcatcaccttcgtggtgctcgcgttgttctttatcgtcgacctgttcgtcatcggacgccgaccgcatgtgccctccaccaaggaatgcgtgcagcatatcgccttcttcgtggttatggcgctgatcttcggcggatgcatctggttcttcgccggctccaagcccgccatcgagttctattccggctggctcaccgaatactcgttgtccatcgacaacctattcgtgttcgtcattatcatgtcgaacttcgcggtgcccaagcagattcagaagtatgtgctgtccatcggcatcaccattgctttgattttccgtggcattttcattctgatcggcgcggccctgatctcccgcttcacgtgggtgttcttcctgttcggtgccttcctgatctacaccgccgtcaaactggtgctcggcggcgatgaagatgaggaatatcacgagaacggcatcatccgtaatctgcgcaagatcatcaagattaccgacgactacgacggcgagaagctgcgcaccaccaagaacggcgtgcgttactggaccccgatgctcatcgtgttcctgaccatcggcaccaccgacgtcatgttcgctttcgactcgattcccgcgatcttcggcctgaccaaggatccgttcctggtgttcacctccaacgtgttcgcactgctcggcctgcagcagctgtacttcctgctgggtgctctgctcgacaagctcgtctacctgcctgccggcctgtccgtggtgctgggcttcatcggcgtcaagctcatcatggaggccctgcacggcaataccttgccgttcatcaacggcggcgaaggcgtccattgggtgccggaggtgcccacatggctgtcgctggctgtgattgtgctcgcaattggcggcgcatccgtggcttccgtgatcaagatgaagagcatggaaagcgctgaaaaggcctgaaatcgttagagaatacaacccttaaacccagtcaacacaacaatgtgagcgctcacaacacaccgtgaagaaaacttgtcatgagtcggctcgcgctagtagactgggtttcggcaaatggggcaatcgcgcctcgaaccaaattgaacaagaataggcaggcattcatgcgtaaagccaagatcgtagacaccatcggtccttccaccgaggattacgacaacctcctgaagctcgttgaagctggtatggacgttgctcgtctgaaccgctcccacggcaccccgaggatcacctcaaggtctacaacaacgtgcgcaaggccagcgaagccactggtcgcaacgttgccgcgctcgttgatttgcagggcccgaagattcgctgcggttggttcaagaagaacgccgatggcgaagacaaggttcagctgcagctcggccaggaattcgtcatcaccactgatgacgtcgagggcgacgagcacatcacctccaccaccttcaagggcctgccgggcgattgccacccgggcgacccgatcctgatcgatgacggcaaggtccgtcttgaggtcaccaaggtcgagggcaacaacgtgtacaccaaggtcgtcgtggccggtcctgtgtcctcccacaagggcatcaacctgccgggcgtcgccgtctccctgccggctctgaccgagaaggatgaggccgacctgcgttgggccatccgcaccggtgccgacatcatcgccatgtccttcgtgcgtttcgccaccgacatcgaccgcgcccacgagatcatggacgaggaaggccgtcgcatcccgatcattgccaagatcgagaagccgcaggctctggagaacctcgaagagatcgtcaagaccttcgacggcgtcatggccgcccgtggcgacatggccgttgagtgcccgctggaagaggtcccgctggccactaagcgcatcatcgagctggctcgccagtacgccaagccggtcatcgtggctaccgaagtcctcggctccatggtgaactccccggttccgactcgtgcagaggcttccgactgcgccaacgccatcctcgacggctccgacgccaccatgacctccaacgagaccgccgttggtaagtacccggatgtgaccgtggccaccatggcccgtatctccggctacgccaccgaccacggcttcgaccgtatcccggagctcaagaaccttgacatgtcctccaccggcgctgtctcctccgccgctgtggacctggccgacaagctcaacgccaaggccatcgttgcttacacccagaccggtgccaccgtgcaccgcgtctcccgtgagcgtccggccgccccgatctacggcctgaccagcaacgagcacacctaccactggctggctctgtcctggggcaccgaagccttcctgctcaaggaggactaccacgacaagtcccgcaaggatctcatggtctacacggacaaggtcctcaaggatgctggcaaggttgctgacggcgacaagatcgtcatcctgagctctgctcagggcgatcaccagccgggccgcactgactccatctacgtgcacaccgttggcgcttgcgactgatttcaggcttctggtagctgctgacagctagcatatagcacacgaaagcccccatccaaagtggatgggggctttcgttatctgttatgttgcgattgtgtggtgattgcaatggcccacagtcaccgcggtgatcgagcgtggcgatcagtcgttgagatgatcgagcgtgccgctcttcaggcgcaaaatggcgaccatggtcttggcatccacaatcgtgccattgaccaccatctcataggcatcgtccaccgacaccatacgcacgtcggaacgcggagtctccgggccgatttcctgacgggaagccggggttagaccggtggcgaagaagattgcggtgtgctgggtggaatagctcggcgtgttcataaaacgggtgaactgcgtaagcttggtggcgtcgaaaccggcctcttcggccagcttgcgcttagctacatcggtcgggcgttcggacgggttgttggcgtgaccggccggaatctccaacgtccaacgatggttggcgatgcgatactgctcgaccagcggaatcatgccatcatcggtgacggccagcacagccacagtgtcgccattgttctcctgaacaaagtagcgttcaaacgaaccgatttgattcgactcataggagacgtgatcgacattgaaataatgcgtctccacaatctgtctacgggaaatctccttgaccggagaggggcgccagggatcgaactgacggtaagtttcgttgctcataagccctcctaacaaaagcgatacatcgaaactacagcccattgtaagcggtgaaaccacgcaggagaacgggcaacacacgggtgcgccgtccgcgatatcgacgtgtttcgcctgtttcaccggggggaatggaggattggcgcgtgtcttgtgtcgcaagagtcgaattggtatgctactctcttcagagtgctttggcacgccctcgtatcccaattggtagaggaagcagcctcaaaatctgcgcagtgtgggttcgagtcccaccgagggcactttagttaggagttcgctgaaattattgtgaaccccattgtcgggtaattcaagaaagaggttggcatggctgcaaggaagaagtccgaagaaccgagtatcaacatcgatgaggtgctgaccgacgaagagctcaaggccgtggccaatgaaagcgaacctgctgagcgcaaggccaagcccgaggacggtccgcgtaccgttgtcgtggccgaggacgaagccgtgaaccgcatggatctggtcgccatgctggaagacaacggttatgaggtcgttggtcaggccgccaacggcgaggaagccgtggaactgacccgcaagtaccgccctgatgtggtgtgcatggatgtcaagatgccgcgtatggacggcatcaccgctgccggcattatctgcgatgaaaacatcgcccccgtcgtcatgctcaccgcattctcccagaccgatctggtgaagaaggccaccggcgctggcgccatggcatacgtcaccaagccgtacgaggaatccaagctgctgccgaccctcgaggtggccatgggccgtttcgccgagatcaacgatttgctggacagcgtggagcgcagcgaacgtaagctcaaggaaaccaccgatcagctcaaggaaaccgaagagaagctcaagaaggccgaagacacgcttgaggagcgcaagctcgtcgaccgcgccaagggtctgctgatggacaaggcggacttctccgagcagggtgccttccgttggattcagaagacctccatggaccagcgcatccccaagaagcgcctggctcaggccatcatcgccaagtacggcggtccgaagccttctgattcgggcgaacgctgattatcggcgtcgccgtactgagtcgtaaagcaacacaaacacactatgggagaggccagcgtgaccgtacccaccaatgaaacattgctggtggtggacggccactcgctggccttccgtgcatttttcgccctgccggtcgacaacttcagcacctccagcggccaggccaccaacgccgtctggggttttgccaccatgctcgcgcaggtgatcgatgcggagaagcccgaccatctgggcgtcgccttcgatgtgaagggcggcacattccgcaatgagatgcttccgcaatacaaaggcacccgtgaggcggctcccgaagagctgctcacccagctgccattgattcaacgcatgctcacggccctcggcgtcacctacatcgagaagccgggattcgaaggcgacgacgtgatcgccaccctcgccaccatgggagacaaggccggttaccacacactggtattgtccggtgaccgagacgctttccagctggtggatgacaacgtcaccgtgttgtacccgggccatcacttcaaagacctgaagcatatgacgccgcagtccatcatcgacaaatacaaagtcactcccgcacaatatccggatctggcggcactccgaggcgaaaccgccgacaatattcccggtgtgcccggcgtaggcgacggctttgcggccaagtggatcaaccaattcggttccctcgacggcatttgcgagcacgccgatgaaatcggcggcaaaaaaggcgaatcactgcgggccaatatcgaccaggtcaaactcaatcgcaaagtcaacgcactggtacgagacgtcgatctaggcgtcgatatcgaggatctgacattcggcaccgtggacgtggcacagatcgacgccctgttcaaggagcttgaattcggacctcgcaccaagagtcgtgtactgaaaaccttcaataccggggccaaggcatccaacacatccggagctggcgagtctacgaataatgagcagaacgagcaggatagcagcctcgatctgaacctgccggaacccacgagcatcactgctccggagcagttcgacgaatgggtcaaggcccatcgcgtcgaagtcaaggttcccggtgaaatcgccgatttcacggtttccgactatggcggtggctcgcagcggcatgccatctgcggcgacgcggtcggccacgcttggaccgtggccgcatggggcgacgaaaggccggggcgtgccacggcacaagccattgccgtggccacggcaacatcagcggccatagtgccccttccaatcaccgataccctgcgagcacagcttgcgcggttcctgaaaagcgaacactcccgcaccatcgtgcatgggtataaagaattgctgcatcttttgggcgcggtcgatcttgacatggacctgccgatgttcgacaccaagcttgccgggtatctggcccaaccggatttccatgccgatagcctcaagcaggcggccgagcacttcctcgacatccacttcaccgaaaccgaacagccttcgcaaggcacgttggacttcgacgacgatcaggtcgaagaagatccgaacgaacatcgtctgcgtgatttggccattatccgcagcctcgccgtcacgctcgggccgattatcgacgagcgtgaacaatgctggctgatgcgcgcgattgaacttcctgtttcccgcgtgctgcacggcatggagcacacaggagccaaagtcgatagcgttcgactcgtctccatgcgtgaccagtttgccgccgaggctcgccaagcgcaggaaatggcttgggagtatgccggcaccgaaatcaacctgcaaagccccaagcagctgcagaaggtgctgttcgaagatatgggtttgaaacccaccaaacgcaccaagtccggctcatacaccacgaatgcggccgcattgcaggatctgtatgtcaaatcagtggacaatgagcgggccaacggtttcctcggagcgttgctgcgccatcgcgagatcaacaagctcaagcagatcgtccaaacgctgatcgatgccaccaacacatcagatgagcgcatccacaccactttcgagcaaaccgttgccgccaccggccgattgagctccgtggatccgaacctgcagaacatccccaatcggaacgccgccggccgtgagattcgtggcgtgttcgtgccgggggaggggtacgaggccctgatgagctgcgattactcacaggtcgagctgcgcattatggctgatctgtccgatgatgaggcgctgatcgaagcgttccgctccggagccgacttccacaaatacgtggcctcgatggtctacaagctgccggtcgaccagatcaccggcgaccagcgcagccacgtaaaagccatgagctacggattggcctatggtctgagcacgtatggtcttgcccagcaactcaagatcgcgccacgtgaagcggaagcgttgaaaaaccggtatttcgataccttcggcaaggtgcacgattaccttgaatcgctggtggccaatgcccgagagaaggggtatacggaaaccattttcggacggcgtcgctacttcccggccctgcattcgaccaatcgtgttgcgcgtgaggccgccgaacgcgcggcactcaacgcaccgattcagggatccgccgccgacatcatgaagattgcgatgattcgcgccgaacagaccttggccgaggctcacgtcaagagccgtatcattctgcagattcacgatgaactggtagtggaaatcgcgccgggagaaggcgaccaggtcaccgaactggtgcgcaacgccatggaacacgccgtcgaccttgccgtgccgctggacgtatcgtgcggcatcggttccgactggcaactcgctgcacactgacaatttctagctcccctcgggtgagggggctgagccgttgagcaaacagtccagtggattgtttgtaggcgaaggcgagccgatagtcgagcaatgaagagcacgagcatggcttgtccgcaattgcagaatgagtcccttgccgcaatagcccactacaatgggacatatgccgaatctcaagcaagtcatcgacgttctcgagaccctgtacccattgcgctacgccgaagaatgggatgagccgggcctcattgtcggagatctgagccacgacgtgcaccgcatcgtgttcgccgccgacccgacctccgccatcattgacaaggccatcgctactggcgcggacctgctcatcacccatcacccgttgttcttccgttccgtacacgagacgagcggactcggtttccggggcgacatcgtccgcagactctaccagcacggctgcgggctgtgggtagggcacactaatgccgacgctgcgtatcgcggcgtgggacaggcggcggccgactacttcggactcatcgaccagaaaccactcgtgccgattgacgatgcaaacgcctctcatccggtcggcttggggcgtgtgggtcgtttgccgaagcctgttgccctgaaggatttcgctcagcgtgtattcgacgaagtgtccgatcatggcatgaccaccgcgctcggcatccaggtatgcggcgattcggacacttttgttcagtatgtggccattctgcctggctccggggactccctgttcaacgaggtgcgtgccaccggtgcggacgtgtacgtaaccagcgatttgcgtcaccacccggtgaccgacgccatcgaacaagcccggtatgaagcccgtatgaggtcccaaggcatcatgctcggccatggaatggcgggggagagccatgtgcgtccctgcttcatcaacacccctcatgccgccatcgaatccatgtggttcaactacgcgatcgatgacgtgccagccgccatcgaacaagcgaccggagcaaggcctgaagtcgagtggttccacgacacgaccgatccatggacgctgtccattaccgcgcatcgagattaagacgctatagtaacgtggcaaaaacgttttttccgaggagatgacatgtttggcggaagcaagcaggaacaactggagcatcggctcgaccataagctgaacgcctcctcggacggcatcgacatggacgtgcccgccaaagtgatcagtagcgaaaccgtttataccgggcgtatcttccatgtggacgacatgcgcatcgctctgaccgacaagcagggcaaggaacacgagatcggccgccaggtgctgcgtcacgccccctgtgtggtcatgctcgtgcacgacatgtccaccgaccgctacctcatcgaacgcgaataccgcgccggatcggacatgttcgcctacgggcttcccgccggactgatggacgagggcgaggacatcatggacgcggccctgagggaactggccgaggaaaccggcgtggtgccggaccgtgacaccatgggcgttgacttcgtaggtgatttctactcgtccgaaggcatgaccgacgaactggcccacatcatggtgttgcatttgggcccgttcaggcgggagcagcgccatttcgatgcggacgagcatgtggaatccgcgtggattccgtggagcgaccttgccgccacgcgcatcacctcatccaattcgatgatcgccatccagcatgaggcgttacgcagactcatcgccaggaactccgacaaagataagccgtcgctgttctcctgacgttcaactccccggcacatcactgacacaaaaaaagtgggatactgaaaactatgcagatcagacctggatcaatgtatccgctgggcgccagctatgacggcgccggtgtgaacttcgcgctgtactcacaggttgcgcagaaagtcgaactatgcctgttcgacgagcacgatgtggaaacacgcatcgaaatgaccgaacggaactcgtacgtatggcataactacattcccggcctccatcctggccagcgttacggctaccgcgtctacggtccctatgacccggtgcacggcctcagatgcaaccccaacaaactgctgcttgacccgtatgccaaggccattgaaggtaatatcgacggcgacgaaagcctgttctcatactggttcaagagcccggacgacaactcggcgatgaacgaccttgactcggccgcccacaccatgaagtcggccgtcatcaacccctacttcgattggggcaacgaccagcatccgtacatctcgtaccacgattcggtgatctacgaggcgcacgtgcgcggcatgaccaacctcaacatggacgtgccgccggacatccgcggcacctacgccggcctggcctatccgagcgtcatcgaatacctgaagaagctcggcatcaccgccatcgaactcatgccgatccaccagttcgtcaacgactccttcctgcaggagaagggcctgtcgaactactggggctacaacaccatcggcttcttcgcgccgcacaacgcctactcctcctccggggaacgcggcgagcaggtcaacgaattcaagtccatggtcaaggcctaccatcgcgccggcatggaagtcatcctcgacgtggtgtacaaccacaccgccgaaggcaaccatatgggccccaccctgagcttcaagggcatcgacaacgcctcctactaccgactggtggaaggcgaccagcagcactacttcgacaccaccggcactggcaactcgctgctcatgcgctcgccgcacgcgctgcagttgattaccgattcgctgcgctactgggttactgaaatgcacgtcgacggcttccgcttcgatctggccgccacgctggcacgccagttccaggaggtcgacaagctgtccgcgttcttcgacatcgtggagcaggacccgatcatctcgcgcgtcaagctcatcgccgaaccgtgggatctgggctccggcggctatcaggtgggcggcttcccgtccagctggtccgaatggaatggccgctaccgcgacaccgtgcgcgacttctggcgctcgcagccctccacgttgcccgaattcgcctcgcgcttgatgggcagctccgacctgtatcaggtcaacggccgccgaccggtggcgtccgtgaacttcatcaccgcgcatgatggtttcacaatgaacgacctggtcagctacaacgaaaagcacaacgaagccaatggcgagggcaatcgcgacggcgagagcaacaatcgctcttggaattgcggcgttgaaggcccgaccaatattccggacgtcaacgacttgcgtcagcgtcagatgcgcaacatgttcgccacgttgctgttcagccagggtatcccgatgatttgcggtggcgacgaagtggcccgcacccagcagggcaacaacaacgcctactgtcaggacaacgagatctcctggaccaactggcatcttgacaaaggacgcaaggaactgctcgccttcgtttccaaactcattcatctgcgtttggatcatccggtgttgcaccgccgtcgcttcttcaccggccgtgagcccggcgacgattcgaacacgattccgcaggtcgaatggttcgaccacaccggctcgatcatggatatggacgactggcagaacacgcatgcgttctccatgatgatctatctgaacggttcggatatcccggaggtcgactggtacggcaaccggatggtcgacaatgacttcatcctgatcttcaacgcgcattacgagccgattatgttcaccctgccggatgagcgatacggccgcaaatggcagctggtcgtggatacgcacaacccgaatgagccggcgctgagctatgaggcgggcttcatgatcaccgcccagtcccgcagcttcctcatgctcatgagcgccaaaaagcccaagaagcccatgggcctataaccagaccgaatttaagctccctctgacgagggagctcccggtgtagccgggtgagggagagaccgcagcaaagccgcgaactcctactcgcgccccttacgctcctccacgagccgagcatcgacatgatgccgaggactgcatgtcggcgctgttgccaaacctcaagcggtggcggcgtcaggatgagatcgatgcggtggcggaggggaaatgacccaaatgagcgatggcattcgactataaaaaggaataaaaaagccctacattccagtcgggagtagggcttgtggtcgggctagccggatttgaaccggcgacatcctgctcccaaagcaggcgcgctaccaaactgcgctatagcccgatacgccattaaggcacaagaaatcattataaacgacgctggatacattgcgtgtcgagcatatgaattcaaaaaggttctggattctcttgcatatgagcggcatctttattcaatgatgctctacaacgactaggtttgaatctgcatctgctatttcagtttaattcagtaacagcattcatggggatgttgcgagtcgtcacgtgttttggcataacaagcagtgctttggcccgcaagggcgaggctccaagtcgccggggggggtattccccggcattccttttcctccaacgttgtcaggagcccatttgagcgaattgagcatcttcgtggacgaatctggcgagtgaggtaagctgtccgaatactatctcatcacattggtgcttcacgtccagtccgattctgtagcggaacatattgataagtatgaacgccatctggctgattccggcttgcctgatattccattccatgtttcagattttcagtagaatggcgacagacaaatcccgctggcttgctagtaaagcgttgtcctcggggagggttttgtttgttattgaaagataacgcggcatcgaatagataggggaggtccggcatgggacgtcatcagcgcgcagaagcctccggactcatctccttcttgatttgcgccgtcgtcggcgcggtatcgatgaacctgtacatggaatacgcgccggccatctggcagctgacgcaacgccgattcatggtatgttcgggcatcgtggcggcatgcggtgtcatttccttcattattggctatgcgcgtaaatcacgttcattgaacctcaaacatggttggtttgcaccgattcgtcgcattttcgaaatcgtcgccctttcggtggtgtatgcctcgaccatcttcctgtcgtccttcgccctcatcggtgcggccaacgatatgatgggcaatgccattttctccggctatatttccagcgtctgcgccgcctttgccggcgtggtggggtacatgacctttgtacaggcggagatgatgaacgccaaaaccattgccagcctgttgccgttcttcgtcatctccggcgtggtcaccgccggcatgaccaccgacgacccatactggtatcacaacaacttttcgcagcttggtgacagaaccacgttcgcggcccgtatgttcaactccacgctgattcttgccggcacgtgcatcatcatcgtcagctacttcgccatctccgaattggtgaccaccgaacggctacagcgcctctggcacgaccgcaccaacagagatccgaatcgcggctacgaaatcccacatttcatgctgcgcatctccattctgtccttcctgctgatggtggccggcctggcattcatcggcatcggcgtgttccggtacacgccacacaatctcttgcacaatatatgcgccaaaggcctgccgttcgtcatgctgctgctgttcgtgctcctgccatggcttgcgccacgcctgtccaaaacagtgatggtggcctccgacctgaccgcgctcgtatgcgctgcattctgggtcaatatgatgatgggtcacaacaccctcaccaatgtggaggcgttggctggtctggcgttcctaggctggttcatcgtgttctcgcgccagatcgccgccatcgaggccgaccgcgtggccgcccagctgctgcacgcgcaggccatcgaaggcggactggaggaagcatccaccgagcccgcacagcagattgaatcccgcatcgccgccgaccgttgatagatatctcgttcattaggtcgatttgtcgttcatttggtaggttcggtgtcctacgccatgttgggatcgcgccatttcaaaggtgggtgcggaggctgacctaccaaatgaacgacaaatcgaccaaatgaatgacagcggacgctctgaagcctccaaatactgatagatttggccttatgactgaacaactcacgaatctctggcctgccccgctcgccacacagccgttgaacgctacggtaacggtgccgggcagcaagtccctatccaaccgctacctgattctcgccgccctcggcagcaagcccgttactctgattggcctgctgcgttcgcgcgacacggaccttatgatgggtgccctcgaagccctcggtgtccgctgcgacgtggattccgcaaccgacaccaccgtaacggttactcctcccgtatccggccgattccatggcaacgtcaatgtgttctgcggactggccggcacggtgatgcgtttcgtgcccggccttgccctgtttgcagatggcccagtgaattttgatggcgacgaacaggcttatgcacgcccgatgaagccggtgcttgacggtttggaacagctgggtgcaacggttgattaccacggcgaggttggccgtctgccgttcactattacgccgcctgcaaccttgccgtctgcccaggcgcaggtcagcatcgattcgtccggttcttcccagttcatctccggcctgttgctgattagttccaaactgcctagcggtctgcacctcgcgcacacgggggagaagaccccgagcctaccgcacattcgcatgactgtggctgatgtgaccggtgccggcggtgcggttgaggccgacgaatccgcccgcacatggacggttgaaccgcgcgcaatgcaactgccgagcaaggtgaccgttgagcccgacctgtcgaacgcggcgccattcctcggcgcggcattgatcgccggcggcacggtccgggtgcctcattggcctgagaccaccacccagccgggtggtttgttgccgggctatctggaacagatgggtgccaaagtatcgttcccgacaatcgatggcgtgcgctattgcgaggtgaccggtgacggcaccgtgcatgggctgggtacgttcgatttgacggcggccggggagattgcgccctcgttggcggcgattctggtgtttgctgataagtcgacagacatggttggtattggtcacttgcgcggccacgaaacgaatcgtctggaggcattggtcaacgagattcgtcgtgttgggggagcggctgaggaattgcctgatggattgcgtatcgaaccggtgccggcggagacgttgcacggtgccgtgatggaaacctatgctgatcaccgtatggccacgttcgccgcgatgctggggctgcgtattcccgatatcgaggtcatcaacgtggccaccacgcgcaagaccttgcctgatttcgtcggtatgtggagcggcatgctgaggcagtaaggggtcctgtgttctggtggacccccctcagtccgccggaggcgactgagggggagtatgacgcaggggtaggggtctcatgaccatatacgaatgggggctgattccaatcggaatcagccccatagtgttgcaactagagattggtgagatgcctaacggcggttacttacttggcgaaggtgttgccgtaggtgtcggtgccggcttcggcgattgcggcggacttgcgggcgatggccagctcttcgttcgtcggaatcacggcgatgatcacggaggagtccggagtggagatgatgcgcggttccttggagcgggtggcgttcttctcctcgtccagcttgacgccgaacggagcgagcttgtcgcacaccatcttgcggaccacgtcgtcgttctcgcccacgccagcggtgaaggtgatcacgtcgcagccacccatctggtaggtgtagttgccgatgtagctgacgatgcggtgcacgtagacatccagagccagcttggcgtcctcattgccctcggacaccagacggtgaacctcacgcaaatcgccatagccggtcatgcccatcatgccggaacgcttgttgaacagggcgtcaagctcgtccacgttcatgtgggcgttgcggatcaggtggaagaccacagccgggtcgatgtcaccggtacggccgcccatcatcaggccctcaagcggggtcagacccatggaggtctcaaccggcttgccggagacttcagcggaagcggaagcgccgttgccgatgtgcaaaacgatctgcttcaggccttcagccggcttgccgatgacgtccggcaccacggaggagatgtactcgtgggaggtgccgtgggcgccgtagcggcggatgtggtactgatcggcgatttccttgttcagcgcgtaggtgctggcggccttcggcagctggaagaagaaggaggaatcgaagacgaagatctgcggaacgtccggcagcagggagcgcatgacttcggcgcccttggcctccggtccgttgtgcagcggggcgagcacagccagatccttgacctggttgatggtcttgttggtcacgagggccggcttcgggaagatggagccaccctgcaccacacggtggccgacggcgacaatgccagcctcagacaggttcgggccgtactcctcgaagaagccgagcacgcgcttcagaccctgctcgtggtcgtgaatcggctcttcaagctcgtgcttttcgccgttgtactcgtgcttgtagtggccgtcgaccggctcaccgatcttctcgacgaggccggaagcgaggccttcgccggattcgagatcaaccagctggtacttgatcgagctggagccggaattgatgacaaggacggttttcgccattatgggcatcctccattgtgattgaatgttcccgtgagacacgggttaccgttgattagattactcgttgcttgctacaaaaaaggcattacggtggctcccgctggcgggagccaccgggagccaagccgggctcactgcgcttcgatggcggtgagggcgatggtgttgatgatgtcccgcaccagagcaccacgggacaggtcgtttaccggcttgttgagaccctgcagcaccgggccgatggccaaggcgccggaggagcgctgcacagctttgtagccgatgttgccggcgcacaggtccgggaagacgaacacgttgacgtgtccagccacatcgttgcccttggccttggtggcggctacggtgggggaccaagcggcgtcgaactggatggaaccgaccaccggcagatccggagccttctccttgagcagcttggtggcttcctcgaccatgtccacgtccggtcccttgccggaaccgagggtggagtaggagagcataccgaccttcgggtcgatgccgaaggcacgtgcggtctcggcggactgcagcgcgatttcggaaagctgctcggcgtccgggttgaggttgatggcgcagtcggagaacacggccacatggtccttgaagcacatgaggaatgcgccggagaccagcttctggccgggcttggtcttgatgacctgcagggccgggcgcacggtgttggcggtggagttcacggagccggagaccaggccgtcggcgtagccgagcaccacgagcatggtgccgaagtagctggcgtcggtcagctgcttgcgggcctgctcctcggtcatgcccttcttggcacgcaactcgcacagcttggcgaccatgggcttcagcacgttctcgtcgtccatagcctggaagcgggcgcgatccaagtagttcaggcccagttccttgccgcgagccagaatggcgtccttgttgcccacgatgatgaggttcacgatctcgcgctcaagcaggtagtcggccgccttgatgatgcggtcctcctcgccttcgggcagcacgatggtcttcttgttgctcttggccttgccgagcaggccgaactggaaggcgtacggggtgatgggcgcggtgacgtccacatcgagcgcggcgagcacttcatcggtgggagcgttcttacggaaggcctccagcgccagatccttggtggattcatcggtgaacggcacctgcggaagagtccagaccggcaggccgtacttggcgagggtctccttaacggagaaagcgtggcgcggctcgcatccggtcacgaagatgccgagcaccttgttgccagcggcctccatgccctcgatggacagcttgacggtctcgtcgagctcgtgcggccaacggttgatggtgcacacggctaggaacacgccggccttcagatcagcggcgacattcgcgtcgaattcatagctggtcggatcgttgacgtgggacttgtcggtgcccacgatcagggcggcgtccgcgcgggaaacgtccatggcatcgttgaacgcgccgacgatatcgccacgggcggtgttcttatcttcgcgcaccttgtgcacatcgaggccggtggacagggccacgccgagtccggcattggaggcggcgagtaggatcggggtgaattcgtcatggttggacacagcagggcggaacaccatggtcttgtacttggaagtcaatgcgttgagcatgccgtaagcgacgacgttgcggccattggcgccttcagggctggcgatatatacacgggtgacggtcacgatgtttttgtctcctttgatgatcaacacgatagggaccacacctcattgtagtggcgattactgttatcgctcacgccggtgtcgcgccaatcggaagcgtcccctttgcgacgctttccggggaatgttgcgcaaaaccccaaaagtcggccgataggccagaaaacgaaaaaggccggtgcgtgaagcaccggcctcgattgtggagctagggggattcgaacccccgaccctctccatgccatggagatgcgctaccagctgcgctatagccccgagtgaagctatccgattcatgggagtcgcaagacccgccatgaaccagcggagaaaccaccatatcgcctgacttgatggcttcgtcgtggagctagggggattcgaacccccgaccctctccatgccatggagatgcgctaccagctgcgctatagccccgttttcagttgttggcccgttgtttggacctcgtatacattacgacgagatgtcgattctggcaaaagccggcgtgtcgccaaatggcaaaagtgggatttggcgacactttttggcttgtttccgccattattcaggcattgggttattcaattactgcttgaacggtttttcgaatacactgaacctgttggctcagcaggggagccgtgacacgatcagcgttcgcgttcccactcgtcggtgtcggcgatggccggaccgtgattgtagtccagcagacgccagcgcacagtgccatcgggattgtccatcggcaccaagcgcacccagtgcgcattacgcaatgaaaccaccgtggaaaaggtcggatcgattgcagaaatgcccaacagggtctgcaatgtctgcgcaatccatgcgccgtgcgagaacacgaacaggtccgtgtcgtctccggcacgcgtggaccagtcctcaagagcctccacgccgcgcttgcccacagcttccttgggctcggctccatacttcagctcgccgccccgagactccatccaggaacggaagtcctcggggtagcgttcggccagttcggccacggcatggccatcccaatcaccgaagctgcgttcacggacgcgacgatcatcgacgggctcgattccacccaatacgtcggcgaaagcttgcgcggtggcgtgcgcacgcttcaaatcggagcagacaatgaaccggtggttgatttccggccgacgatcgacgtacaggcttttcaaggccgcggcggtctgcttgacctgccattcacccacggcgtccagcggaatgtcgacctggccttggagcttgtgagcggcgttgtaggaggtacgtccatgacggataaggaaaacggaacgaacatgattggtcatagtgacgatcctttcggttccagtgaggaaacaggaaaaagggagggctgcctggtgccgtcaatgacgttcggcaacaggcagcccgacacgcgaatatcagcgaatatcagcgaatatcagcaagtatcagcgttacgcgattcgcacgttacgcggtggtgacggcagcatcttccgcatgctccgccgtttccgggtgtgcgagttcaagatcgatggccgggcagtcgcgccagagtcgttcgagcccgtagaattcgcgcgattcctcgtgcatgacatgaaccacgaaatcaccgtagtcaagcagcacccactggccctcggtcaggccctcgcgagagcgcggctgacggccggagcacttaaggaacaggtccttttcgatttcctcggccacggccagtacctgacgctcgttggaggcgccggcgatcatcatgatgtcggtgatgccgagcaggtcggctacgtcgaaggccacgatgtcggtggccttgatacggtctgcggcctcggcggccacgcggacggcgttgatggaatcctgaagtgcgggcatggttcagcgctcccaggcgggcttccagccctcgacgttgtgctgcgtgttctcggagtagaccatcgtgtcgctcggcacggcgtggcgcaccacggagccggcgccggtggtcacgttgtcgccgacctcgaccggggccacgaacaggttgccggcgcccacatggcagccggagccgatggtggtgcgattcttgtgcacaccgtcatagttggcggtgatggtgccgccgccgatgttggtgtggtcgccgagctgggcgtcgcccacgtagctcaggtgcggcaccttggtgccgttgccgatgtgcgccttcttcatttcgacgaacgcgccggccttggcatccttgccgaactcgttgcccgggcgcaggtaggtccacgggccgatgttcgtgcgtgcgccgatgtgcgattcctgcacgcgggaacgctcgaccacggcaccttcgtccacggttgcgtcaatgagggtggtgtacgggccgacgatggcgtcctcgccgaccaccgtgtggccttgcaggaaggaaccgggcaggatggtggcgtcgcggccgatctggacatcgtcctcgatccaagtggtttccgggtcaagaatggtcacgccatcgcgcatccagcgctcgcagacgcggcggttgtaggtcttggacagcgcggccagctgcacgcggtcgttcacgccttcgacggtgagcggatccggagcagcgaacgcgccgactttgccagcggccttggcggtttccagcgcgtcggtcagatagaactcaccctgcgcgttgttcgacttcagtccggcgattgcctcggtaagcacggaagcctcgaacacgtagactgaggtgttcacttcctgcacggcgagttcgctgcggttggcgtctttctgctcgacgatgcgcagcacgttgccttcgcgatcgcggatgatgcggccgtagccggtcgggtcatcgaggatggtggtgagcacggtggcgccgttgccggaggcggtgtggaattcgaccagacggtgcagcgtctcgctgtcgagcagcggcatgtcggaggcggcgatcagcaccgggccatcgaccttgccagcctcggtgagctgcgccattgcgcactgcacggcgcggccggtaccgggaatgtcgtcctggttcacgatggtgacctgctcgtcataggagcgggcggcttcggcgacgcgctcggcctggaagtgcacgaccacggccagcgtgtcgggattcagggcggccaccgaatccatgaccctgttcaggaaggtcttgcctgcaaaagtatgcagcaccttcggcttgttggaacgcatgcgggtaccctcgccggctgcgaggacgatggctgcggataatgccataactgacgtattcccttcgatcggaatgtctattgagggtggaaacacctcaaaacaatagacggccgcccggatgtcgagcggccgtcagccgttcccccacctggactcgaaccaagacaaagggttccaaagacccgtgtgctgccattacaccatgggggagtcgtgggctttcggcccacaagtgttcatttataccatattgtcggtatttaccgaaagactacgccatgtcgcgtctcgcatcgtgtgctttccttgaacaaacacgcacgtgatcaggcgaacaggaagccttgaccgtggtgctcggggtaggtgtcgaacagttcggcgaccgagccgtcctcgaatacggcgcggatggcgctggccagcagcggggcgatcgacaggacggtcaagccatcccagcgcttttcctcgggaatcggcacggtgtcggtcagcacgacctcgcgcgcaccgcagttcttgagtcgctcgatggccgggccggagagcacgccatgcgtggcgaccacggtcaccgacttggctcccgcgtcctgcagcacgtggcatgcgcccgcgatggtaccggcggtgtcgatcaggtcatcgacaagcacgcagtccttgccggcgacgtcgccgaccacacggttggcgaccgcctggttcgggcgggtgatgtcgcgcgtcttgtgcacgaaagcgagcggaccgccgccgagacgctgcgcccactgctcggccacgcgaatgcggccggcgtcgggggagacgacggcgacgttgtcgagatggccttggaaacgatcacggatgtagtcgaccagcactggcatggccaccagatgatcgaccgggccgtcgaagaagccttgggactgcgcggcatgcagatcgaccgacatgatgcggtcggcaccggcggtcttcagcaggtcgaacaccagacggcaggagatgggctcgcggccgcggtgcttcttgtcctgacgggagtagccgagcaacgggcagaccgcagtaatggaacgggccgaggcgcgcttcaatgcgtcgatcatgatgagctgctccatgatcgccttgttgatgggtttgtagtggctttgcagcacgaacacatcggcgccacgcaccgattcggtgtagcgcacgtacatctcgccgttggcgaaatcgtatgcggtggtttcaaggacgtcgatgccgagctgctcggcgacatcctcagccaacttcggatgaatccttcccgtaacgagaataagattcttatcgggctttccttcaaggattgcgctcaccatgtctcccaacgtgtggtctcgttgatgcagtcttcagcatagccgttcttcacgaccggttggacaactcagcgttgcctgccgttcacctgccgcttgcgatccattgttcgatggcctgtttgaccgcctttgcatagatatcgctatccatgctcgggtggatgccgtcggagccgagcacctgcgcgttcgcgttggctgtggcatcccaatccaccagcaccacattgtccggatgtgcggccgcatagtcggcaagcacctggttggtaggtggaatccacgtacggtctccgtgggcattgaccagtaccagcacgcggtcggggccgatcatattacgaatctggtccaactgatcgggggtgattgccgaattggtgccaaggccgatcagcacccactgccgcagactgccggcggacagatcattgccgatgagttcgggggcgaccatgatggagcgggaaacgctcgcgtcggtctgaatgccggggaagacttccgaaaggccctgtgatgaggccagcatcaccgaatcgcctatggcggtaatctgatcgccggtgggcatctcatgcttgggcttgggcggtgccggcacggcatgtcgcagcagcacgtgttcggttttctgtatgcgttccagttgtgcggcctgttgctccagctggatctgcatggcggttttcgcaggtgcatgagcaatgccctgcacgcagccggccaacgacagcaccaggataacgtcaacggcaataacccgggccacatgattcttcttgttcgtgcgaaggggcaccacgacggataccgccgagtgcgttgccgccggtttctccaccatcagccaggaaatcatcaccgcaatggcggtgagcaacgcggtcatgatgagaggccaaggccctactgccttgaagatcttcggggcaagggcgctggaaagaatccacaacggccagtgccacaggtagatgccgtacgaatacttgccgagggaggccaatggcttgaacaccatgaggctttgcatccaggaatcgtcggagatggtaccggcaatcagcagcacggacaacaagctggacaatatgatgccaccgcggaaggcgaatgcatcctgtttgccgataaccgccatggtgaccaaggcaatcaggctgaggaacgccaataccggtgccgccgcattccagatgcgatgctccacgggaatctgaggtaacggagcccgatgtgcggctgccgaagcgctcgagctaatggtgcggggcatcggcacagccctctggcgagcgtggcccaactgaggagcggtgacccaccaggcgagagccacacccagcatcaggcccatgctgtgggtatcggtgccgaagtagacgcgggtggggtcgcctttgggcacatacatcacccacatggcgatactgctgaacgccgcgagtcccagtgggatgagtgaagacagtttcgtctggcggagcttccacatcagccagacgatgaacggcacgatgacgtagaactgcatgagcacgccaatgaaccacagatggcgaaacacctgcgggttcatttggtcgaaatagctttggcctccggcaatggcgtaccagttgtagcagcccagcagcacggtgatgacttggtcgcggatggaaactagaatgtcgtgatcgaacagccagccgacggagacgatgaccggaatcagcagaaacagcgccggatagagacgtactgcacgcttgggaatatatcgcacgagattcagcgatccggttttcgccagagaacgaatcaaactgacggcaatcaggaatccagagacggtgaagaacacgtcgactccgtagaatccgcctggcagccgttgctgcatgcagtggtacagcacaatggctatcagcgctagtcctttaataccgtctaaacccacgaaccgcttcacggataatccttctctttccgtagtgctgatggcattccccgttctctccaacaaacggaaaacaagcccagcatggccgaggggagagacaatgcgacagcagcgaatcgtcaggccgcatgctgcatgattaccggcttgacgattcgcggcataccgcgcttatcggtggcgcttaccggtgatacagactcacccgttcgtacttcggttcgcagcacacgttgatgccgagtttgcgatacagcgcctcgtccgtggatgagatgataacggagaagaaggcgtcgcagccccgcaactgtttgagcccgtcgatgacgcgagcggccacaggactggtggcgctggtgattgacaatgcaatcagcgtctcatccgagtgcaagcgtcggttcacgctgttgagatgttcggttttcagccgacagatgggttcgatggcggcatcgtcgattaccggaatggtttcgtcaacaccggtgacggccttgagcgcgtgcatcagcagcgcgctggccgcgcccaacaggtcgccggttttgccggtgaccacatggccatcgggcagcaccatggcgccagccggggcaccggtggcggcctccttctcaagagccacggcgcgggcgggagaaagatcgggggtcacgccggcccggttcatgatggagcgcagccgctccacctgttcctcgccagtgccggtgcgcttcaagtgcacggcggcggcgaagtagcggcgcacgatttccagacgcgcggcatcgcggcaggcatcgtcgtccacaatggcgtatccggccatgttgacgcccatatcggtggggctctgataggggctttcgcccatgatgcgctccatcatggccttgagcacggggaatgcttcgacgtcgcggttgtagttgacggtggtctcgccgtacgcctccagatggaaggggtcgatgatattggcatcgtcgaggtcgacggtggcagcctcgtacgcgatgttcacgggatggttcagcggaagattccagatggggaacgtctcgtatttggcatagccggcgtcgatgccgcgctggtgctcgtggtacagctgagacaggcacgtggcgagtttgccggagcccgggccgggcgcggtgaccacgacgagcggtcggctggtctcgatgtactcgttcctgccgtagccgtcatcggacacgatgcgttcgatgtcgtgcgggtatccggcgatcgggtagtgcaggcggcaggtgacgccgagttgctcgaggcggtggcggtaggcgtcggcggcgggctgattggcgtattgggtgagcactacggagccgacgaggaagccgcgggaacggaacacgtcgatgagtcgcagcacgtcctcgtcgtaggggataccgaggtcgccgcgggtcttgcctttttcgatatggttggcgttgatggcgatgacgatttccacatcgtccaccagactttccaacatgcggaacttggtgtccggctcaaagccgggcagcacgcgcgaggcgtggtagtcgtcgaagagcttgcctccgaattccagatagagtttgccgccgaattgcgcgatgcgctttctgatgttggcggcttgcagctcgatgtatttttcgttgtcgaatccctggcgcatagaggtcggcatccctttccgaacgacgtcgtaaacggaaaaattataccggacgtcgtcggcaacaaaaaatgggattccccgatggggaatcccattcgtcatagagagcaattactcccgaggaatgttgaacaggggtttgcatggctcccaaaaacgcgctggttgaaacgttgccgacgacgcgtgcgctcgaagagtatgcacgggtggctttgcggtgatttcccagaccgttcgttgctaggcgagatatttctttttccaggccttctttcgggcgtaagcgttttctgtcatgtcggagtagtcgtaatcaactttgaacttgccgttggaatggagaataagcgtcatcgatccccatctcttttcgggcttaagcgcggccctttcaggttcaatgaacttgttgatagccataaagtttttcatcaaggatgccctcgaaacgcctttttggtcaaagcatttaacgaagtcgtcttttccgctgccagcaacgtaatactcaatagagaacgcaccctcggcgtactcggcgtaaaacacgaccttgctccagtcttcggggagggtttcctcaagaattgaagctatcccttgtagcatcttcttttcactcattacatttcctttgcagtgttaagaagaaacgtaaccgtctcttcgccgtcaataatgtccgtgatagcaaacgagctaggcctgaatgacccgccctcataaagtggctcaaccttgaaaaacacttcagcgccatcagccaaagcatcggcgcatttttgctcgattgctgcataggctttttggttaacctcgccgcccatggcgacaatattctcaaggccatttgatccattgaatcggtcggcaatcagatggcctctttgatcaaaaagctcttcaaacccttttccgattgactggatagtgtccttgatggtcaaacgaccttcgtgggtctttagttgtaagaagccttcggccgattcgaccctacccattgcatcggtaacgtatttatacccattgatctcatagctcatgttcggaacgaggtcgtcgccaacgcggtaaagttgcccgagatcgtcggttgcacacttcacgccgtcgatcgcaaactcgttattgggaagcagtcggtcgccttcgtaaattgcctttccggcatcatccagaattcgtgagcttgcgcccgattctgctgcctttgaggcaagaaagttatttagacctcgtccggcaagaagcgttgctgccgtaacagttcccgcaacgacttctccgacgatatcctcctgagatatctcaccgtcttcagcgccggcttccaagctctttcccatttcgtcaagaacgagtacagacccagcagcgagtgctgcaggggcagaagcggtgacggctacggcaccaagcgcaacttcagtggcgatttcgcctccagtttcgacatagtctccgatttcccgtatctgctcatcggcttccatgaagtcgccccaggcgttggctgcatcgtcaacagcgtgtgtttgcgcggttttcaccgctgcttcttcgtcttcggccagtagttcaatattcgattcaacaccgacatatgcgttttctccaacgtcggcaactccaagtacgaacctgccgccaagataagctccgttccttgcgccatcgcggacagtttcgcctgcagcgttgagtgttggctcgcatgctttccaggcgtcatctgcggcttcttgaactgttgaaatgctcgcggttaggacatcgccggaagaaatatcccgccatgcggcatctgcacaatcagcaacggtgcgttgcgcctcctcaaaggccaatctcgtttcggtcgtatccggcattaattgctctatattttcaaacgccatttagatcaccggccttgtttgagataagaccgctgatacttcggcgagtgctgaggccttttccgttgtctcgatgccggtacccctctttctcagctcgttgagatgagcgttaagcatcgactgaatgaacaggtattggattggtccccagctttcgggtgaggagtcatcttcgaatttccagcttgaaagcagatgggagcaaagcctctctttgaggctgtcggcagataaatccctggcgtcgtcgaggatgcgtccaatattgaaatacctataagcacaccattcaaacagtggcttcctcgaggacagaggagtccttgccatctcaatcaagcgtgccttcatggagtcaggtatgtccatcttgtgcacacagtcgcagaagttgtattcccttggctcatcgagcttgaacggattaagcacacaagagttgagatagcgaagctcttcagaagaagccttgtccttcgcgctgtgcttgctctgtgtcggcgagtactctaggccgcgttcatgcggttcgatgtgacagaggacaggttcgatccattcgttctgatatattgctgcaacgcctcgctgaagctttgcaagctcttggatttggctctcgttaagatttgccgccttgccgataagcatcctgtcgccttcgtcaggcagtttccaggataagtcgatgcgatgattctgcctcaagcccagcgggttgttaaggcgcggtcattttggcgcttacatctcacttttgcagacgtagaatacgagtattggaatcaaaggagggttctcatgccaaatatcggtaaggacgaccatccgaagctgtggtcgcttattttcgtgcttatcatcgcgctgaccttctgttgcttcgtcatgggccaaggactcaacagtggaaccagcgtcttcctggcaggccaaggttacggtgcgagccttgccggcgtacttgcctcgtcttctccattgccgccgcgttagcacgactgttcgtcggccctgttatcgacaacggcaagtgctcactcgttatcatcgccggcatcgctatcctcatagcaggaacagcactgtccgctgtcgttcaaggcatccccctcttcacaatcagccgtttgctgcaaggcgtgggctttggcgcagcaacaacagcagcctcgaccgccgcagcaagcgtcttaccgcaagaacggctcggcgaaggcattggataccacggcctcggacaggctatcgccatgagcatcggcccagccttcgcactttacctagtaggaaccgatccctcaacgaacctctatgtcggccttgccctggttgggtttgcagggcttgtaatcgccctcaacgcacgctatgaaagtaaatggcaaactctgccaagctccagcgcataccgaatcaaaatggaaacccggctcgaactcgactcaaaagacgggcaggcacccagccccaccacagtaactacatccgaaacaattaacagtgaaaagtatcctgaaggcgaccaggtgtccaagagaaccctgcgtgactcattcaacatcttcgagccgcgcgcattgcctggcgccatcccacagatgatcatgtgccccacttttggctttggcgtcttctttgctggtctgtacggtactactctcggctatacccacgccggtctcttctacaccatcagcgcggtaagcatgattatcattcgcatgatttcaaagcatttcatggacaccgtacctgcaatcaaaacaatgaccggagccgtcgcgtgcggcatcctctgctgccttatgctacttgccgcaccgtacggggaacctgtcttcctggcgtccggaatcttctatggtctcgccactggcataagcctgccacttaatcaaagcgtagcggtaaagaacaccccgccagagcgctggggcgccgcaaacgccctgttcctgctcgccaatgacatcggcattggcttcgcaagcgtaatctggggcgttatcaatgactcattcgggttccagacaagcatcgtctgcgtcattgtctgccttatcgcaagctacgcatccgcctggatcgtctaccccgcccgcgacaagcggtggaggcattagagcgtaagcgtcaaaatgaccgcgtagcaggaaacgtccaggaccattccggcatacggatggaaaagtcctggacgtttccatctttgcgttgcggtatgccttaggccgctatgtcgctacaggccctcctcggcgttgttcgccatctcgtcgtcgaacgcatcggggtcgatgttaattatgaagtcgtcaggcatctctttggccttctcggcagcggctgggtcgagcttgcaggactcaggcaccctatccgaccacggcaggaacgagtccacaacctcatcggtgagctcgccggcgttgggcatctcggtcagcagccactcgacgtaaagcctgggattgagcccgttggccttggccgtggtggtgacgctgtatatcgccgcagacgcccgcgcgccgcgcggcgcatcgctgaagagccagttcttgcgccctacgacgaagattcgctgggcctgctcggcgacgttgttcgagagctccaggtgccccgtcttcgagcacgttcatgacgtagggccagaactccacagcgtactgcagcgcacggtgcggcgccagcttcggcgaggctaggggaagctgggcccgcgcccatcccccgaagtcctccatgagcgggcggagctccgcgtcgcgggcggccttcctgccgcccggctccatgtcgtcgaacttggagtcgaccttgaacatggcgtcgatcctgcgccttgcctcgagcgcaacgctggccgcagacgccgccttggcgtcgccgccggcgatcttcacgatttgggcgaagtagcggcgcacgtggacgaggcacgccgtgttggcgatgttggggttgccgagattgaagtagggtttgtagccgttggcggtaagcgtgccggaccagcccgcaagaaactcctgggcaacgcccttcctgcgggtctcgtggtattcgaatacatacacgggcacgttgcagcgcgccgagcagaacagccacatcctcgatttcttcttcgcctcgcggttcggctctttcaggacctgaaccgtggtctcatcggcatgaatcctgacatgcgacagcagctcgaccttcattctctcatggaccttcgccagccagcgcgcgtgcacgttcatcatccagttcgccattcctggcgcgatatcgtcgcgccgcacgccttgaggtctgtctctatgcggtagagcggcagcgacatgacgtacttgccgttgacgatccaggcaagcagcgacggcgtcgcaaacgagcctggtatcggcggctcaggctgcggtgctcgcacgatgacgcccttgcgttcctattgagtttcacttgagtttcaggggcgtttttggggtggtgggacaaactactgggacagttcactctccgaaaaatcctttactcttcgtccgctgcgtgtcgccatgtccgtggtgtacgcgcttttagagtaaaaatgactgaaactgcaggtcaaaaggcataaagagaccccctgaaaacgttgtttccagagggtctcaatagtttttactcacccaaaatcacaggtggctttacgctttttcgtacgtggcggcacactgcgacactctacggacggaatttcgattgcgcaaaatccgctccagtttactcccactcgccaaagtaaaactggttctaaacaatactgtttaggggatttgactcttagttgctcaatttgataccaattatccaacttatacggcgttgtcggactcctgttatcaaaagattatcaagcccaatgttatcagcagaaaagcaatggtttggatcatctgtattataccacaagcagagtgctatttcaatcaaataagggactgcttcaactgtagaatccgtttttcaatctctcgaatgatctcgacaaagacttgatcttcgcttccggtcggatcttctaatccccagttatcgtcaaatgctctaccaatgaaaggacagcccacattgcaccccatggagattgcaatatcaggggcaggaatatccgagatcagtttggaatactgggttttctccatgtcaatcccgtacagttctttcataatgcggacagcatcctgattgatttgcggttttgtttccgttcctgcggaatagctttcaaacacatcggaagccaagtgctttcccaaggcctcggcaatctgactgcggcaggaattatggacgcagataaatgccacctttttcttactcatatttgaaccagtctttcgttttatttgcgtttttttacaaggaacagcatcacgggaacttctgtcagcacacccacagtcgttgccagtgccgcaggggaagtcgttccaaacaaggcgattgcaacagcaacagccagttcaaagaagttggaagcacaaatcattccggcgggagcagcaatcttgtagggcagcttcaaaacccggcaagcgatatacgcaatcgcaaaaatcaggaaggtctgtaaaatcagcggtaccgcaatcaaaacaatgtgcagaggtttttccagaatggtattgccttggaacgagaaaatcatcaccagcgtcagcaataagccaatggtagttacactgtcaaacatatggatgaaagtctcctcaaagtacactgccccttccgcttgatgacagccgaacgggtcagcataccgccagccagaggaaacaccacaaacagtaccacagagagaatcagggtatcccacggaacgggaacattggaacgcccagcaaaaaatgcccgttgagttcgatttgagtttcacgggccccgaaacggccccgtttcgccctcggggacaaaaaccgcgcgtcaactcacttgggataaatccttactcccattccctcgaatacctccccgtgccttgttgtcttgaaacacggggagtaaatggcgaaatcgcaggtgaaagggagtaaaacggcaaagaaaaagcctccgttccaacgagggaacggaggctaggaaatcgtttttactcactgccgtcgctggcggttttgccatgactctcgtacgaaacgaaactcagcggtacaccacggcactcaaaagagcaggtcaaagccctatcggcttactcccattcgatggtcgccggcggcttggaggtgcaatcgaggacgacgcggttgatctggcggcattcgttggtgatgcgcgtggagatcgtggcgagcacatcgtaggggacacgggaccagtcggcggtcatggcgtcttccgagctgaccgggcgcaggacgatcggcgagccgtaggtgcgctcgtcgccttggacgccgacagagtgaacgtcagccagaagcacgaccgggcactgccagatgtcgcggtcgagaccggccttggagagttcctcgcgggcgatggcgtcggcctcgcgcagcaggtcgaggcgctccttggtgatctcgccgatgatgcggatgcccagacccgggcccgggaagggctgacgccagacgatttcgtcgggcagaccgagctcggtgccgatggcgcgcacctcatccttgaacagagtgcgcagcggttcgatgagctggaacttgatgtcctcgggcaggccgccgacgttgtggtggctcttgatgttggccgcgccgtcgccgccgccggattcgacgacgtcggggtagagcgtgccctgcacgaggaacttgacctccttgccgcgggcgccggcctcttcgaggacctggcgctgggccttctcgaaggtgcggatgaacttctcgccgatgatcttgcgcttgcgctccggctcggagacgcctgcgagggcgtcgaggaagtcgtcggcggcgtcgacggtgatgaggcggatgccggtcgcggcgacgaagtcgtgcttgacctgctcgacttcgcccttgcgcagcaggccgtggtccacgaacacgcaggtgagctggtcgccgatggccttgtgtaccagagcggcggccacggcggaatcaacgccgccggacaggccgcagatcacctcggcgtcgccgacctgctcgcggatcttcttgacttgatcctcgataatcgaggaggcatcccagtcgttgggcagcgcggcgcaacggtgcaggaagttttcgataagcttctggccaagcggggagtgcttgacttccgggtgccactgcacaccatagagcttgcgggattcgtccgccatggcggccacgggcgcgccttcggtgtgggccagcacttcgaagccggccggggcctgttcgaccgccacaccgtggctcatccacgtggtctgctcggcgggggagtcggcgaggatgccggcggcgtcgtcgatggtggctgaggtcttgccgtattcgccgagcgcggccttatccaccttgccgccgagctcataggccatgacctggaagccgtagcagataccaagcaccggaacaccggattcgaataccttggtgtctatggtcggcgcgccgggctcgaacacggaggccgggccgccagacagaataatcgccttcggatccttggccaggatctcgtcgaccggcatggaatgagggaccagctcggagtacacgcctgcttcgcgcacgcggcgggcgatgagctgggcgtactgggcgccgaagtcgacgacaagcacaggaccgtttgccattgatattcccctaacgttcattggaattttacgtgggctgaacacccctgattatcactggtcaaggcgacaaggccgacacgcagagactatgtgcgcaaatcgaacaaactacatgcctgtagacggacaacacgccgatttcgaacatgggaaatcgaacgtgcgctgttctagccaaatgctggatttccgcatgcttccgccgttttgaaaaagtatgttgaaaaaactaatgttgacaaacggtcagtcgaaccgcacaaatactgaaatatccgcaacaatttcgaacacacccgcaagaaatcgttcaaaagtcgcgttgtcctcgtaccatgacgattgattgggaacggaaaaccttggcaccgcaagggtcagggaccgtgaccgaacagaaataatcaatcgcacgatcacgtgcaggagtacaggagtacacatgacgagtcctgttattggcaccccttggaagaagctcaacgctccggtttccgaggaagccctcgaaggcgttgacaagtactggcgcgttgccaactacctttccatcggccagatttatctgcgttccaacccgctgatgaaggagcccttcacccgcgaagatgtgaagcaccgtctggtgggccactggggcactacccctggcctgaacttcctcatcggccacatcaaccgtttcattgctgaccacggccagaacaccgtgatcatcatgggcccgggccacggtggcccggccggtacctcccagtcctacctggacggcacctacaccgagaccttcccgaagatcaccaaggacgaagctggtctgcagaagttcttccgtcagttctcttacccgggcggcattccgtcccacttcgctccggagaccccgggctccatccacgagggtggtgagctgggttacgctctgtcccacgcttacggcgccatcatggacaacccgagcctgtttgtcccggccatcgtcggcgacggcgaggctgagaccggcccgctggctaccggctggcagtccaacaagctcgtgaacccgcgcaccgacggtatcgtgctgccgatcctgcacctcaacggctacaagatcgccaacccgaccatcctgtcccgcatctccgacgaagagctccacgagttcttccacggcatgggttacgagccctacgagttcgtcgctggcttcgatgatgaggaccacatgtccatccaccgtcgcttcgccgagctgtgggagaccatctgggacgagatctgcgacatcaaggccaccgctcagaccgacaacgtgcaccgtccgttctacccgatgctgatcttccgcaccccgaagggctggacctgcccgaagtacatcgacggcaagaagaccgagggctcctggcgttcccaccaggtgccgctggcttccgcccgcgacaccgaggcccacttcgaggttctcaagaactggctcgagtcctacaagccggaagagctgttcgacgccaacggtgctgtcaaggacgacgtccttgccttcatgccgaagggcgagctgcgtatcggtgccaacccgaacgccaacggtggtgtgatccgcaacgacctgaagctgccgaacctcgaggactacgaggtcaaggaagtggctgagtacggccacggctggggccagctcgaggccacccgtaccctgggtgcctacactcgcgacatcatcaagaacaacccgcgcgacttccgcatcttcggaccggatgagaccgcttccaaccgtctgcaggcttcctacgaagtcaccaacaagcagtgggatgccggctacatctccgacgaggtcgacgagcacatgcacgtctccggccaggtcgttgagcagctgtccgagcaccagatggaaggcttcctcgaggcctacctgctgaccggtcgtcacggcatctggagctcctacgagtccttcgtccacgtgatcgactccatgctgaaccagcacgccaagtggcttgaggctaccgtccgcgagattccgtggcgcaagccgatcgcctccatgaacctgctggtctcctcccatgtttggcgtcaggaccacaacggcttctcccaccaggatccgggtgtcacctccgtcctgctgaacaagtgcttccacaacgaccacgtcatcggcatctacttcgccaccgatgcgaacatgctgctggccatcgccgagaagtgctacaagtccaccaacaagatcaacgccatcatcgctggtaagcagcctgctgccacctggctgaccctggacgaggctcgtgccgagctcgagaagggtgccgccgcttgggattgggcttccaccgccaagaacaacgatgaggccgaggtcgtgcttgccgccgccggcgatgtcccgactcaggagatcatggctgcttccgacaagctgaaggaactgggcgtcaagttcaaggttgtgaacgttgccgacctgctctccctgcagtccgccaaggagaacgacgaggctctgaccgacgaggagttcgccgacatcttcaccgccgacaagccggtgctgttcgcgtaccactcctacgctcacgacgtgcgtggcctgatctacgaccgtccgaaccacgacaacttcaacgtccacggctacgaggaggagggctccaccaccaccccgtacgacatggttcgtgtcaaccgcatcgaccgctacgagctgaccgctgaggctctgcgcatgatcgacgccgacaagtacgccgacaagatcgacgagctcgagaagttccgtgatgaggccttccagttcgccgtcgacaacggctacgaccacccggactacaccgactgggtgtactccggcgtgaacaccgacaagaagggtgccgtcaccgctaccgccgctaccgctggcgacaacgagtgataacacctccacggtgttgttagttcgctaacaccaaagggctcgggattcgtcccgagccctttgcttattcataagccctgtcacggcggggcagaacaaagcgaactgttgtgatgttttaatcgcgtagcaccctgaaatgcagcagggcattgcgcacaccgtcgtggtccacatcgtcagtgatgtagtcggcggcggccttgggctcggcggtcgcattgcccatcgcgaccccgatgccggcgtaggcgagcatatccgtgtcattgccgccatcgccgaaggccatggtctgctcgcgcgtgatgccgtaatgcgccatgaaccgctggatgccgcgcggcttgccgccatcggccggaatcagatccgtgaaatccggatgccaacgcaccccgcgcacattgctgcacagtcccaccagttcggcctccagctcgggcccgacaaagggactgatctggaaagtctcatgatccagcgcgcgggtgcgcgggtcctcgaaataccgggtcggtgcggttttgcccagtttgctccacgtggcgcgaagcagatcattggactggttgaagtacacgtaatccttctcgccgaaattgcacaccacatcggggtgacggtccagccagtcgagaatcacctcaatatcagcagtatccaaggcctgcgaggcaaagaagccggtgtcatcaaaacaatactgcccattgaacgccaccacgccatcgaacgtcaccggcatggtatccagcaccacgtgcatctgtgaaggcgcgcggcccgtgcaaatcagcaccttgacgcctgcggcctgcagccggtgaatcgcctcgattgtggaatccggcaccgtatgggtcgtgaaactggtgagcgtgccatcgatatcgaagaatacggctcggatatcggcattggcagtatcggtagtcatagcttccattgtcaaagcccctctcgacgtgctttccggcgtgttcggcacgcctatagcgggttatcaaacgcacgaatcccggacattgcatgcgcgccataaaagacacctatatggcaatcggccattttccgtcactttcgcggttcaagcgcgttatggtgttacccgacatcaattttggagagaggaaatccaatgacagcagcaacccagccggcaaccccggccgctcctaacaataacgagccggtgcgtgtgaaccacaccgcccgcaacgtcatcatcaccatcgtggtcgtggcgattatcgccgtagccgcgttcttcggctaccgcgcgtttgccggtgccaacgagtcgtccgccaagggcagcaagggcaacccggtcaagatcggcgtggtcggcgctaccaaccccgaatgggtcaagttcaagcaggacgccgagaaggccggcatctacgtcgacatcgtcgacttccaggactacacctccgaaaacccggcccttgactccggcgagctggacctcaacgaattccagcacctgctctacttggccaactacaacgtgagcaacaagaaggacctgcagcccatcggcggcaccgccatctacccgctcggcgtgtactccaccaaggtcaaggacatcaaggacctgaagcagggcgacaccgtcaccattccgaacgacgaaaccaaccaggcccgcgctatcggcgtgctcaaggccgccggtctcgtgacgctcaagggcgactggaccgccttctccaccccggcctacatcgacgaagccaagagcaaggtcaaggtcaccccgctcaaggccgaacaggtggccaccaccctgaaggacccgaccatcgccgctggtgtgatcaacaacgactacgtggccgatgccggtctcgacccgaaggacgccatctaccaggatgacgccgaatccgaagaggctcgcccctacatcaacgtgtgggtggcccgcaaggcggacgtgaacaacgagacctacaagaagctcgtttccatctaccagcggaaggatgtgctcgacgccctgcaggagaactccggcggtaccgcggtgttcgccgacaagttcagcgccagcgagctgcaaggcttcctgtccgacattgagaaggatgccaaggcccagcagtgagccgcggctgatacgagcgcacgactagcctgtccatagccattaccaccaagcggagcgagtacccgagccaacaatcgggattcgctccgcttccgtgaccggacaccaacaaccagcatcagggagcactatgagcgaccccatcatcaccttcgaccatgtcgtgaaggaattcaaaacacgcggacgcggcgcgaacatcgcacgagccgtggatgacgtcagcctgaccatcgatcgcggtgacatcttcggcatcatcggctattccggtgcaggcaaatccacactggtccggcttatcaacgcgctcgaacgacccacctccggcactgtgaccgtgcttggtactgatatcacctctctgagtgagaccaagctgcggcccatccgccagaaaatcggcatgattttccagcagttcaacctgttctccaccaaaaccgtggcccagaacatcgcctacccactgcaactcgatcactggcgcaaggactatcaggatcgtcgtgtcaacgaactccttgaattcgtgggcctcagtgagcacgcaaacaaatacccttcgcagctgtccggcggccagaagcagcgcgtcggcatcgcccgcgcactggccactaatccggagattctgctcgccgacgaagccaccagcgcgctcgacccggaaaccaccaccgaagtgctggccttgctcaagcgtgtgaacgaggaattcggcatcaccattgtgcttatcacccatcagatgaacgtggtccagcagattgccggccgcgtggccgtaatgagcgccggacgcgtggtcaaatccggcgacgtatacgatgtgttcgctgcaccccagcagccggtgaccaagcgattcattgccaccgcattgtctggcctgcccgaggaagaccgggtcgagcgattgcatcacgaatggtcgggccgcattgtcaccgtgcttatccgccaaaaggacgtttccggcacccaaggccatgaactcaaggcatccggacagaatatctccgaactcatcgccaaatacggcgtcgaatccagcctgctctacggcggcatcgacacggtcaaggggaccgccatcggtgccatcacctacgaattcaacgggcccggctggcatgtggacgaattcctgcgcgagctcgccgccaatagcgacgtcatcgacttcggcaccgccgcaaagcctgtggcctacgccgacgcagtcgccggacatgcctcctacgccgaagaccgcgcccatgacccactggcggccgatactgccaccgcgcccgccgcgtccgccgccgcacatgaaggagccaacgcatgatcatcctcgccaacccgcgtagcgactggaacgtgctgcgtccactactgttcgaatccattggccagaccctgaccatggtgctcgtcaccctcgtcatcggcggattcctcggcctgatcctcggcgtggtgctctatggcacccgccccggcaacctgttcgagaacgcggtcgtctaccgcatccttgacatcatcgtcaacatcgtgcgcccgattccgttcatcatcttcctggcagccatgcagccgctcaccatcgtcgtggtcggcacgtccatcggcaccgtggccgccatcttcccgatggtggtgatgtgcaccttcgccacctcgcgtctggtcgaacagaatctcgtgccggtcgacccgggagtaatcgaggccgcgcgttcgatgggtgccggcaagctcaccatcatccgcaccgtgctcatccccgaagccctggcaccgctgatcctggcctacgccttcctgttcattggcgtgctcgacatgtctgccatggccggctacatcggcggtggcggtctcggtaacttcgccatcgcctacggctaccagaagttcgaccagaccgtcacctggacggccgtgatcatcatgatcgtactggtccaggtggtgcagggcatcgccaacgccatcgccaaacgactgctcaaacgccagcaataacaaggcatactgaccccatagatcgcggccctcgccaatatggagcgagggccgcaatatattcttcgcgctactagaatcgggaaccatgagtgaacatatcgacatcgaccacgaactcatcactatccgccactacctgcacgcccatccggagcgtagtttccgtgaattcggcaccagcatctatctgaccgaccagctcaaggcgcacggcatcgagatcctgcacaacccgctggagactggtgttgtggggctcattcagggcgaggccggtcccgggccgcgtatcgggctgcgcgctgacatcgacggcctgcccatcgtggaagactccggactggagttcagctccgtcaatgaaggcgtgatgcacggctgcggccacgacctgcacatgaccggtctgctcggtgccgccttctggctcgccgagcaccgtgacaagttcgccggctcgatcaagattctgttccagccgagtgaggagaccggccaaggcgctcgcgccatgatcgacgccggactcgtggatgacgtcgaagccattatcggcacgcacaacaaccccaactatgcgcccggccagctggccatcggcgttgagccgatgatggccggctgcgtgaaattccgcgtgaccctccacgcccaaggcacccacgccggttacccgtacaagggcaccgggcccatcgaagcgctcgccagtattattctgagcctgcagaccatcgtgagccgcaacgtcacgcccttccacccgctggtgctgtccgttaccgaagtgcacggcggccatgtgtggaacgtggtgcccgccgaagccggattccaagggactgtgcgctatttccacaagtcggatggcaatctggtcggccgccgattcaaggaagtggtggaacacaccgccgaggcatacggcatcagcgccgacgtggtctgggatgactttcaagacccgctggtctccgatccaggtctcgccaaggccgtggcggcggatgtcaacgactacgcgcagctcgaaccgatacgtcagtcgatggcgggggaggacttctgcgaattcgccaaggtgacgttgccggtgttcgcgttcgtcgggtcaaacggccaggaaggttgcgccgactggcatagcccgcatttcgtgggtctcgacgaatccattcccaccttcgtcaacttctacgtcaacaccgctctgcgcgtgctcaacgagctgaagtaaatccttttctggctcgcctccggaggctgaggcgttaggcagacagcccagtgggctgtctgtagccgaaggtgaggcgacagccgaaccagatatgcgcgggcctcgcccgtccataagtgcaggacgagctatcagcgaagctgactgaggggagtggcattcgttcattaggtcgattcatcgtccattaggtcggtgaacggcgatactggttgttggaatcgcgccattgcaacgactgatatcgcattgcagtgacctaatgaacgcaaaaacgacctaatgaatgacgccaagccggaagaacaggcaatccgacgtcatacgcggctacactaagaatctatgacacagcttcgcttcgcactcgcccagatcgacacctgcgtcggcgcgcttgacgccaacgccgccaaggtgctcgactactcccgtaaagccgccgcaggaaacgcccaagtggttgttttcccggaaatgaccctcaccggataccccatcgaggatctggccctgcgccgcaccttccgccaagccgcatgggacaaggccaacgaactcgccacccagctcaacgacgacggcctcggcgatctgttcgtggtggtcggcaccgtgggcaccgaccgcaagacctccaagccgcgcaaccgactggtggtcttgcaccaaggcgtggtctgggctggctacgacaagcacttcctgcccaactacggcgtgttcgacgaattccgcatcttctccgccggcgaccgctccgtgaccctcgacgtggacggcgccaccattggcgtggccatctgcgaggacatctggcaggacggcggaccggtggccgacctggccaccaagaacatcgacctgctgctcaccatcaacggctcgccgtatgaggaaggcaagaccaacacccgtttcgagctcgcccagcgtcgtgccgccgaggttaacgccccggtcatctacctgaatcaggtcggcggtcaagacgacctcgtcttcgacggcggcagcttcgtggtcgacgccgacggcacgcttatcgaacgcagcccgatgttcatggaaaacctgacgttctgggacttcgattccgccgccgaacatcaggccaaggccgagatcgttccggaactcggcccggacgaagaggtatacaccgcctgcgtgctcggcctcaaggactacatggccaagaaccacttcaccggcgtgacgctgggcctctcaggaggcatcgactccgcactggtagccgccatggcggccgacgcatgcggcggcgagaacgtctggggcatctccatgccctccatgtactcctccgacggttccaaagacgacgccgccgatttggcctccaacattggcgcccattacgaggtccagcccattgagccattgttcaacgcctaccaacagcaacttgaccttgatggcgtctccgccgagaacctgcaggcccgcatccgcggtgtgatcgtgatggccagctccaattcgcgcggtctgctcgccgtggccaccggcaacaagtcagagctcgcctgcggctactcgaccatctacggcgatgcggtaggcggctacgcacccatcaaggacctgctcaagacccgtgtctgggagatcagccgttggcgtaacaaggccgcggccgcaggcgtcggcatcggcggtctcaagatcgcgggcaacgaggacggcaacaccggcatcccgttgaaggacggcgtgatgattccggtctcctccatcgagaaggcaccctcggccgagttgcgccccgggcagaaggactccgactccctgcccgaatacgcgctgctcgacaaggtgctcgccgcatacatcgagcacgcgcacggccgcgccgacctgttagccgacggcttcgaccaggtcaccgtagacaccgtgatgcgattggtggaccgcgccgaatggaagcgccgccaatacccgctgggaccgaaggtcacggccctcgcgttcggccgcgaccgccgactgcccgtcaccaacgcattcagggaataaacatatattgctcccgccagcgggagcaagtaataccgttgaggaggtaccaatgacagacgataacaagaagcagtggtatttcaacaccgtcaagaagcaggccgagttgggcatggtctcaccgatcgaacagcgcatgggtccgtacaagaccaaggaagacgccgaacatgcgtgggacatcgtggtggaccgcaatgccagatgggaggaggagaaccggcgctggaagaactacggcgtgaaacccgcacaggctcgccccgaggattgacggtcgaaaactgacggatacggttctgctgtcaatctcaagaccgaaccgctcatacgaacatcacagtatgagcggtttcccatatctggagacgtgcaatagtcccatcaatatctagaagccattggaatggtagcgttcacagaaacaatgtgagatagctcactcccaatttcagcttttctcaagcaagtgccaactacactgttgaaccaagggttccgtgaagatgcgaaacctacaaccccatttaaggagtgacatgaccgcagtggaaaatgcagctgtctcccaggaggagctcgacgccaaggcgtgggccggcttcaccgagggcaactggcagaaggatattgacgtccgcgacttcatccagaagaactacaccccgtacgagggcgacgagacattcctggctcctgccaccgagaagaccaagcacctgtggaagtacctcgacgacaactacctggccgtggagcgcaagcagcgcgtctacgacgtggacacccataccccggccgacgtcgacgccttcccggccggctacatcgactccccggaagtcgataacgtggtcgttggcctccagaccgacgttccctgcaagcgcgcgatgatgccgaacggtggctggcgcatggtcgagcaggccatcaaggaagccggcaaggaaccggatccggagatcaagaagatcttcaccaagtaccgcaagacccacaacgacggcgtcttcggcgtgtacaccaagcagatcaaggtcgcccgccacaacaagatcctcaccggtctgccggacgcctacggccgtggccgcatcatcggcgactaccgccgcgtcgccctgtacggcgtgaacaagctcatcgccttcaagaagcgcgacaaggactccgtgccgtaccgcaacgacttcaccgagccggagatcgagcactggatccgcttccgtgaggagcacgacgagcagatcaaggctctgaagaagctcatcaacctcggcaacgagtacggcctcgacctgtcccgcccggcccagaccgcgcaggaagccgtgcagtggacctacatgggctacctggcctccatcaagtcccaggacggcgccgccatgtccttcggccgcaactccgccttcctcgactgctacatcgagcgcgacctccaggccggcaagatcaccgagaccgacgcccaggagctcatcgacaacatcgtcatgaagctgcgcatcgtgcgcttcctgcgtaccaaggactacgattcgatcttctccggcgacccgtactgggcgacctggtccgacgccggcttcggcgatgacggccgttcgatggtcaccaagacctcgttccgtctgctcaacaccctgaccctcgagcacctcggacctggccccgagccgaacatcaccatcttctgggatccgaagctgcctgaggcctacaagcgcttctgcgccaagatctccatcgacacctcggccatccagtacgagtccgacaaggaaattcgtagccactggggcgacgacgctgccatcgcatgctgcgtctccccgatgcgcgtgggcaagcagatgcagttcttcgccgcccgcgtgaactccgccaaggccctgctgtacgccatcaacggcggccgcgacgagatgaccggcatgcaggtcatcgacaagggcgtgatcgagccgattaccccggaggccgacggcaccctcgattacgagaaggtcaagaacaactacgagaaggccctcgaatggctgtccgagacctacgtcatggccctgaacatcatccactacatgcacgataagtacgcgtacgagtccatcgagatggccctgcacgacaaggaagtgtaccgcaccctcggctgcggcatgtccggtctgtccatcgccgccgactccctcgccgccgtcaagtacgccaaggtctacccgatctacaacaaggacgcgaagaccctggaaggccacgagtacgagtacgttgagggcgccgatgacgatctggtcgtcggctaccgcaccgagggcgagttcccggtctacggcaacgacgacgaccgcgccgacgacatcgccaagtgggttgtctccaccgtgatgggccaggtcaagcgcctgcccgtctaccgtggcgccgtcccgacccagtccatcctgacgatcacctccaacgtcgagtacggcaagaacaccggttccttcccgtcccgccacaagaagggcaccccgtacgccccgggcgccaacccggagaacggcatggactcgcacggcatgctgccgtccatgttctccgtcggcaagatcgactacaacgacgccctcgacggcatctcgctgaccaacaccatcacccccgatggcctgggccgcgacgaggacgagcgcatcggcaacctggtcggcatcctggacgccggcaacggccacggcctctaccacgcgaacatcaacgttctgcgccgcgagaccatggaggacgccgtcgagcaccccgagaagtacccgcacctgaccgtgcgcgtctccggctacgcggtgaacttcgtcaagctcaccaaggagcagcagctcgacgtcatctcccgtaccttccaccaaggtgccgtcgtcgactgatgaccaaccccgcgaaccgcggcaatgactaactgaaggggtggggcacggctccaccccttccttatttcccacagaccttcgcatcatttggaacaggaggacaacgatgcccgcaacacccacgttccgcaccacgaccaggcatatgctcaaggaatcgaagacctatgcctcgcagactttgatgggcggcctttccggctttgaatccccaatcggactcgaccgacgtgaccgcctttccgccctgaaatccggcgatatcggcttcgtccactcttgggacatcaacacctccgtggacggaccgggcacccgcatgaccgtgttcatgtccggctgcccgctgcgctgccagtactgccagaacccggacacttggaagatgcgcgacggcaagcccgtctaccttgacgccatgatcaagaaggtcgatcgttacaaggacctgttcaaggccacgcatggcggtatcaccttctccggcggcgaatccatgatgcagcccgccttcgtctcgcgtgtgttccatgccgccaaggagatgggcgtgcacacctgcctcgatacgtccggcttcctcaacacgaattacaccgacgagatgctcgaggacatcgacctgtgtctgctcgacgtcaaatccggcgacgaggagacctatcacaaggtcaccggcggcaccttgcagcccaccatcgattttggccagcgactggccaaggccggcaagaagatctgggtgcgatttgtgctcgtgccgggcctgaccgactccgaagagaacgtcgaaaacgtggcgaagatctgcgagtccttcggtgatgccgtcgaacacatcgacgtgctgggattccaccagcttggccgcccgaagtggcacgaactgcgcatcccatacccgctggagaaccagaagggacccaacgccgccacccgcgaacgggtgaccaaccagttcaaggaccacggcttcaccgtgtattaaattgcagggccgaaccgcgcgtaaataccacgattcggcccgttcgcccataccctagagatatggccgacatctacgcatttcctacgggagagtccaacgacggacgccccgtgcgccctcagggtgtgccggatgaagtatgggcagccgtcgaatccgtcagcaccatgaagcgcatccatgacgtgcgctatcgggagattcccgtgccttccaccttggccgattatggtatcggcgtggaattcgaagcgggagagcgtgccctcggcgatgccttttccgccggtcttggcagcgatgccgaatcacgaatcgccacaggctggatcatgatgctttatgctcatgagctgcgcattgactgggattccaactggcgttgcgtggcgttcgcgcgactgccgctggaaaccgccgaaaacgattctctgacccccggcatgtactgggatgacatgtgcgactatttcgacggcatcgagccggattcggtatccggcacagtcaccgtgacccaaaacacggcttttggctcgatggccggctccaccagcgccgggtgtgagattcgcgtctcatggaccccgcttgacgggaccgggccggacggtactatggacgccggcgcacaagtccgctcgtgggccgcattcatcagatccaccatccgttttgaggaggatgacgccagttgagtgacgtccgtgacaccgaaccccgactgctgaaagagcctcgcgggggagtacccgatgtcacttcgacgctggacggctatcatcgtgtctgcgatgcgatggccgaggcgacgggctcgctggccgccgacgccgaacgggcgtccggcttccgctatggacacgaggattggctgattcagttcaaacgtgagggtgcaggcatcgccttgcttgatcccgtcgccctgacccgggccggagctgattggaatgaattcaatgacgccgtgggcgacgccacgtggattctgcatgattctctgatggacttgcccggattcgccgaaatcgggctcaaacccaaagccctgttcgacacggaaatagcggcgcgattgctcggcctgcaccgctttggtctggccgccgtcaccgaacactacctcggcatcacgctagccaaagagcattccgccgccgattggtcctaccgtccgctgccgcgcgactggcgcaactatgcggcgctcgacgtggaggtgcttatcgaacttgaaaccatgatgcgtcgtgacctgaaagccgcaggcaaggacgagtgggccgctgaagagttttctcacgctttggttgcgggccttgccccgcgcaaaccgcatccgattccttggctgcgtatctcgcgcatcacccagctgagtcgtgatccaaggggcttggccatcgccaaatccctatgggaggagcgcgaccgactcgcccggcaatacgatattgcgcccagcctgttattggccgattcatcaatcatcgaggcggcgaccaacaagccgcacaatgctgcccaattccgcgcgctccgatccctgaacgagcgtgtgcgcatccataccggcaccgagcaggacaaaatgttcgagcggtacgcgccgattcagcgtgcggtcaaaccgaaggtctggaagcaggccatcgatcgagccatagccctgaagcccacccaatggcctaccatgcccgcccccgaacaggacgaaaacggtgtggtgaacgcgccccgatccatgcggctgtggcaacagcgccatccggagcgttatgaccgtctgcaacgggtgcggcgtgtgatcaaccgcatcgccgaagacacccgcacgccggccgagatgatcatcaagccacagatcctacgcaacctgtgctgggtggaagacccggtggaagtggacgtcgagacgttcctgatcgagcagggcgcaaggaactggcaagtgaaactcattgcaccgtccgtaagtggcgttatcatgtagaggttgccttacggcagaactgtaagaaataacgacttttgaggagtcattagcgtgaagatcagcgttcgtaacctcgagcccaccaaggtgaagctcaccgtcactgttgaaccggaagagctcaacccgtatctggatgcggcccgtaaggaaatcgccaagcaggtgaacgttcccggcttccgtaagggtcacgttcccggcaagatcatcgaccagcgcatcggtttcgccgccgtcgccggtgaggccgtgaacgacgcggtcccggagctgtactccaaggccctggatgagaagaagattcgtccgatggctcagccggagttcgacgtgcaggatgttccgcagtccgccaacgacgagaccaagctgaagttcaccgccaccgtcgagcgtcgtcctgacatcgaactgccggaaatcgacggtcttgagatcgccatctccaagccggaagtcaaggatgaggacgtcgacaagcgcctcgagaccctgcgtcagcgcttcggcaccttggtcggcgtggaccgcccggccgccaagggcgacttcgccaacatcgacctgactgctgagattgacggcgagaccgtcgactcccaggaaggcgtgagctacgagctcggctccaacaccatgctcgacggtctggacgaggcccttgacggcctgtccgccggcgaggagaccaccttcgaaggcacgctggaagccggcgagcacgagggccagaaggccaccgtgaaggtcaaggtcaactccgtcaaggctgaggaactgccggagctgaacgatgagttcgcttccgaagcttccgagttcgacactctggacgagctcaaggctgacatccgcaaggctgccgctcaggacgccgaaggtcgtcaggccaccgaggctcgcgatgccttcatcgccaagctgcaggaaggcctcgagatcccggtgccgaagggcgtcaaggccaacatggtcgaagagcagctcaagggcatgaccccggacccggagaaggccaccaaggagcagaaggctcaggccgaggagaccgtggagaaggatctgcgcgatcagatggtgctcgacgctctggccgagaagctggacgttcaggtgtcccagtccgacgtgttcaacttcctcgcttccatcgcccagcagtacggcatggatccgaacaacttcatccaggccatcatcaagaatggccagcttggctccgctgtgcaggaagtcggccgttccaagggcctgctcgccggcatgcgcgccgtcaagttcaccgctgatggcgaggttgtggacctctccgccttcctgggcgaggccgctgaggacgaagagtccgagtccgtcgaggccgcttccgctgctgccgccgtggccgacgaactgtccgccaaggatgacgccaaggatgctgagtgagcatagcctcatcgcgttagcgtgattgtttgagcccggaatcgtgtttcatggttccgggctcttcctattctggcaaaaggactatttctttggctcccctctttgaggggagctgtcgagcgtggcgagactgaggggagttcccaaggcatactcgttgcatagggtgcggaggttgacatgcagccaacggttactatcaaacgccttggttggctcgctgcggcgaccattgtgctcggcgtgctcatcggtgtgggagcaggtctgctgaccctgttgctctacggcgttgaacatgtgctgctcggctacatcgaaggcccagaattgcctggttcattcggcgtgcccgctgcacgccgtgcgatatcggtgaccgtgggactcagcatcgcaggcattatctggtatctgctgcgacacaaaacgactgcggtgccctcagtcaagaaggccgtggcgggaaagcgaatgcctttctggcaaaccattgcgcatgtggtattgcagattttcatcgtcggctccggtgcctcgatcggccgagaagtcgccccacgcgaactcggcgccatgctcgcgcaacgtttctgcgacctgttccatatcgagggcgttgacggcatcgaccggcgcatggtggtggcagtggctgccggtgccggtctaggaggcgtctatgacgcgccactggccggcatgttcttcgccgtcgaaatcctgttggtagatgtgacaatcgaaaaagttgcgtttggactgggcatgtctgccattgccgcattcgtggcggttgcgatcaaagggcattgcctgttctacgacattaccgccatgcaaccggaatccacgccaacgttaatgctgttcgctctgatctgcggtgcggcatgtggagtgggcggcgcattgttccgaaaaggttcgcaatgggcggaagcgcacaagccaaccggtaaggctattctgtggcagatgacgctggctggtctcatcaccggtttggtggcgattgttgtgccgcaggtgatgggcaacggccgtgccgcagcgcaacttggattcagcacattcattcctgaaaccgccggcactgctggtgccatgcagtcggcatcttcagcggccgcctctccatggaacttgctgacgggcggcggtaatgtatccgattcggcctctggcgggggagcgggctctggaatggcatcgttctgggccatgcttcagggtgggagcggcccttctggatccgtgatgaacgccggtttcccgctgtcccagtccaatatctggatgttgctgggtgtgttggcactcacctttgttgccaaagcgctggtgacgctgatgaccattcgctccggtgcgtcgggcggtgtgctgcagcccggcatcgcattaggttccacgctgggtgcgatgctcggtctcgtatggatactgatgtttccgaccgattcggtaaccgcgtgtgccttgatcggtgcggcttcgttgctttcggcctcacaacaggcaccgcttatggccatgtgcttggtgatggagctctctgaagcgccgattaccttctttgtgccggtcggcatggccgtggccacgtcgtcactgatatcaaagtggttgctgagtcgtaagtaaatacatatattctggctcccctctctgaggggagctgccccggtcgaaactcccctcagccgcctatggcgacagctcccctcagagaggggagccgaggtaaagaaagctatgtcagaaaatacagaaattcgctcggcacttgaattgcttgccgctgagccgctcactgagcagattgactactatcgaaagccattcatggtgttatgggccgccattcaggaggcagccagcgatgtggccgaagactacgacttacctgcggatatggcccaattatgggtggccgaacagatgcgccaagtcgccgattcactggtcgatcggctcgcggaaaaagccgtggcccatggtgccagcaagtccaacgtagcgcgagccgccggtgccagccccgccaatgccgcccgtcgcttcccgcgtctgggcgacgatgccgcctcccagacccgcctcctcattgacgacgtcctcgacaccctcgaataaaccgaaatccctacgctgcccgccaaaaagcacgcgaaaagccgccttcagtcgcttcaaggcggtagtctgaacaatgttcgagtaattagaaggagaatcaaggtgagcaatacctttgcgaccttgccggtcatggcgggcgatgacgtcccggccggccccgtcgacccgattttcaaccgtctgctcaaagaccgcatcatctggatgggtgaagaggtcaaggacgatatggccaaccgcatctgcgctcagctgctgatgctggccgccgaagacccgaagaaggacatctggctgtacatcaactcgccgggcggctccatcaccgccggcatggccatctacgacaccatgcagctcatcgagcctgacgtggcgaccgtgggcctgggcatgtgtgcttccatgggccagttcctgctgagctccggtaccaagggcaagcgttacctgacctcgcacgcccgtgtgctcatgcaccagccttccggcggcatcggcggcaccgccactgacgtgcgcatcaacgccgagctcatcatggacatgaagaagaccatgagcgagctgaccgctgagcagaccggccacaccctcgaggaaatctaccgcgacaacgaatacgaccactggttcaccgcccaggaagccctcgactatggcttcgtggacaagctcgtgaccacgccggacaccatcggcaacaaccagcagggggagtgagactcatggcaagtgaagaagcaaagttcgccgcccgtgccgaccgcttggccggccgtcagggcgtagccggtttcatgccggcctccgcccgcgcagcccagcccgcgccgaccaaccgttacatcatgccgcagttcgtggagaagaccccgtatggcatgaagacccaggacgcctactcccgcctgttcgaggatcgcatcatcttcctcggcgtgcaggtggacgacgcctccgccgacgacgtgatggcccagctgctggtcctcgaatcccaagatccgaaccgtgacgtgatgatgtacatcaactcacccggcggttcgatgatggccatgaccgccatctacgacaccatgcagtacatcaagcccgacgtgcagaccgtgtgcctcggccaggccgcctccgccgccgccattctgctggcctccggcaccaagggcaagcgcctgatgctgccgaacgcccgtgtgctcatccaccagccggccatcgaccaaggcttcggcaaggccacggagatcgagattcaggccaaggaaatgctgcgtatgcgtgaatggctggaggagaccctcgccaagcacaccggccaggacgtcgagaagattcgccgcgacatcgaagtggacactttcctgaccgctcctgaagccaaggaatacggcatcgtggacgaggtgttggaacaccgccagtaaaacttccggacattgcaataccctcggtcggcaacgaccgggggtattgtatttcaaggatgacaatgataatgcgcagcgtggcggttcgacggtgcggcgcagtcggcaaaggagaatcatgggacgtgtggtgagctacaacgaggacgtaccccgttgcacgttctgcggcaaaaccgaacatcaggtacgaaaactggtggccggtcccaatgcctccatctgcgatgaatgcatcgccctgtgcgtggacatcatctccgaggagcgtgtcaaagatgccgaggtcaattcgctgagcctgcccaagcccgctcagatcttcgattatctcaaccgctacgtcatcggtcaggagaacgccaagcgcgcattatccgtagccgtatacaaccattacaagcgcgtcaacatggagcttcaggagtccgctgagcagcttgacgggaataacgggcacagtggccagaccggcaaacaagccaagcaatccgttcccacccagacgcgtgctgcccgccgcagcaatgaccctttggctgacgtcgaggtcgccaagtcaaacattctgttgctcggccccaccggcgtgggcaaaacctatcttgcgcaggcgttggcccgcgtaatgaacgtgccgttcgtcatcaccgacgccaccaccctgaccgaagccggctatgtaggcgacgatgtggaaaccgtgctccaacgtctcctccaagctgcggatggcgacgtaagccgagcccagcacggcatcatctacattgacgaaatcgataagatcgcccgcaaatccggtgagaacacctccatcacccgtgacgtgtccggtgagggcgttcagcaggcgttgctgaagatcttggaaggaaccatcgcctccgtgccgttggaaggcacgcgcaagcataaggagcaggacgttgcgcagatggacacacgcggcatcctattcatctgcggcggtgcgttcgtggggctgacggacattgttcgcaagcgattaggccgtcgagagaccggcttcggcgcgaattggcacgacgccgacatgaaagacgaggaattgctcgaacaggtcaatgccgatgatctggccgagttcggactgttgcctgagttcatcggacgtttgccggtcaccagtgtgctgaaggaacttaccgtagacgatctgacggcgattctcacccagccagccaacgcgctgatcaagcagtaccgtaaactgttcgccgtcgacggcgtcgatctgcaattcacagaacaggccattcgggcgattgctgatatcgctatcaagcaggggaccggcgcacgcggtttgcgttcgattatcgaacgtacgttgcaggacacgatgttccagttgccgagtttggatgatgtgaggcaggtgattgtggacaaggcgtccgtagagggttccagcacgcccaaactcctgcgcgaagccgtggatgtgccgcagggacgtctcaaagttgcgcagtcggttttgcttgaccgagtccgtacacacgaggcgtgaggccagtaaatacgccgttgcggtagtggtcgggatggtgcgactcgccgcaacacgccgagttgcattcagctgaacggcgtgtattatatatcgagttgtctgaaagacaacatgcgccagtagcccagcggattagagcagctgactacggatcagcaggtcgcaggttcgaatcctgtctggcgcactcccgaaccacggggacaacagtggtatgcgccagtagcccagcggattagagcagctgactacggatcagcaggtcgcaggttcgaatcctgtctggcgcacagtaagcctcgaaagcgaaatgcttccgaggcttttccaattgtattggcccgtttgagtcggttgagtcggccacacagggttgggctaaggttgcccttcgcgactcagcccggagcggaacgtcctgagacattccgtactattacatacggttcatccaagagagtgcagcaaggagacgcgatggccacgaccgccggcgcgaagaagggactttggtccaccatcaggcgaatcgccgcctcagaccgtatttccggactcatcatgcttggcttcgcgctcaccggcctggtgctcgcgaatctgcccgccaccgcgcatgcgttcgagaccgtagcggaaacgcatctgttcatcccctacaccaatctcgacctgcctattggccactgggcccaggatggtctgcttaccatcttcttcctgaccgtgggcctcgaactgaagcaggaactcaccaccggctcgcttgccaatccgaaagcggccgccgtgccgatgctgtgcgcggtgggcggcatgatcgccccgcccatcctgttcctggccgtcacggcattgttctctcagatcgggcctggtgaacccggcacgctgattctgaccaccaccggcagcagcatcccgttctcggagatgtcgcacggctgggcagtgcccaccgccacggatatcgcgttctcgctggccgtgctcgccctgttcgccaaggccctgcccggttcgatccgcgcgttcctgatgacgcttgccaccgtcgacgacctgctggccattattctgatcgccgtattcttctcctcgattaacgcctggtattggttcatcggcatcgccgtatgcgccgccatctgggcatacctcgtgcgactgaaaaaagtgccgtggatcgcggttggcatcgtcggtatcctcgcttggatcatgatgttcgaggcaggcgtgcaccccacactggccggcgtgctggttggcctgctgaccccctctcgtgaaatgcacggcgaactctcgccgcgtgccgaacgctatgccaacaagctccagccattctccgcactgctggccctgcccatcttcgccttgttcgccaccggcgtacacttcgagtcgatgagcccgctattgttggcctcgccgctggtcatcgcactgattgtggctttggtggtcggcaaacctctgggtatcatcaccaccgcatggctgtccacgcatgtgggcgggctcaagatggccaaggggctgcgtgtgcgcgacatgattcccgctgccgtcgcctgcggcattggcttcactgtgtccttcctcatcgcttcgctggcgtacaagaacgcggaactttccgctgaggcgcgcttcggcgtgctggtggcctccctgatcgccgccgcgatttccggtgtgctgctgagccgtcagtccaagcgattcgagaagaccgcagccgcagcagcggctgatgcggaggatgacgaatcgattgatggtgatggcatcgggcagccaagccacaccacagagcccaccacgcccacggaacaccccggcaccctcgccgacggcaccgccagtgtggaaatcgacttccgccactgatggcttagacggtccctactccattgttggccttgtttcgtgaaaaccgtacgctgagacgcgctcagtgtacgttcttcacgagatgaggccttatttcgcggaaaacgtacgctcagtgtcactcaccgtacgttcttcacgaagtcaaggatgatttcgcggaaaacgtacgctcagtgtcactcaccgtacgttcttcacgaagtcaaggatgatttcgcggaaaacgtacgcagagcttcaggcgctagaatgcgaagagtcgatagcgccgtacaggaggacattggatggcaaagaagcagaagaaatccaagaagaacgacggcaaaaaggccgctgaagcaaagaatctagccgaggccgcatccaagtccgcagtcgtggacgatatggaaccattggaagccacagccgcgaatgatgcggcggcgttggaggctgagacggcaactgaggctgtggccacaccggtgaacccggtcgatctggaggacgcctcgccgctgggcgacacctatcatcgcggcccggtgattctacgcggccagatgattccctcggacaacaccaccgccaacctgctgaaacccgatcaggacaccgactggctgcacatggacccatggcgtgtgctgcgcatccaatcggaattcgtggacggtttcggggcgctcgccgagctcggacctgcggtctctattttcggctccgcacgcacccagcgcaccgaatcgatctacaaggcagcacggcgcatgggtagccagatagccaagcgcaacatcgccgtcatcaccggcggtggtcccggcatcatggaagccgcgaataggggagcggcactggccggcggcaaatcggtgggacttggcatcgaattgccgcacgagcaggggttgaaccagtgggtgaacctcggcatgagcttccggtacttctttgtgcgaaaaaccatgttcatcaagtattcctccggcgtgatcgtatgcccgggaggcttcggcacactggatgagatgttcgaattattgaccttggttcagacccacaaggtggcgaatattccggtggtgctctacggcaaggaatactggcaggggctctttgactggctcaacggtccggtggccgagcatggcatgatctcgacgatcgacccgaaactggtcaccgtaaccgatgacgccgacgaagccgtggacgtggccgtcagcgcaattgtgaggtaagcgagatagagtggctcccctctccgaggggagccaaggacagagttactttttgtaggcgatgagcaggccggtgccgtcaggggtgagcgtggactcgaaaccttcgtcatcttcgacggtggtgagcagctcacgcatggcgatggccttgtcgctgcggtcggccggattgatcacgccgccctgaccgtcctccaacgccagcacatcggtgaacacgatcacgccgtgcacgcgcagcagacgggaggcctgggcgaacgtggcggcatagttctcggcgtcgcccgccaccacgatcagatcgtaatcattggcgttgaggcgcggcagaaacacgctggccggggcgttcaccgcacgcaacgtggtgtcggtctcgtcctgcagctcggcgaacgccttgcgaatcagcgcgatgccctgggcggtggaatcgaccgcagtcagcaggcccttgttatccagtgcatgggcgagctgcaaggtctccaccagcgagccggtgcccacggcaatcaccgaagcggcgccggtgatgcgcaccagcatgcccagcagacgggcctgcgccgccgaaccctgcaactggccggactcgtcggcggccgtacgggtgtcggtcaacgcatcggattcacgttcgcgcgcgtgttcctcggtgaattcccatgccttggcgaggttggtgtactgcgttctgtccataattcgttctttcatgtcttctctcgtgcgggcacccagcggatgcatcgacgcatgtgcttaggcgatcgccgcagccagccgcggcgcggcttagcgctcgcggaccttagccacgatctgccacatctcctcgcccacatcgatgccgcgcgggcagtggcgggagcaggcgcgcacggactggcaggcggccacgccgtcggcggtgtcgatggcatccatacgctccatggccttggtgtcgcgcgaatcgttgacgaaacgggaggcccaaatcagcgcggccgggccgatgaaggcgtcgccgccggcgtacaccgggcaggcgccttcgcacacgccgcaggcgatgcagttgctcagcagctcgtatttggcgagttgttcggggttctgcaggtattcgaacacgtccaccttgccttcggcggtggtggcgagcacgccgtccgcctgaagatacggggtgagcttcctgatctggttgagcatagggtcgatgtcggcgatgaggtcgcgctgcggcgggaagccgggcagggacgccagttcgatgactcccagcgaaccgtttgcggctgagttctgggcggccgccgcgtttgcgacgttttccgcggaatcgtcggattcctcagcctcggtgccggtgtgtcggaacccttcgtcatcgacttcgggcatggcgccgggttgcttggcccaatcgcggatggtggctgtgcacagcagggtgggggtgccgttgatggccacggcgtccgaaccgcacatgccatgaccgcacgaataacggaaggccagcgtcgggtcgacggtgcgtttgatggtcagcagacaatccaacacagtatccgaagggcgcgcgggaatcgtgtactcctgcacccactgcttgccgcgcggacgacggcgcgccgccgaatccgagccgccgccgaacggggagcctttcttggcaaacgggctgccaccgcgtgcacgttcggcacgctcgggtcgcggcgtgaaacgatgcacttgcagggtaaccgtcgtgttgctcgcctcagccatgttctgcctccatgaaacagtgggatgtcaagtccaatattagccaacctattgtgccacaagccctaggcggcttgggtattaccaccagcggatcagtactcgcgcttcttgggcggatagtcggtgatgtgcaccggcttgaaacttaccgaaccatcatcggcgaccatcgagtgagcaaggaaatgctcatcgtcgcgttcggggaaatcaaggcgttgcatggatccgcgagattcctgacgggattcggaagcgtgcagcatgacctcggccagttcgatcagatgacggacttcccagatggcggtgacctcctgattgaaagcggcggtcttgtcatgggcccgcaaggtatcggcaaccggtgtgatgtcaccgttgatctgggtcaacgccgtatcgatggtctgagcggtgcaacgtacggccagagcctgctccatcactgatccgagttgggccatgagctgataaggattggcggtgggcactccatcgtctgaatcatctattggcccggcgagcagttcgtcaagctccgctttgcgagaatcggcagcctgatcggcggcatcggtcagcatgtcatcggccgaatcatcggccatggggagtcaaccgggttctcggcgatgcgtgcggccatcgtctgaccagcgcgtgtgccgaacagacaggcgtcgagcagagaattgccgcccagacgattcgcaccatgtacggagacacaagagcattcgccagcggcgaacagtccatcgactacctgcacggcaccgtcggcccaacggtacacctcgccgtcggtggtgatggggatgccgcccatcgtgtagtgtgcagtgggcttgatgggtactaggtccttggccggatcgaggttcgcgtactgctcgatggtttcgaccacctgcggcagcacttccttcatacgttcggggtcgatgccggtcatatccagccagacgcagtccttcggaccatccgggtccttcgggtcggcgacgccgcgaccggcgtcgatctccgccatgatggagcgggagaccacgtctcgtgcggccagatccttatgctccggagcgtagcgttccataaacggctcaccgtcggcgttcctcagaatgccgccctcggcgcgggccgcctcggacagcaggatgccggtgtgcgcgagcccggtggggtggaactgcacaaattcgatgtcctccagctgcagaccggcggccaaggtcaaggccatgccgtcgccggtcagatcccaggaatttgacgtggtgtggaacagtcggcccgcgccaccggtggcaagcagcacgttgcgcgcgtggatggcctgaatcttgcccgaatgcgtgtcaaaggccacgatgccggccgcctgcttgccgtcgtcggcgagcaccaggtcggtcacataccattcctcggcgaactcgacgccggcggccacgcactgctgccacaaggcgtgcagaatctggtggccgatgcggtcggccgcataggcggcgcgcttgaccggggcgccgccgaactcgcgcgtgtggccgccgaaccggcgctgggcgatatgcccgtcctcggtacgggagaaggccacgccctgacgctccaggttgatcacggtctgcggcgcgtattcggcgagcagtttggccgcatcctggtccaccagccagtcgccgcccttgatggtgtcgtagtaatgccagtgccagtcatcggactccacattgcccaggctcgcggcgatgccgccctcggctgaaccggtgtgcgaacgcagcggctgcagtttggagaccacgaggatcttcgggtccacgccttgttccttgagctcggtgatctcgggggagcgcagcagtcccaacgccgccgacaggccggccgctccggcgccgacgatcaccgcatcatacatatcttccaaacgtttcggactcatgggttcgattctcgcacacccgccgaacagccttcgagccgtgtcatggaagccgattagccgacacggctgctcagcttgagtatgccggcatcccgctcgatcactcccttcagctccaatgcgccgagtagctcaagtatggtgccgatattgggaatctcgtcgggtaccgtctctcgcgccacacgcaatagtgcgtccggggtgacgatgagatgtcgtttacggcattcacgaatcaatgccactaatgtgcgttccatttccggcagcttggcgataatgatacgttgttgggcttccttctcgggatcgggcttcggcttgacacgaagatccggcatctgatgtgacgagggaagctcttcacccttgcttttgtcgttaccggaatcggcagttgcgctcgccggcccatccttggattgagtgcgcgtaggctgagtatgcttggtcttcgaacgtttcgaatgacctgaatcttgtgacgactcctgtgacgccgatgattccgaggatgctggcgataacggagtcgttgccggcacttccatggcctcctcgttttcggacgagtcctgacctgtggatttcgatatgcctgggcatgctgccataacgggcttatgccgttcatggcatatatcctcggtggatgtggcggcacacagaatcatcgctcggtggtcgccgatcatcttattgcacccggcgttgcaaggctgattgatgtcaccgggaaccgcatacacttcgcgcagcaattcgcatgcccatcccgcggtgttgagcgctccggaacgcaaccgggcttgcgtcacaatcaatgtggaagacatggccgcgataatgcggttgcgaagcagaaaacgacgggcttcgggaatcgtcccggggcacagttcactgatcagtgcaccaccctgcgcctcgatgcgttcgaacagcgtgcggttacgcatcggtccgatatggttgagcccgccggcgaatacggcaacggttttgcccacattggcgggcattctgccgtgcagcgcattcaacgctccccaatgtgccgccgcatccgtgcccatcgcgcctccggacacgaccagatgcccggcaacggctgcctgttcggctacggtgtgtgccacataccggccatattcggtcacgtcccgtgaaccgacgatgccgaccggtttggcgcaactggtcaatgcgcgtggatcgcctttgatccacaaacacagcggtggcgcccaatcggagcgaatggacaggtcggccaactgcgagggccaacatggatggccagggccgataatccattgcgtgccatccatagtgaaccagtcggccagttggatgatgtcttgcgagggcaggtccatcatgcggttatgccagcaggccagtgcattgcggaaggagcgcatcgcgttcgccgacgccttgcggccccatcgagtgaggccgtccacgaacatgcggtcaatacgtgacagcgccgggccgcagatttcagatggctggcttggatgggattgcgccaacgcatgccagagggattcggcgttttccgcgcctttgagcgtggcgtacatcatcacatccgcgccatcaagacagaacgtgagcgcggcacgatacaacgtatccgtgggaggtacgggaatagtgcgcgaaacggcgagactcgtatcggtgtgatccacacttcctgcggtgccgccagattgccggatatcagtagcgttactcatgtcatcctcgttctcatttcgatgccctgatggacgtcctgttcagtggggatacgcggccggccagatcggcgagcgtccaagacagacgcatggcgcgatcagccccgcgcaatgtgagttgatgattggacagggcccgattgaccaattccatcgctttcagcgatgtattggcgtgcagccatttgcccgaagcttgcgcgttgcacacccatccatactgtctgaaccggtctttggccacttgacgggcacgaatcacacgagcttgtatcccggcactggactcgccgattggctcgctttgcgcggcaatgcgcgagactggtggcaccgccatctgaatatccacacgatccagtatcggtccggacaatcgcgagaaataacgtatacggtctttttcccggcaagcgcaacgttcgccggtgccgtaatagtatccgcacggacaggggttggccgccatgatgagttggaatgaggccgggtagtaggtgctgccttttgaacgggaaagcgccacatacccggattccaatggttcgcgcaacgtctgcagggcgcgtgcgctgaattccggtgcctcgtccagaaacagaatgcctcgatgcgcgcgtgtgattgcgccgggaacggcgatgccgctgccaccacccaccaaggccgccgtgctggcggtgtggtgcggtgcctcgaacggcggcatgtcggtgatgccgtactgaggcagtatgccgcacagcgatcgaatcgatgccacctccagctgttccgcctcgttcaacgggcacatgatgccgggcatacgtgaggccaacatggttttgccgctgcctggcgggccggtcatgatgagattatgcccgcctgccgccgccacttgcagtgcccatttggcatgctcctgacccagaacctcgttcatatcgccacaatcgttgggatgacttgtgggcgattgatccgtggtggtctcgtcggtaaccggtgtatcgggaatcgtataggtggcatcgccgcccatcagttcgatgagctcacccacatgcctcacgcccactacatccagtccatccaccatcgaagcctcgtcaagattgcgatggggaacaatcattttgcgcacgccacgttcctcggcatgcagcatgatcgggagcagcccatgaatcggcagcaccgagccgtcaagattcacttcgccgagcacaatggtatcttctaggcaatcatgccctatggcacccgccgcacataggacgctggccgcgatggccagatcatgcgacgaaccgcgtttgggcatggccgcagggctcatgttcacggtcacacgggtttgcggccaaccgaatccagtggcttgacacgctgatttcacgcgctcgcgggcttcggacaacgatgcatccggcaatccgatgatgctgaagtatggcaagccagggctgatgaaagcctgcacttggacgatgaaggccttaaggccgatcagtccgactgagagggtgctgccgatagccatgtctactcctttcacaatgtgtttcgcaacgtggctgttttttttgggggggggcttcagaaggcattttcaatgtgatgcacgagcggcctgcccacccgaagcacgatggtgacgacatcgaaacggaccgccgaatgcggcacccgattacgccggtcaagtagccaatcgcaggcggctttcctgagattgtgctgtttcgccggcgtaatggcctcttgcggatatccgtaatgcatggaccggcgtgatttcacttcgacgaacaccaccgtgtactcgggattgagcatcacgatgtccaattcgccgtaacgggtatgccaattgcggctcaaggtcgtccaaccgtgttcctccagccacgcggcggcatactgctcgccgagcgcgccgaactgtttgggcgtcagattgcggtcgcccatcgtggccgcaatccgttccgaaggcagcattgcctgcggatcaggtgaagccagcatgggctggtgaaaggcaagaccggcgtcgatgccggacttcgtcgtcggctgagtaggtggtaaagcgttcatgattccactgtgcgggttacttatgtaagagcacaagcgcaaccggcaaatgtggatactatgacgcggtttggcgtgttgtggataacgtgtggatgaaaactcggttatccaccattagttcagaaggtttaccaaggctcaccagtcgacttccctgtgacgaaaaaacaacccatcggattgttcgctgaatacgtcagacccagtgagcggagaggggagccaaggtgcggtcacttcaccaaatcggtgagttcgccaaggttcagttcgaaactgacgccacgatcctcgaaatgcggctggttacgggtgctgaccatggcgtgacgcacgaactcaccggcgatttcggccgactcggccaggccgcggccggccatcaccgcgccgcacagggcagaggcgaaggcgtcacccgtgccatgaatcatgtatggcaacttctcatgagccagctcgatcttgccggcaacaccggtggaagcgctggccacatagttgacgattttgccatcgccatggtcaatgcccttcagcaccacgttcttggcacccaactccagcagagcaccaagcagctcgttaaccgtggcctcatcaatatcctggccaggatagtcacgcttggtgagaatgctcgcttcggtgaggttcggcatcaacacgtcggcaccatcggccagcgcgcccattgcctcgcacagctccggtgtgtacgtggggtacatttcgccggcgtctcccatcaccgggtcaaccagacgcagcgcgttcggatattcgcggtagagacgctgaatgatcgccacctgatcggggagccgaggaagcctgaatacacgccatccagctccacgtcttccttctgccaggcatccaagtaaccggagagaatatccgtggtgtcatggaacgtgaacactgcatagcgtgtgtgcgccgagaacagggcggtcggcaccgggcacacatcgcagccggcggccgagagaatcggaatcgcggcggtcagcgagcacttgccgtagccgcacatgtcgtgcacggcggccacgcgcggaatatagttcggatcacggtcatacagagttacatcggtcatgtctgttcgaatcccttcaccatgttggcggaataattcattggcgatgtttgactgtagtcgttcgtcatgtaaaccatgtaaccgggcggcagaaaaatgaaacagacgtcatcaccgagcgggcaaaccgtcttggtgacgggtggaacaagcaatcatcacggacacttgagccatgcgcgaaaggcatggcagcgatatcaccgtgaccgcagtcgaccttgaaagcgcatgcgtgcggcccggcgtgtcgcgataatttcaacgactttttcgtgacttctgacagtcgctcacgtcaatgattccaaggctttataagcccttataggcaagtccgataacgttcagcttgcgccgcgcggcccaagcgtcgtaacttcataaccaacacctcgccaaccgcccgaacacggcaggcgggtggcaaggaaaaatcctcgcgacctagcacaaccaaggagaataccatggccgagaacaacaagaagtaccgttttgaaaccctgcagctgcacgtcggccaggagcaggccgacccggccaccgactcccgcgcggtgccgatctaccagaccacctcctacgtcttccacaacttcgaccacgccgaggcccgcttcggactggcggacccgggcaacatctacggccgtctgaccaactccacccagggcgtgttcgaagaccgcatcgcggccctcgaaggcggcaccgcgggcctggccgtcgcgtccggcgcggccgccgtggaatacgcggtgcgcaacatcacccagtccggcgaccacatcgtcgcagccaagaacgtgtacggcggcaccttcaacctgctgcgccacaccctgccgcgcgacggcatcaccaccaccttcgtctccgccgagaacccgcaggagttcgaggacgccatccaggagaacaccaagctcgtctacttcgagaccttcggcaacccgaacgccgacctgcccgacttcgaggccatcaccgccatcgcccacaagcaccacctgccggtgatcgtggacaacaccttcgcctccccgtacctgttccgcccgctggagcacggcgccgacgtcgttgtggaatccgccaccaagttcatcggcggccacggcaccaccctcggcggcgtgatcgtggaaggcggcaagttcaactgggccgaagtgccgggcaagttcccgaccctgaccgagccggatccgtcctaccatggcctgaacttctatgaggccctcggcggcgccgccttcgtgacccgcgtgcgcgccatcctgctgcgcgacaccggcgccaccctgtccccgttcgcggccttcctgctgctgcagggcaccgaaaccctgtccctgcgcgtcgaacgccacgtccagaacgcgctgaaggtcatcgattacctgaagaccgttccggaagtcgagtccatctcccacccgtccatcgaaggccgcaaggacaacgagctgtacaagaagtacttcccgaatggcgacggctccatcttcaccttcgacatcaagggcggcaaggacgcggcaagcgtgttcatcgacaacctgcacctgttcagcctgttggccaacgtggccgacgccaagagcctcgtgattcacccggcctccaccacgcactcccaggagacagtggaggagctcgaggatcagggcatccaccaaggcaccatccgcctgtccatcggcaccgagaacatcgaggacatcctcgatgacctgaagggcggcttcgaagcccttcgcgcttccggcttggccaagtgaggtcgacaggaaggttgacggcccgatgagaaggggcgcgatgctaatggggtgcatcacgaatcatcgagccgcatggggtgccttccgcctgatcgcttgacccaaggaatagaaagctcgcactgatgtcatgcagtgcgggctttcttgcgtctgtatgcctcacactgtttgcgcagaggcatgaatagtgtgagacctgagacgacataatcctcaaggatgagggccggcgcgtggccgaccgcccaattcagtctggcgcacgatggggcgcgccgttatttcttcataagttggaatcatcatccgggcataaggcccggcccaatatggagaggcattatgaacgtgcagaacccgtccgcatcgcgcggcatcgttattcaggccgtcgacttggtcaagaactacggcaccggcagcaatatggttcacgccctgcgcggcgtgaacgtgagtttcgaacgcggcaaattcaccgccatcatgggcccatccggttccggcaaatccacgctgatgcacacgctcgccggtctcgactccgccacttccggccatatcttgttcggcggcgccgacctgacccgcatggacgacaagcagctcaccttgctacgtcgccacaagatcggcttcatcttccaaagcttcaacctgttgcccatgttcaccgcagagcagaacatcctcatgccgctgactttggccggtgataagcccgaccgtgcctggttcgatctgctcgtagaaaccttgggactcaagcaacggctcaaccatcgtccgaacgagctgtccggtggccagcagcagcgcgtggccatcgcccgcgcgctgattaccaagccgaagctggtgttcgccgacgagccgaccggcaacctcgactccgtctccagcgccgaagtgctcggcttcctgaagcgttcggtcaacgaactcggacagaccatcgtcatggtcacgcatgatgcggtcgccgcgtcttacgccgaccgtgcgctcgtgttcgccgacggccagatcgtggcggacgtaaacaagccgacagcagaccagatgagtgaactgctgatgaaggaacgtgaggccgccacaatgaatgtggcttccgcgagacattcccgctaaacgcactgtagaagcattcgaagaagggaacagaatccaccatgtggtccatcactttgaaactcatgcgaaaaaccaagcgcatgctcatacccgcaggcatcgccatcatgatcggcacggcgttcatcgccagcaccttcctgttcggcaatgccatgaacgactccctgacacggcagctgaccgccatgttcggaaacgccaactatgcggtgagcatcaacagctccgacctgagcgataaggaactcaacgaggcgtattccagcactgtcggcgactttcatctcgaccagatcgccggcatcgaaggggttggcggcgtccgtgcctcggtggaaaccggcgtcagcgtttccaagggagacagcaccgtcagcggcgagatcatttccaccgcggcacagaagaacatgctccccgtgaatatcacggaaggggaccagccgaaggattccaacgaagtcgcgctgccggaagacatggcgaaacagctgaacgtcggcgttggagacactgtaagcctgacctcccgatatgcggtaggcgacgatggcaaagccaaggcggacaacgtgcgcgtggtaggactcacatccgatccgaacggcgcctactcatactatggtggtgcgatcgtaggatccaacaatctgcttgccgcaatgcagggagtggacgatttcaacgccaccggaacaacaatggtgtatctcgaccttgccttggatggaaacagcgtatccgcaaaaaccatcaacggtgtgaaagcgttgctgccaaagcatttcgatctgatgtcacgacagcaaatcagtgacgaaagcatcaaatccttaagcggcaaccaaaccaacatcgtcaccacattccttatgtgcttcggcgtgcttgccatgttcgtggcggctctggtgatcgccaacacgttccaagtgctcgtggcgcaacgccgccgcacactcgccttgctacgcaccatcggcgcaaagaaaggccaactgtatggttccgtgctgttcgaagcggtggtgctcggcttcgtcgcatccgtgcttggcgtggtgctgggaagcctgctcatgtggggcatgtgcgtcagcgacatcatgcaagagggtatgcgattcaatttctcttggcaagccgccgtcgtacccattcttttcggtattgtggtgacggtgctcgcatccttgggatccgcacgttccgctactgcggtgacaccattggaggcattgcgcccgatcgaactgaccgacaaccgtcgttccagcctcacgcgagccataatcggtattctgatggtggtggtcggtatcgccatggcagtattttccatctggcaggtacaagccaccaatggcggcgaggaagcgaacagcgatcaattcacgatgattctgctcatagccatcgccggtgccgcactggtgttcctcggcatggtagtcaccgcggtgttttggatgccggccctcatgaagggcgttggagcgttggcctcgctgacaggcccttccgcaacggttgcgcacgccaacattcagaagaatccgcgacgcatcgcagcaaccggtgccgctctgctcatcggcgtcaccctggtttccaccatcgcaaccggtgccgctagcgccaaagagactatgaatggtgcgctcgccacccgttatagcgtcgacatcgtggccatgggcgatgacatcagtcagcaaatggtcaaggatgtagccgacatcaacggcgtgtccgacacattgtatgcgccggcggtttccgtgaccttggagaaagcggatggaacccagcctacgtccgcattgctggtcggtgtgaagaacatcgatcaggtcaagcaggtcatgcgtgccaacttgggtaacgcctccatcgacagtgatagcgtgctcatgccaacatacaatgcgcaaaccggcaaggaactgcagttcgccaatggcacggctgatttctccaccgaatggaatcaggacggcgtcactacgcgttcgctgacattgcaagcaaaccaagccgactaccgtcgcgtatccgcacagtatggagctgtcggattcgtggatgaaagccatttcaccaatggtgaccttgacgccgccacccatgtgttgctggtcaaggcagatactgacaaatcgggagtttccgttgacggcatctacaacaacatgcaggccgcattggagaagagcactgatgcaacagtgaccggaccgattgccgaacgcatcgaatgggcgaacatgatcgactccatgatgatgcttctggtggggttgatcgccgtggccgtgctcatcgcacttgtcggcgtagccaacacgctgtcgctgtcagtgatcgaacgcacccgagaatccgccacactgcgtgccatcggcatgactcgaggccagttgcgacgctccctcgcggtggaagccctgctcatctcgctggtatccggcatctcgggcgtactacttggcaccctgttcggctggctgggcgcatacgtggtgttcagtatgtacggcaaagtggtgttcccgttcgaatggggcattaacggcatcgtactcgccgtggcagccgtggcagcattgctcgccagcgtattccccgcacgcagggcagtgagcacgcctcctgttgaggcgctcgccgaagcctaagcttcatagcaaacacaacgaaaaggactcctgccacaaacatggcaggagtccttttcgcgtatcatgcatacgcaaaacaacaaatcaatcagaccaaatggttttcgtaagcgaacaccaccgcctgcacacggtcacgcgcattgatcttcgccagaatatgcgccacatgcgttttcaccgtcggcaggctgatgaaaagcttatcggcaatctcctgattcgacaatccatgcgcgatctcaataagcacttcgcgctcgcgatcggtcagttcatctaattccggatcggtgtacgtcgaatcagaagtggaagaagcagtggaatttccatgtgcgccaacattcgcagccatgaaatcgccttccatcattttctcgataagacgtttcgtggcggacggtgcgataatcgcattaccttgaaaaaccgtgcgaatcgaattcaacaacgtttccggttccgtatctttcagcagaaaaccggaagccccggcagtgatcgcagccataacatattcatccaaatcgaatgtcgtcagaatgatcactttggtatgagtgacttctgattgcgttccatcggcagcaaagcgatgctgcaacgcactgatctgccgagtcgcctcaataccatccatgccgggcatacgcacatccatcaacaccacgtcaggatgcagcgtttccgccaacgccacagcctctgcaccatcgcgagcctgcgccgcaaccgtcatatcaggctgggagccgatcaccatggcgaaaccggcgcgtaccaattcctgatcatcggcaatgaccacacgaatcttctgttcttcactcatactctccaccttatcggcattgttccgctcacagcgcgaaacaaacccttaaatctccctgaaaaacttgaatcggctatcgaggcacgcgctgcagctgctcctccaatggtgctgcgggcctcaactgcagttcgctcgcactaccggcatgagcgtcatcgctgaaaccagtctcacgaagcacgccaagcaattcgcgcatacgcttaagcgcggcgcgcccctgctcgccaatggctttgaacgctgcggaaatctcgtcggcggtagtctctttgccttgtgcttcggcgctatccagcatgcggataccatcgacggcttgactaatcacgctgttcaacgtggcggtgacttcagcctgaatgctggcactgatacggtcacgttccatattcgccgcgagaatacgctgcttctcctgctcggccaccagtgcctcttcgcgagcctgcaacaccagtgcgtttgaatcactggaacgcgcccaacgtgcccacgccatgatgccggcgcacagcatcagcactgcaaccgtatacatgacgccggtaaagaatgctgcactactacttgacgtggctgaaaccggttttgttaagcccacggaagcggcgatggcgccgaacaaggtagtgtatccgtgttgatcagctgcgattttcaagcccatcagagctgaacaggtgacagcggcaagaccggtccaacgccatgcgtgttcacgcccatacaatacggctgaatacagcgcacacagcgacgctacgatatgtccaacctcaatcaatcccaaaaaaaccaattgcacaaccgacaatacgaacacaataagcgcgcaagtctcggggaacctgcgtcgaagagccagtgccagcaagcagcatgcggcgatcgcatgagagagctgcgcatcgcgtgaactatcaaaaaagaatgtaatcgacatgcgattcagcagcatgaccaataccacggcaccaacggaatccatgagcacataatggtgctgcgtccacgcggaaacacgttccacccaattcagccctcgcgaattggatgtatttgcaagttctacggatttcagtttcagcgatgtgagcaaatcatgcagattgggtgcggtgatgcgcaagtgttgcagggcgttcgaacgatggtcgcgaccggttggttggttggtttcctgcgtctgttccgatggttgatcggggattcgcgccgatatgttgacggctgtgtgagatgcgattgcttcgtcggataatttcgctttgctggatatggcagttgtgttgcaagattcggactgttccgaggcatactgttcgccggtttcgtctgtcgctggctctttaccgccgtaaggcagggtggccataacttcgaagcctccgccgagttgagggccagcctgcaatgagcctccggccgattcgatgcgttccttcatgcccaacaggccgtaacctggcgtatgcccgtcgatattggccgccgcgccacgaccattgtcggtgacggtcaaagtgagtaaaccgttgttccatgactctttaatatgcacatcgacgtgcggccccgcatacttgcggatattcgtcagcgcctcctgcactacatggtaggaagctatcgaggcttgttcaccgagttgttctgggctggcggtgccggtgatattccatcggattcgaatgtcgggggagacgtttcgcgcttgttccacaagattgcctatatcgttataatcggcgtgcggtgaacccccgaatactcccagaagacgttgcatgtcatgcagtgcgcgttccgattcgtgtcgaatcgtctccatggtgtttctagccaccgcgggatcatgcgtgcctgcatagcggccgccatcagactgcacgatgatgattgatagggtgtgcgccaccacatcatgcatgtcgcgtgcgatgcgtgctcgttccgccaacgcggcgatatcgcgttcgtcctggtctcgtgcggcgatcgcctcattgcgttcccgcatcatacgaacggttgccagacgggcacgctgccagaacgctacaatgacggtggaaataatgcatacttcgaaaatcggcgtcagcaccaacatgtattgcgccaccatgttggcgacttccgacatggatgttcctgtgtagatggagccgagagtgtcttccgtgaccattgagccatttggatttgagccattccaactgctccacgtatgcactttgccaccggtgagcagcggcccattggtcatggtccatgccatcaacgccgaagccagaagaccgatggccaacgctagaataatgaaggctttcgtgtttttgggattgccgtagacgatcaccgaatacagcatgaccaatgccagaatatcggcgcccaatatgcaagggccgaatatgagatgcgtcaaggccaatgccacacagagcaacgctccggtctgtggccgccatcgacggatcagcagcgggatcagcattgccgcttcccacgccatctgtatggaaggattaaggtcaaacagcaatcccggattataggtgatgctgccggtcacgccgaacagcagaacacctatgacaagcgtgaggatgagatcgcctgcgaagacatgaccatgcatccacgacaggaaacgctgcttgaaattcgacatacgctccaccctagcgccagatatgctgtgacgccatcgtgcgcaggaatgaaataacggtaagataaagccgcttttgtgaggtaaggttatctccgcatgtgggtgagatggaatccatcaagaagtcactacccgcattgaatatgccgatgacgccaaaggaaaggtgaatgcatgacgttgctgagcgaatactacgtgcccggattgcatattgaggatcgttccatcaaggtgccgttggattgggcgggtcacgagcccggtcatgggttcgatggcgaatcgatcagcctgttctaccgtgtggtcaccgctcccgaacatgtgcatgacgacctgccgttgctcgtgttcctgcagggtggtcccggtggttccggtccgcgtccgctcggcccaagttccgatggttggatcgaggaagcgatcaagcatttccgcgtggtgttgccggatcaacgtggtacggggcgttcgtctcgtgtcgacacgcatgtgattgagggcatggacggcgacggcaaggccggtgccgcgtttttgaagcgtttcctcgctgattcgatcgttcgtgatttcgagcatctgcgtcgcaccgaattcgggggcgcacgttgggtcacgcttggtcaaagctatggcggattcctgacgttgacgtatctttcgctgttcccgcaaggagttatcgccagtttcaccacgggcggcattcctcatgttcccgccgatgcgaccgacgtgtaccgtcatacgttcccgcgcatggcggcaaagacgaagcagttctacgagcgttacccgatcgatatcgaacgtgtcgtggccgtcgccgacattctgcaatcgcgcaaggtcacattgccgaacggcgacccgctcacggtggaacgcttccaatgcttgggatccgatttcggtatgaagccgagtttcgaacgcgtgcattggattcttgaccaggcattccttgacggcgacggttcggcctcgacctcggcggaactgtctgacgaattcctatcttccgtgatggaggcgacctcgtctcgcccactgtattggccgttgcaggagttcatctacgccaacggcgagctgaaaacgccgatttgctgggccgcccagcgcgtgcgcggcgagcatccggaattcgcgggtgacatttgtccgcttaatttcaccggcgaggccatgttcccgtggatgttcgagcaggaacgtgcgttgcgtccgttcaaaccagccatggatgtgcttatggaagacacgcatttcggcacgatctacgatgccgaccagttggcgcgtaacgaggtgccgttgcaggccgccgtctatttcgacgacatgtacgtcgactccggtctgcaatttgatacgctgtcccgtgtgggacgatcgcactattggaccaccaacgaattcgagcacgacggtgtacatggttccgtggtgttcaagcacctgttcgacgaggcgttgaacaggggagacctggaagaactgttctgacattcccgaaattctccgaaaccatcgcatccaaaacaattacgtccattagaaaagacgacaaggaggacaccatgtccaatccaaccatcggattcatcggatacggcaacatggcgcaggcgatcgccgaaggcctggtcaatgccggcacaatcagcggcaacgacattgtggcttgtgcggcacactatgacaagctggaatgtaacgccgccaaacttggtgtgaaagcggtgcataccgctgcacaagtggccgaagccgccgacgtggtcgttatcgccatcaaaccgtatcagattgaagcggtgatttcaccgattgttgataagctggcgcagccaaacaccatcgtcgtgtccattgcggcaggctgggatctgaacaaattccgcgacctgttcggaacgtctttcgaacaggcacacatccaatgcaccattccgaacacgccgatggctgtcggcaaaggcgtgctggtcacggaaatcgacaacacgctcacgcaggaacagacggaaaccttcgaaagcctgttttcgtcaatcagcctgattgaacacgtggacaccgcacacatgggcatcggcatgtgcatcgccggctgcgcgccggccttcaccgacatgtacatcgaagcattgggcgatgccggtgtgaaatatggtttgcagcgtgccaccgcgtatcgtctggccgccaaaatggtggaaggcgtgggtgcgctctatctggccgacgaaacgcatccgggtgccatgaaagacgctgtctgctctccaggggcaccaccatcaagggtgtcgcatcgttggaggaaagtgcgttccgaggtgccgtgatcaaagcggtcgacgccatcgaagcctaatactaagctaaggaaccatgtctcttactatcggaattgtcggactgccgaacgtcggcaagtccaccatgttcaacgcattgacccgtaacaacgttctggcggaaaactatccgtttgccaccatcgaaccgaacaccggcatcgtgccattgccggatgaccgtctgccggtgcttgccaagctcgtgcacacggagaagatcgtgccggccaccgtcaccttcgtcgacatcgcaggcatcgtcaagggcgcttcggaaggcgaaggcttgggtaacaagttcctcgccaacattcgcgaagccgacgcgatctgcgaggtcgtgcgtgccttcgaagacgatgatatcgtgcacgtcaacggcaaggtcgatccgtccgacgacattgaaaccatcaacaccgagctgatcctcgccgatctgcagaccatcgagaacgcgctgccgaagttggagaaggatttgcgcggcaagaagatcgaaccggcctacatggaggccgtcaagcaggcgaagaccattcttgaagccggcgaaaccattgataaggcggctcgcgaaggtcgtttcgacaaggattccgtctacgatctgcacttgatgagcgccaagccgttcatctacgtgttcaacgtggatgatgccgaactgcagaacaaagacatgcaggccaagctcgccgcatccgtggctccggctccggccattttcctcaacgcgcagtttgaagccgacctgaccgaactcgacgaggctgacgctcgcgagatgcttgcggacgccggtcttgaggagtccggattggatcagttggcgcgagtcggctacgatactctcggcctttccaccttcctcaccgcaggcgagaaagaagtgcgcgcatggcagattcacaagggctataccgctccgcaggctgccggcgtgattcacacggacttcgaaaagggcttcatcaaggccgatatcgtctcctacgacgatttcgtggctgccgaaggttccatggtcaagatcaaggaggaaggcaagctacgtcaggaaggccgcgactacgtgatgcaggacggcgatatcgtcgaattcaaattcaacgtctccaaaaaataagtgtttctctggctcccctcttttgaggggagctgtcgctacaagcgactgaggagcggcacggataaggcctgagaagtcgtcttctcaggcctttgtcatgacattgttctgcaaggactggctgctgcggcagcataatgtgtgttttattattcggccttggcggcttgctggtcaatccaattgttaacgtcggtgaccgcctcgtcaagggttgctttggcggctttgtagtatttggaatctacaggttgacgatttccgcgccgaacggccagagtgcgagcttggccatcttgaacgattgcagtccgaacggaataccgataatggtgatgcagttgagtacgccggctcccagatagccgagcgccatccagcagccgaccagcaccacccacaggatgttggccaaggcagagccgactccgccgccgtattgcacggttttgccaaacggcgtcaaggtgagtcccgccatcttgaacgcttgaatgccgaacgggatgccgatgatggagatgcacagaatcagtcccaccaatgcccatccgattgcgatggccaatccaccaagaatgatccacaggatattgccgagaactcgcatgattagtccctttccgattccggtcgattccgcgcatgttcagcttcactattttgccagaaatcatgacggaaacacgagatgcaacccttagctcgcccctgattcatccccggaccgttattcaggcggagcgtatgcggtaagcccaatccttttgtgaagattttgtgtattgtcaggcatgcgtgggtttcaccgtcgatttgaatgatgataagcttctcgatgtctgccgtacgaagaccccatcaaggagatgccatgaacctgtatcgctacgcgatgttcatcgcacgcgcctgccgtgggtcgttcgtcggcaatgttctgtttgccaatccacgaatggccctattctcgatgctggtgtagcggggacacgccttatgccgggatgtaccgatggcccatccgcagtcgacgtcgcatgaatcgctcaccatagccatcaacttacgcaaagccgcgaatcgtttgccgtatatgaatgcggaacggatggcggcttttcctttacgtccggactcatcggtgtcctcgtgtcttgacacaagcatggggccggatcgccacacatgacgttaccaacagaaggaaatgctgtgacctcacagaaaaacgcggaactcgggtccgccaccagttccgtaaagcctattgatccgcacacccgattcatcgttgtgggtgtgatcgtcgtcggctcgttcatcgcgctgctcaaccagaccgtcatgtcaccggccttgccggcactgatgcgtgatttcaatatcaccaccggcaccgtgcagtgggtgaccagcgtctacatgctggtctcgggcatcatggtgccgatttcaggctatctgattgataaattctccacccgaaagctcttcgccggagctcttgccactttcatggtcggcacactgctgtgtgccgtcgcgccgaatttcatgctgttgctcgtcgggcgcatactgcaatccgccggctccggcgtgctgttgccattggtcgccgtagtgccgatgctcgtctatccgccggataagcgcggcaccgccatgggactggccggtatcgtcatggccgccggcccggctatcggcccggttgtcggtggtctggtgattgacagtttcggatggcgcccgatgttcattggcatcgcagtcgtggcactggtcatccttgtcggaggcacgatgatgctcaagaacgtcagcgagttgaagaacccaaagctcaacatcctgtccgtgatcctttcgaccatcgcgttcggtggcctgctttatggcttctcgtccgcttccacgatgggatggagcaatccggtcgtcattatctcaatcgtcgttggtcttgtggccttcgtcgcattcgtatacaagcaagtcaagctcgatgagccattgttgcgcgttgatacccttgccacccgcaacttccgcaactccgtgattctggtcactctgatcaacgccgcagtcgccgcaaccaacgtgacgttgcctatcttcatccagaatgtgctcggccaatccgccaccgtcaccggcatggtcatgctgcccgccgcggcggtcggcatcatcctgagtccggtcgccggcgccgcattcgacaaattcggccctcgcggcgtgggcatcggcggccttgcgctcatgaccatctctcttggtcttctcggcaccatcaacaccaggacatcagtgctgtttgtcgccgtgttctgcgcattgcaggcatccggtcaggctatcgccaacatgccgatcaacacttggggcgtcaacgctttgccgaacgacatgatcgcccatggaaacgccatcgccaacaccggccgccagatcgcggcagccattgcgacctcgcttctggtcaccgcagaaacatccatgaccgcctcgcacatgtcccagggtgtgaagtccgccacggccagcggcatcgcgttctcctacctgctgtgcgccgccatctcgctggtcgccctgattatctgcatcttcaccgtcaccagccgtgccaaggagaaggacgcgcgcaacgccaaggcctccgaggcgcaatcctccgccgaagtcgcggccgaaaccactgaaggccagcccgccgagcatcactacgccggcgcatacgtggcccccgccgcctccctgttcaagcaggcccaggaacagtccatcggcggaatcatggacgatcagccctacagctgcctggacagcgatgacatcacgcatgtggtgcgcgagttcatccgcctcaacgtctccagccttcccgtggtgaacggcaatggcaggctcgtcggcttcgtcagcgacggcgatgtcatgaaatcgattgccacctatgaatcccgtacggtttccaccggcaccggttcgacgatggtggtgttcgacgacgaaaccgtggcctccaaggtacaggcgctctccggcaagaaggtgatggacatcgccacgcgcaaggtcgttgccgccacgcccgaccagcatgtcggagaggtggcccgaatcctcgccaagaagcagttcaagaaactgccggtggtggatggtgatggcagactcgtcggtgtgatccgccgtaagtccgtgatggaacatgccttcgatgcgctgttcccaaaggatgatcggtgattaggcgccatcatcgctgaatagaatgaatggaatatgaggcttcccttctcgcgggggaagcctcattgctttgtccgcggagtcttacggcacctgcgcaagggcaacgtcacgccttcatgatacactattgaacagtgtgttcctatcgttgcatggtgacgctaacgcatggcgtcacgatactgaagtctgccatctaacggcgggtacggctcgttgctggagtcgtgcacgcatacgcgcgtcggcgtgcgtatgccgtgatgtgacctttgtagtggaattgaagaattgagaacactcgtatgtcttctagtcaaaaaacaactgaaccaactgtgcgcgaaacacccgaggtttccgacgatgacaatgtgaatgcgcgcgcagcggtccatagcgcgaacaaacccggtgccgcctatgccgcagcagtggccaatgaggaatccgagcgtgcgtggatccgccgtgtagtgcttctactcactggccaggcgttctcactgctgggctccaacatcgtgcaatatgccatctggtggtggattgtgatgcagacgaacagcggcatgggtatgctgctggccacgttgtttggcgtgatgccgcaggcgatcgtctcgattttcggcggctcctgggccgaccgtcacagtcgcaagttgctgattatgctgccggatatggtgattgctgtggtcaccgtcgtgctgtcgctgagcttcgcgatgggatgggtgagtctgaccatgattttcgtggtgctgttcattcgttcggcgggcggcggtgtgcagacgcccgctgtgcagtcgttcttaccggatgttgttccctcgggcaaactattgcgcgtcaactcaatatacggcgtgattaattcggcgaatatgattgtggcacctgcggtggctgctgtgcttatcaacacagtgccgctgtggtcgattctgttagtcgatgtgaccacggccattatcggcgtcggctttgtggcgttgatcaaagcgccgaagaagagcgcggaacatgttgcgaggcgtatggctgaagcggagaatagcgggcaacccgcactcgaaccgatgtcggatgccaatgctgatcgttcgctgattgccggcgtccgtcgtgtgtttgctgacttgaaagatggcttcagctacacatggcgccgggcgaacctgcgcaacgtggtgctcggtgacaccttggtgtgcttcgtggccgtggcgccgatgaaccttacgctgttgctcatgacccgcgaatatgagggcatcgatttgaatctcggattcatcaacctgaccaccgcctccgataaactcgccgccaacgagctggaatggagcatcggtatgctgctcggcggcgcgctgatgtctaccatcggtgccaagctcatccgcaacaacatgcgcgtggtcgccttcggcatcactctggtgggcgtctccgtcgttggtcttggcgtggttcacaatctgctggcgtatttgctgattgatgtggtgaacggtttggcttcggccatctgcatgggcccgatgcgcaccatcatccagaccgaggccgatgagaagatggtgggccgtgtattcggccttgacaccaccatgagcacactcagcatgccgctgggtatgttgatcttcgcgccgttggccgacgtgatcccgatttcgctggtgttcatcatcggcggtgtgctgactctgcccatcggcatctatctgttcggccaggcgcgccacaacaccagtgcacaggtgactcggacacaagcctgacagtcgcctgacagccacctcgcaggcgcaaagtcaactaccctatttgcgcatacagatcgtaagatgcatacttcggtagatcgtagacggtgatcgagaatggtgcggatcggccattgcccggccaatccacgaatgtgatatctccatagatgattgcgttctgtgcgttgcgcagtactagggaaatcttgatttgctgcccatcggatggcttgaatccgtctgttgtggcgcggacctcgccattgaacgtcgtgccgccgtccctgttgtctattttggatgttccgctgatggggaaggtagcggttccttgagcctcggtgacgttgtacgtatcagggctaagcacaacgaaatctacggtggccggggccgtgccctcgcccgcttggccggcgttatatacagtctgattcgggaatgccataatcagtgtttgcgtctgcgagaacacgatggaaccgcctttggcccgccccgtaatggtaatctgcggatactgcacctgctgggtcgtactggtgttgcgcagggcgaaagcgtagtggacatacccttgctggttcgccgaccagccggattccactattttcagaggattatcggtgacggtgtcttggccgtttccatcagcgccgtcagtgccgcctactccgcccgtgccattggcattgtcggttcctgccccgttcgaggagtgcccgccatcggccttatcggttgattggctgctggattgtgtcgaggaatcgggtgatgttgccgacccgataatgccaagttggcctgccaacacaatgcctcccgcaatagcggcgaccaccagcgccgctccgacgatggaccacagcacgatggcgcgtttgctcaagtgcagacgccgaaatagtcgagacgccgacgtgacgtcgttcgttgtgctcggtgatggcggatttgccgatgatgcgttcggcatgggcggattggactgggagaacagcgcctggcgaaactcctggacgctctgtggccgtttgctgggctcgaatgcgcacgcatagccgatgacggcgcgcagtcgtgccggtactgcggcatcatcggcaagtcgctgctcgtagtcgctggcatcgggatatacgccggtcagcatgaatccgagcagtcgaccaagcgagaacacgtcggaacgcgcgtcggttttggcgaagccatattgctcgggcgaggcgaaaccataagtgccaagcgccgtggtgtcccgcgagcgattgcttgacgctgaccatatgcgcgcaatgccgaaatcgatgagatgcgcgccgtcccgagccaggatgatattggccggcgtgatgtcgcggtggataacgccgtgctggtgaagctcctgcacggcttcgcaaatttggtcgataagctgcacggccacattcggcgcaagccgcccgttttcctccacaatttgcgcaagcgtgctgcccggcacgtaatcgtagacgatgacgaaccggtcgggcagctcgtacgtcgcttccacgcgcggcagacgattactctggcaggcgctgagcaccgcccacacattgcgttgcgctaggggagagggaatcttcttgcgtacgaacgggccgttgccgtcaatgctcaccagttcggtgacgccggaaggtccgcgagcaagcgtgcgctcaacatggtacgcatcgtcgatgctcatcgcatgcatcgcttgcttatcgtccatgtctctccttgatgccctcttacttgcgtctcactggtgagtgttgttgggccgaatgtcgtcaatcggccggcagcaacgtcgcctctcccatacgatacaactcgtcgtccgtggcaatgcggtcgaatccattgcgtatgcaccagatgataatcgcgtcacgtcgctgtttgcaccacagttcggaaacgcctgcaagacgaagcagccgttgggtttcgcgtaatgtgcacttgagaccaaaagccagcatgatggcgtgatctcggccggggcggcttttgccggagaaaatgtcataaaccactgtggcgttgaggccggatgcccgcaccacgtcggctcgtttcaggccatgggcttccatacggtcgaacagatagtcggtcagcgtgcgtgcgctgacgagtccctcatcgagatactgctcaatgctggcgctggcgagcagccgatccagcagttcctcggtcaaatgttcttcggggatgtctgccattgcctatgctccttgtcgctgtgttgcgggtgctgtgctgcgccatcgtacgcggttgctcgattcccagcgtacaggacgccgacttttcggaaacacgccgaaaaattcagttgtcagctgatgtatggcccgcgcgtgtcgccgacaatggtcgatgccatccgtgtaggtgcggtggcggaaaggatgttcatgcgcggtatcaagcatcgacaataaagctaacatgcatacaaaatgctaatttgcgtacataataacaacgccatacactggtttcgatgtatcgcagagcaaagcgagcaataagaagggacgcaatgatgagcgaacgataccggcttgccatggcagtcggattgaccgtaacggttgccgggcttgcctcttctgtgctggtaatgctgctgcttaaggaaagaagggcatcatgacaacgccatttgatcaacaacctcagccggttccaccgtccgaaggcacgaatgacgcaccggaagatcgcgcgaatgcgcctaccgtgccgaatactgtaccggctggccaaccgaacgtagcgtctgatggtgctaccaccactccgatggctccggctacggcatcgcagcggcccgccggcgcgccatttgatcgtgtatatgcggtcagtccgcaacagctgttccaagttattcacgaccagctgactactggcgccacgtttaccttggataacgaaaacacccagaccggagcgttttccttccactcctatgatggggtgaactgcacgctaaccgtagtcccgcagggtgcggcaggggccgccattcgtctggaggcgactggaaacgaaagcgccaagcgcgttgatgagttcctcgccgctctggacaagcgtattggtgtggctcctgcacccgccacacatggtgccggtgctgccactggttttgctggtgccgctgcgcctgccgtgcttgctccgaatgcacaaggggtgaagaagacttccaagctggctgtgttcgccattatttggggagtgttgttcgtactcgcccaatttgtggatgtttctggccgatcctggggcggactgctgttcgccacggtgattccggcactgctctcaggcttcgccgtatacgtgacccgcccgagtggcaaggtgcaaggccgagtgctggcctgggtggcagtcggtatcaccgttgtgggtctggtaatcggtggcgtgttcgtaattcgtgacgatgcgaaggccaaggctgatcgggcggaattggaagcatcgctcgccaccaagtgcgaagcatattcatggccggagtcggatatcgcggcgctgctgccgcagccgaaatccacaaagggtgaaattaaaagcgagtcttcggactatttctccatcgaggtgtgcggtaccgacgccaagcagtatgccgactacgtcaagtccgtgcaagacaacggtttcaccgtggactatagcaagtccgctgacagtttcaatgccaagaacgccgatggatacagtgtgagcgtttctcgtaacactgacgacgagaccatcatgtccatcactatccaggttccggaaaagaaggaagatacgtctacggacggcgacgccgcgaaacaggatgataagagcactggtacgggcactgattccagcgatgccaacaagcagagcgaccagtcttcggatcagaaggcgcagcagaacaccaatgacagtgctgacttcaaggccacgatggacagctacgaggcctttatcgatgagtatgttgccttcatgaacaaatatcagaaatccgacaacgtggtcagcatggctaccgactatgccagcatgatgaagcgttactctgagttctcccagaaggtagacgccattgacgaaaactccctcagcagtgaggattcggcctactacaccgaggtcatgactcgatgcacgcagaagctcgcatcggtgggccagtgatcagactggcgtatcgaggtaacggttttccaagaaaggaacgatgacgatacatgggtatacgcggcagacagtacacgccaatggatgagccggtcttcaacaaggccatccccggaacggaggctctggccggggcgctgaaggacacttttggcgcattccgtagtgggcttgggattaccgaacccgtggtttcggtgaattgcgaaggttgtggcgctccgctttccggtcatcgcaaagaagtcgttcgatgcgaatactgcgatcgcgaaacgcagctataaccaacatgccagcataacggccggtcttgcgattgcatagtcgcaagatcggccatatgcatgagatatcgaggaaaaaacagatggcagttattaaggcgttcgccggcgcgctcggcggtacattcgcggacctgtggcgtgatatcatcaccgctggtccgttcacggaacacaccgtcgttgtgccgggcattccccgcggaagcaacaacgatcgcggttcgaatgaatacggttccgagggaataatcaccaatggttcgcgtatctatgtgccagagaatactgcggcgttcattttctctgaaacaggtatcgaaaacgtcatcaccgagtcgggcggttatgaatatcgcaacggggagcagagcgtgctcgccggagacggcatcggatcgttcttcaatcaggttgccgatcgattcaccttcggaggtcagcctggccgcaccaaatatgtggccttcgtcaacctgcgtgagattcgtggcatcaaattcggcacttctgcgccgctggtgtataacgaccggttctatggcgtcgatttggaaattcgcgcacgcggatccatgtcgctaaaggtcgctgatccagttcgattcgttcgtaactttgtgcctgccactaccgtgtcgtattcattcgatgatgaagggccacgtaggcagattctgtctgaattcgtacagtcgtttattgtggccatcaatttgctgtccaatgaatatcgtatttcgcaattgcccggcaaggcgaatgacatcgcagcatgcgtgcgtggcgatcgggccaatgcaggtacgtggaatgatcgttttggctttgaagtgtccagtgtgggcatcgaaagtatcgagttcaccgagcaatcacgtcaactcgtgcagcagttcgcctcgaataagatgaatgttgccgcatacgagggcgtttcccagcaagctggcaatatggctgcccagcagcgcattgcgcaaggtattcaagacaacggctttggcgatggcggcatgttgcttggtatgaatatggcgcaagccatcaatcctatgactgccgccccggttcaagcgccggcacctgcgccggcaccggaagccgctgctcccgcctctcacacggcatccatgtctgtggaagaacaagtcgaggcgatgaagaaattgaaggaattggttgatatcggcattctctcccaagaagaatttgatgcaaaaaagcacgaaattctcggcctataaacggtgcattcatgcaactcgaaacagctgataatgagggaaacgctggtgcgacacggacaaaatggtgctcagggcttcgaactgggttgttcaatccgtttcgatatttcggcgactcagcgcttgttcgggccgccgtccgggaacatcaagtaggtgatgatgccggcggcggttccactggccaatgcgccggtgatgacggcgagagcctgcatcgccgtgctgagcgtgggcttgcccgttgcggcagtctttgaagccttcaatgtggcggcactgggcttgcgtttctcggtggcggcgttgtcggcaacgttgccaccgtccgtattgactggggcattgtcggcaacggcctcgccgtcctgctcttgagcgcgccgttcgcgaatgcgttgctcaatgggatcgtcgaccaaagtcttgatgatgcgtgccagatcgcggtcttcacgacgtgcgatttcggcgctgaacaccgtacgtaaagcgagatactgcagtttggtcatcgggcttttgccggtctccaagttagacaccgtctgtcgcgcgactcccagctcgtcggccagttgctgagtcgtccatccggctaccttgcgaatcggacccaggttctcctgaaacttatcaatccaccattgttcgatttcagacgccgccattacgcacctccttccacgctgtcaccagtgtacgttacctgtaccgaaatcaatccaaaaaacagtgttcatgtgaaattcactgcgtatttgcgctttcgccggcttaccgagattagccttaaacaaggaataacagagtagaagcagaaggtatgcgcgtattcgatttcgacggaaccatctatgatggcgaaagcctgttcgacttgtacctgtattccgcccggcacgacccgaaagtgttccgctacatcgcccccgtgctgcggtacgcagtcaaatacaagcttggccgggccacgcttgaacaaatggaatacggcgtgggtaagatgaccgaaggctatctcacggaactgagccgatccaaacgggtggcgagcgtcgaacagctcgtggacgacttctgggataggaactattcacgcatcaagccctggtaccagcctgagtcggacgacgtgatcctcaccgcatccttcagtctgacggtgggggaggcctgccgcagactcggcgtgaggaatctcgtggccagcgaggtggatgtggagacgatgaaggtcacgtacctcaacttcagcaccaacaaggccaaacggttccgcgaactgtacggtccggacgtcgtcatcgacgagttctacaccgactccaaattcgatcagccgatgatcgacatggcccggcacgcgttcatggtcaaggggaacaccatcacgcaagtcaagtaggaaacaacagaaaacaacacaacgtaaccaataacgaaaggggaacatatatgagcatgccgctcgatctatacgtaatccggcatggcgaatccgaagcgaacgtcatcgtccaggcgggcgagcagggcgacaattccctgtacacgcaggacaacgtcaccgtacccgaccgctcctggagactcaccgccaccggacgcaagcaggccgactgcatcggccgctggctggtcagccagcagcagctgttcgaccgctacatggtctcgccatacgtgcgcacccgcgaaaccgcagccaccatggccctgcccaaggccaaatgggaggagaaccgtgtgctgcgcgaacgttcttggggcgagatcaacaccatcaccaaggacgaattcaaaaacaactacgcgcgcaactggaacttcaagaacaccgatccgctgtactggcgtccgccggcaggcgagtcgattgccgatgtggccgaggaccgtgtgcacaacatcctgacctcgctgagccgcaaatccgattcggaatccgtggtcatggtcacccacggcgacttcatgctcgccctgatgctcaccatcgaggatttggccgacgaggaattcctgcatcgcgccgattcggacgactggaagatcaccaactgcacctgcctgcactatacacgccgcgacccggaaaccggccgcacctccaagcgtgtgcgctgggagcagaccgcccggcccgtgctcgacgagacgaccggccgctgggaggtcaaggtggagccgtggcgcgaattcaagcgcccgtatctctccaatggcgatttggtggatgtggtgcaggccgtcgacccacacctgctggagtattacggcaaatagcctttcccggaagagagacttcacaaaatcttcgtgagctagaatggtgcgtggtgcggctggttgtgaatgccgtgccccaagcgagagcgaggagagtagtaatgtccaatatcttccaatggcaattgcatggcgacggcaagacgctggcgcccggcgaggtagtcgagcccgatgaacgtctgacttgggtgcgcaccgccggtatcggcgcacagcacgtcatcgccatgttcggtgccaccttcctggtgccgattctgacgggcttcgacccgtccaccaccctgttcttcacggctatgtccaccgcactgttcctgcttatcaacaggaacgtgctgccgagctatttgggctcgtccttcggcttcattgcaccgatcaccgcggtctccaccgccaacaagggcattgcggtcgccagcttcggcatcatggtcaccggtattctgctggccctggttggcgtgctcgtgcattacgccggctccaaatggatcgacatcatcatgccgcccgtggtcaacggcgcgattgtggccatcatcggcttcaatctggcaccttccgtgtggaccaacttccaagccgcgcccgacaccgcactggttaccctgttggccgtgctgctcgtggccgtgctgttcaagggcttgctgggccgcctcaatattttggtcggcgtgatcatcggctatgtatatgcctgcatccgtggccaggtcgacttctccgccatcggcgacgccgcatggatcggcttcccgaagttccacctgccgcaggccgatttctccatccttcccatgttcatccccgttgtgctcgtgcttgtggctgagaacgtcggccatgtcaagtccgtggcccaaatgaccggccgcgactacgacaaccagatcggcaccgccctcatggccgatggcctgggcaccacgctcgccggcttcggcggcggctccggcaccaccacctacggcgagaacatcggcgtgatggccgccaccaaggtgtactccaccgccgcctactggtgcgccgccgccttcgccctgatcctgagcctgtgcccgaagttcggtgccgtgatcaacacgatccccgccggcgtgctcggtggcgtgaccacgctgctgtatggcatgatcggcatgatcggtatccgcatctgggtggagaacaaggtcaacttcgacaagccgctgaacatcatggtggcagccatcaccatgatcattgccatcggccaattcgcgttcactgttggtggcatttccttcaacggcattgccattggcacgatcgtgattcttgtggcctaccacggcctgaaggccattggcaaggcaaccggcactattgccaaagacgatccggatattttgtagtgtgttttagggctactgggctgtattttggctcagcccttttgcacaatggcccctaccttcacgggtaggggccatttgcgtgttccatggagcggtgctcgccttacgtggtggtaaaacccatggggcggcaaacatcccatggggtggtaaaaccctcatggggcggtaggtgaaaatggctttattctgcggtttcacaatttcttcaaaccgccccatgggcaagttaccgccccgtggggtcataagtaaagagtgggatgacagtgtggcgagcaccaagcaaagtagggggcttacgctaagctcggaaagcttgcgtaatttgcgtaacctttgacatgaaaggccactgtgccccgtaataatttcgatgatcgtgacgattccgctgatttccagatgaacgacagcgcggaatcccgcccccttacctttggcgaacttggcgtacccggaccgctggtgcgcgtgcttgcggcagatgacaagaagaccgcattccccattcaggccgacaccctgcccgattcactggccggccgcgacattctcggccgagggcgcaccggctccggcaaaaccctcgcattctccattccgctggtcacccgcctcggttcctacgattcgttcggcgaaatcgcgatggaggagttccgcaaggaaatcaagcgccgcaagaaggccagcctggaagagcgccgcgccgacgacttcctaccgcacccgcgcggcctggtgctggcccccacccgcgagctcgcgaaccagatcaacgacgtgctgatgccgctggcccacacgttcggcatgaacaccaccacggtgtacggcggcgtcaagtacatccaccagatccgcgatctgaaggccggcgccgatatcgtggtcgcctgcccgggccgccttgaggacctgctgcgccagcaggcgctcacgctctcgtccgtcgaagtcgtggtcatcgatgaggccgacgaaatggccgatatgggcttcctgccaccggtcaagcgactgcttgagcagatttcgcccgacgcccagcacatgctgttctccgccacgctcgatcacggcgtggatgaagtggtgaacaccttcctgcacgatcccaaggtgcacgaggtcgattcggccaccgccgaacccgacctgatgacccaccacgtgttcgaaaccacgcgcggcgacaagcacgaactcgtgcgcatgctcgcctcgggcgaaggccgccgcatcctgttcacccgcaccaagttccaggccaagaagctcgccaagaacctgacgcagaacggcattccggccgccgagctgcacggcaacctgaaccagaaccagcgcgatcgcaacctcgctgcgttcgattccggcgatgtgcgtgtcatggtggccaccgacgtggccgcccgtggcatagacgtcggcggcgtggagctcgtggtgcaggtcgagccgccggccgacccgaagtcctttgtgcaccgctccggtcgtaccgcccgcgccggcaaggcgggcgacgtggtcaccctcgtgctgcccgagcagcgccgcgagacgcgccgcttgctgaaccaggccggcatcaagaccaagatgatcgaagtgacccacgattcgcccgaagtgcttgagcttgtgggcgaccgcgccgagcgcgtggatggttggagcctcgacaagtcgcagcccgtgggcaacccgcgcaagggcaagaacaggggcgccaagaacgcggcgggcgacgagtccggccgcggcggcaagcgcaagcacaatcgcaatcgcaaccgtgacgagcagaacgttgccgagaccgagttccagcacgagaacgcaggcggcgagtttgttgccgaaggcgagccgcagcgcaagcacggcgacaaggccagcaagaaggccgtgaagaagaaccgcaaccgtgcggaacgccgcgcaggcatgagcaaccccgaggccgagcgccgcgactatctgttcgagcatggcgatgaccgccgcgaggagcgccgcaagggcgaccgtcgcgacggatacggcaagaaccggtacgacgagcgtcaggacaatggccgcgaccagcacggcaagaaccgtcgcaatgatcggtacggcaagggcgacaagttcgataagcgcgacagggccggatacggtcgcaacgatgatttcggcagccgcaggcacaatgcgggccgtgatttcgaacggtccgattcccgcgatttcgagcgtccgcgcaagcctcgccgcaatgaacgcagccacgaggattacggcttctcctatgacgagcgctcccatgacggccgcagacagtccatgcgcaacacccgtcagggcgaaggcggcaagcgcatccatcgcaagaacgagaaccgcatcgtacgcgacgagcgttcagaaggtgccaagcgtcacgaacgccgcatgatcgccaaatacggcaacacggaaggcccgaaccgccgtcattccaagaagaatcgccacaatgcgccattccgtatgaagtctggacgccgttagtccgacagcgcgtatgaatcaggcccgacgacctttgatggtcgtcgggcctgattgtgttataggccggtgtttgcgatgcggatgcctgttcgcctgcctagcggccatgacgattgcacttatcgccgcagtcgttgtgatcgtggccatgccgaaacggcggtaatggcctgtacgcaccctagaataacggatatgacgcaatcgcagccccgatccaaacgcacgcccacccttgaaatccacgggagaatccttgacgcggcaaggcggatcgtggaacgggacggtgtggatggtctgaccatccgtgcgctgtccgcacaggccgatgtgtcgcccaccagcatctaccagcacatcggcggcaagcaggcggtgtgcgatgcgctcatcgacacatacttcaccgatctgcgcgaacagctcatcgccattgacgaatccgaccccgtgctgcgcctgcgcagggcgggcataatctaccgtgaacacgcgctggacgcccccggcatttacgcgctggtctggatggggcaggcgtcggactcggcccagcactgcctggacgccatcacgcagatcattcgatacggccaggcagcatctgtattccgcggcgatgacccccatctaatcgcatcctccatctgggtgtccatacacgggttcatccaattcgaactgcgttccgcacaaccccgcacacgcggccgcgagcgggtcgaccggtcgtacggttacctgctcgacctgctgatccgaggcattcagaggtgaatgagttagctccctctgatgagggagctcagtattgatacgctgtactgccatcggcgttgcggatggtgaaagtgggggattgctcgatgttgaggtccacggtcagggaatgctgggcgtcggcgctcgtcgaacgatagacgaagtgcttgttttccagcttcacggcctcggtacgcgcatccagcagccatgggttgcgacggcgcagcgcgatcagcgcctgatgcagccggtatgtcggctctcccagcgtggacagttcggcaggggagtcggggaacttcggacgtacgtcgtcatcgccgccgaaacgctcctgcttgacgcccacatagccctgttcgtcgccgtaatagatgcttggtacgccgccgaccgtcatgagcaccgccaatgccaacgccgccttggccgggccaatctgcgatgcgatacgcgtcacgtcatggttgccgatgaacgtctgcggcacgaaggaatccaggaacgcgttgtgccgcttcaagttccaatccagctcgaagaagttctccgtctccagcgcatgctggatcgacttccatagctcgtattgcgtgatcgaatccatcgtggattcctcgatgatgcgcgggtaatcgccatggatcacctcgccgaaaatccacgaatacgggtgtgcggctttgacttgcggcaacacgcgcgcccagaacgggctcggcacggcatacgcggcgtcgaggcgccagccggcggctccgcgatccagccaatggctcatcacatgggccacatagtcaacggtctcgtcagccgaatggtccagcgccaccagatccccgtgcccctcgaacacatccaaagcgggttcgccattatcaccgacatgcgcgcggaccagaccatgccacgggttgtcggccggattcaagcgtccggcggtctcgtcaagcgccgtctgaacggccggatgattgcggctcacatgattgaacacgccatccagcatcacctgcaatcccatgtcccggcaggccgcgacaagctgatcgaacgcggcatccccgcccaatcgcacatcgatatgcatatggtcgagcgtgtcgtatccatgcgtcgccgactcgaacaccggacccagcagcaggccggacgcgcctagatcgcgcacgtactccagccagggaattatcgcgtcaaggccgcggccatggaactggcgcgggccggcgggcctgatatcggcaccgcagaagcccagcggatacacgtgccagaacaccccgtacttcacccaatcgggcattgtgcggctcgaatccatgcttacaaccactgtgcacctcctgattgacaccgtgtccattttcgcacatcgcggtgcgaatcccgggtaatcggcatgaaacgcagtccgtgaacatgtggccaagctcacatattgggacattttcctgaggcgctacatgccgtggctacgcttccaaccagtgccataagcagacgagagataccccaaaagggtcgcaatgaagagaacctttcccgcaaaggttattgaagaggaacagagggttattatgaccaccgccgcagcccaggccccggcacctggcaagttggaattcaaggacgattacacgccggacgaagccgaacgtgtgattcgcaattcgaagggactgcccgtaggcgtgcgtcccaaaatggtatggacatggaagaaggccctgctgtgggccgccatcgccatcgtatgtgcctgcggatgggcgattctggccgtctcgcgcggtgagcagatctccgccatctggttcctggtcgtggcgctgagctcctacgccatcgcctaccgcttctatgcctattacatccagatcaagatcatgcgcaccgacgacgcgaacgccaccccggccgagcgcgtgcatgacggcgcgaacttcgaacgcaccgaccgccgcgtgctcttcggccagcactttgccggcatctccggcgccggaccgctcgtcggcccgatcctggccgcgcagatgggctacctgccctccactctgtggatcatcctcggcgtgattttcgccggcgccgtgcaggacatgctggtgctgtggatctccgccaagcgccgcggtcgctctctgggccagatggccactgatgaaatgggtaagttcggcggtatgatcctatccatcttcctcgtggtgatgacggccatcgccatggcattcctggcgctcgtggccatcaaggccatggccgcctcgccgtgggccgtgttctccatcggtatgaccatcccgatcgccctgatcatgggctgctaccagcgtttcctgcgccccggccgtgtcattgagaccacgctgctcggtttcgtgctgctcgtgctcgacatcgtcgccggcggatggatcgcctctatcccggccgtggccgccgtgttcacactggacgccaagcagctcgtcatcgccctggtgatctactcgttcgccgccgccgcgctgccgcactggctgctcgtcaccccgcgcgactacctgtccacgctgatgaagatcggcacgctcgtgctgctcgtcatcggcatcatcatcgccaacccgtccgtcaaggtgccgggtctgaccgaactggcctccacctccaccggcccgaccttctccggcaacctattcccgttcctgttcatcaccatcgcctgcggcgccctctctggcttccacggcgcggtgagctccggcctgaccccgaaggccgtggagaaggagaaccagattcgcatgatcggctacggttcgatgctcgtcgaatcgttcaccgccgtcatcgcgctgatcgccgcgatcaccatctcgcagggcgtgtacttctccaccaacatgtccgccgcacagatcaccgccgcatccggcgtgagcatctccgccacctccacgccgggcgaacaggccgatgccgccgtcaaggccgtggagtcgatgaaggtctccgacatcgaaggcaaccagatgcaggtcacctgggattccgtggacgagaacggcgcggccaagacctacgaaggcgccgcggcgcttgagcaggccgccgccgacatcggcgagacctccatcgtctcccgcaccggtggcgccaccacgttcgccatgggcatggccaacttcctcaagtcctacctgggcggccacgactcgatggccttctggtaccacttcgccatcatgttcgaagccctgttcatcctgaccaccgtggacaacggcacccgcgtggcccgctaccagatcggcgaaatgctcggcaacgtgcgcaagctcaagaagttcgccgacccgacctggaagcccggcaacatcatcaccacgctgatcgccaccgcgctgtggggcggactgctgtggatgggcgtgtccgacgcgaacggcggcatcaacgcgatggtgcctatcttcggcatctccaaccagctgctcgccgccgcctgcttcgtgctgatcaccgtgtgtgtggccaagatgggctactggaagcacctgtggataccggtggtaccgctcgtgtgggacatcgccgtgaccttcaccgccgacttccagaagatcttcgggccgctgagctacttcaccaccgcctccaagtatcaggcgcagatcgactccggcgagctgaccggcgaggcgctgaccaacgccaaggccgcgctgtccaacgcgtatctggacggcgtgctctccgtgttcttcctggtcatgatgggcgtcttcgtggtagtcggcatcgtggtcgtggcgcgcacgttcgccgctggcaagtacggtgccgaaacgacgtccgaggagccgttcgtggaatcccagtggttcgcgccctccagcctggtcgccaccgcgcttgagaagaaggtgcagcgcgaatacagcgccaagctgcatgagcttgtgcggaacgggcaggttgcagcgtagtgcgtcattggctccccttttttcaaggggagccaataatcagcgaaaggagacaaaatgctcggcaaactcgttgccgtatggcacggcatcgtctggtatctgcgtgagatcagcggcgaggcccgctacgaccattatcttgagcatttcgcggccgagcatcccggcgaaacaccgatgagcgaggtcgaattcattcgcgcccgcgaggaatacgaccgtctccaccccaataccagttgttgctgctgacaggccgcaatagcataacaacaccataaaacccgcgcgccatgggaactacgtagccattcttccgttacaatcagtgtgacggcttccgccccgaagaagaaggtgttaattccccttggacgtctcactggcgcatttcctccaacaagtgctttccaacccggctctgaccgtcacaacgttgctgacgctgggagtcatcttcgtcaacggctggaccgacgcacccaacgccatcgccacctgcgtgaccacacgatgcatgcgcgtacgctccgccgtcatcatggcggccatcttcaacttcctcggcgtcttcatcatgacgcagctcaacgcctccgtggcctccaccatcagcaacatggtcgatttcggcggcgacacgaacgcggcgctcatcgccctatgcgcggcgctgttctccatcgtcgtatacagcgtgggcgcctcgctgctcggcatacccacctccgaaagccacagcctgatcgccggcctgtccggagcggccatcgccatccaaggcggcatcggcggcatcaacatgggagaatgggtcaaggtgctctacggtctggtcgcaagcctcctgttcggcttcgccgtcggctggttggtatgcaaggccgtgaccctgatttgcgctggcatggaccgccgccgcaccaacgggttcttcacctacgcgcagatcgtgggcgcggcggccatgagcttcatgcacggcgcgcaggacggccagaagttcatcggcgtgctgttcctcggcatggcgttctgcaatggccaacccagcgtgaccggtgtgatgattccgatctggctcatgattctgtgcagcaccatcatgggcgtgggcacgtccgtcggcggtgaacgcatcatcaaatccgtgggccaggacatggtgaaactcgagaaataccaaggcttctcggccgatctgtcaagcgcgctgtgcctgctcgtcatgaccgtgctcggcatccccgtctccaccacgcacaccaagaccagcgccatcatgggcgtgggcgcggtacgccgcctctccgccatcaacttcggcgtggtgcgcgacatgatgctcacctgggtgttcaccttccctggttgcggtctcatcagcttcgtaatggccaaactgttcatggtcgtgttctagaaaggaatccacccatcatggcgagacaaaaagacacgttctacttcgacggattccgccgcagcgcggactacgcatgccaggccgcgaagctgctgtccgaggtcatgcacgacttcaatccgggccagctgcgcgaacgcatggacagcatgcacgcgattgagaagtcagcggacgaggtgcgccacgacatgatggacgaactggtgaccgcgttcatcacgccgttcgaccgcgaggacatcgacgagctcggccacgtgctcgacgacgtgaccgacagcatcgaaggcgtgctcaaccgcatgtactacgacaacgtgaccgacatgcgcgacgacgcggtccagatgtcggatatggtggtgcgcgccacggaaagcatctgcgagctggtcaacgaactgccgcgattccggcattccaagacgttgcgcgaactggtgttcgccatcaacacgatcgaaacggacgccgaccacctgttcatcgagtcgatgcgcacgctgcacaccacctgcaccgatccgctgcaggtgttcgcctggcatgacgtctaccgtcacctcgaacagtgctccgacgactgcgagcgcgtggccaacaccatcgacagtatcgtcatgaaaaacagctgaggttggtttttcacaacctccctctgatgagccgagccgtgaagaaaacgccggaggcgtttttaggcgagggtgagtgacaacgagcgaataagaggtcagctgcaagctgtcctgaatcgcgttcgaggtggcatcgcgaagcgatgtcggagggagaggcctacttgaccaaaagccccctcacctatgggcgttgagccagaggatggcgagttgggtgcgattggtcaggccgagcttgtccagtatcgcgctgatgcgattgcggaccgtgccttcgctcaggaacagtctggcggcgatgtcgcggttatcgaggccctcggcgaccagcgcggtgatctcacgttcgcgctcgccaagcaggccctcgatggaatcggcggtatctctggaatcgtcggaatcggcaggatccggagttcgttcggtgagcttgccgagcacttccgcgccgagcaccacctgaccggccatcaccgcctgcagcgcgggcccgaccgccgccacatcctgtttgatgagatagcccttggcgccaagtcccatcgcctgcgcgatatacgactggtccgcaaacgtggtcaggaacagtatgcgcgcggccgggtccgtggccagaatctcgcgcgcggcatccaaaccgctggtgccgggcatctgaatatcgatcagcagcacgtccggtcggctcgccggtgtctcgaaataacggcgcacggcggcgtctccgtcatttgccatccatagcacctcggccgtgccggtggccgtcagaatcgtctccaacgactggcagacgatcggatcatcatccacgattgcgattctcatcaatccctcgattccatggtccaacgcttcttcggcacggatacgaacacacgccagccgtcctcatacggcccgcagaccgcggtgccgccaagggcgcgcacgcgcgattcgatatccgccaaacccatgccgcgcatcagctcatcggccgaaccacgcatatcggcaacgccgtcggcggcgagtcgcgagccgacgtgcgtggcgcgcatcgcacgcgggcgggcagcggccgtccgggacccatcggactcggacacggccggccccggatcctgaatgaccaactgccagaacgcggggaagtcacgcaacgtcacgctcgcctcgcgcgccgcgctgtgatgcaccacgttcgacaatgcctcgcgaatcacggtcgcgaaacagcgcgagaccggcgcaggcgccttggcgatatcgttggccagcgtcacggcgaaaccgggggagatgccgtcgaacgacgtgacggcatcatcgatctgcgcggcgaaatcagtgccatcatcctcaagatcatgcaccgaacggcgcactatcgtcatcgcatcatccaacgtcgcacccaacgtggcgaacccttgcgcagcgaccgtatcgttcgtcgccttggccaccgttttgccggcctgcgcctgcatgatcgcgcgggtcagcagatggcccacattgtcgtggatctcccgggcgatacgcgtgcgctcgccgagggtcgccatgcgaatcgactgggcgcgttcctcatcgatgtcggcgatgcgcgaacgagtggcccgcgaggattcgcgcgccctgtcctgcgcgtgcagcaacgcgcgccgcgcctcgtccgaggaggcgcgggcccggcccagaacgaatccaagcagggcgaccagcgtcatcaccagcgtctggagacggtcggtgccacgggcgaaccagagcgcgatcagcggcaacacccatatccagcgcgcggcggccgaaagccacggggccgaacgcattgcatcggcaagggaacggcgagaggccgcggtccgcgagacactgggggagcggccacttgccgcagtccgtgccccagcccgggctccggtcgaggcgagggccggcagccgtgcagtatcgtaggcgatgagcggcatgaacgcgcaccatgaaggcaccgccacggcgatgacgagatacgccgtacacaagacccaagaccattgcgcgggacgcagccattccaccaatccggcgacggaaacggccaacagcaggccggcgatgaacacgccatcggaccgtagcctgacaagccaggccaaagccaggcccaacacgagtagcaagcccatctcggccaacacgcgcatggcacctccccggctcgacgctcttccaccaccagtctagcggtgtgcggaacacgacgaacttgacgggcgtgcggaattacccgcatgacggtccaagacaacgggcctacacttcccgaatagatgaggcacaagcgtcggatgtcgtcgacacaaccgtaaagggatgataccgatgattacgcaaagccacagggcgtccaactattcgatggacgagatcagcctgatgccggtcgataaggtgtacaaggccatgcagaccgacgccgaaggactgtaatgacaaatgtcacgcctgtacggccaagtcgtgacgtttgcctgtggcggcgtccggccccttcttgggatgatggaatcgccaaggaagggagtgactatgacaaccgacaacagagcttccgaacacgactcgacaaccaacccggctctggccgtgcacgtcagccaactggtcaaacgctacggcgacatggtggcgctcgactattttgaccttgacgtgaaccagggcgagattttcgggctgcttggaccgaacgggtccggcaaaaccaccgcgatcaactgcatcctcgcgctgctcacctacgattcgggcacgattcgcgtgttcggccagccgatgacgccgacctcctacgcgctgaaacgtcgtatcggcatcgtgccgcagaacgtggccgtgttcaacgaactgaccgtcaccgaaaacatcgactacttctgctcgctgtacgtgccgaagaaaaccgaccgcgcgccgctggtcgaggagtccatcgaattcgtcggactccaggacttccgcaagttccggcccggcaaactgtccggcggtctgctgcgacgcctgaacatcgcctgcggcatcgcgcacaagcctaacctgatcttcttcgacgaacccacggtcgccgtcgacccgcaaagccgcaattcgattctggaaggcatccagcggctcaaccaggccggcgccacggtgatctacaccagccactacatggaggaggtcgaacagatctgcgaccgcatcctcatcatggaccacggccggcacctggcgctcggaaccgccgacgagctcaagaacatgatcgacacgggcgagcgcatcaccatcgaaacgctcgatctggcggattcggcgatggccgaggtccgtgcgctgccgtgcgtgatcgaagccacctacgacggcaaggaactcgacgtgcgatgccgtcgcggcgaacacaacctgaccgacgtgctcgacgcggtgaaacgctccggcgccaacatcggccacctgaccagtcgcccgcccaccctcaacgacgtgttcctcgaactcaccggcaaagcactgagggactgaccatgctcccctcagtcggcaagcaaataacttggctcccctctccgaggggagctgtcaccaaaggtgactgaggggagttcctgagtaaggagacatcatgtggaccacatttctggtcgcattgaaagcgaacttgcgtaaccggtcggcgttgttctggatgaccgtgttcccgattgtgctggcgaccatgttcaacggactgttcggcgggctggccgaagcatacgaactcaagccggtgccgatggccgtcatcgaagacacccgttggcagcaggcggacggtgcccgcaccttcgtagacgcgctggccggggaaacggaatcggcctcagacgacacgacctacgccgaaatcgaccaaaagctgctgaccatcaccacagtcgacaccgtgaaggaggccgaacaacggctcgccgacggcactgccaacggctatctgaccgccgacaataacggccgattggcgatgaccgtgagccgggaaaccgccgtcacagccaaggactccacgcaaaacagcggactggacattagcctcgcggccctgcgcagcgtcatcgacctgtacaaccgcaccgacgccgttacccggcagaccatcgccgacaatccacaggccgcgctcagccggaacttctggaacagcgtcgggcagaacgtcgacatgacccatgagacgacgctcacgcatttccagcctgacgagatcgcccgatactattacgcgctgctggccatgtcctgcatgatggccatgggatactccatcagcacagtcgccgccgcacaggcgaacctgtccgcgctgggcatacggcggaccgtagcgccgctgagccgggccaaacagctcgtcgcgggcttcctctcctgctggctgtgctcgtcggtcgccctgtccatcgcattggcctatatccggctcgcctgcaacgtctcgctcggcggacgcgaaccggcggcgatcctcgcggtcatcatcgcctcgttcatgaccagctcagcaggcaccctgctcggtgcggtgccgaagctctcgtacaacacgaaatacgggctgtcgaccggcatctcctgcacgctgtcgctgttcaccggactgtacggcgggtttgccatgcagatcagcgactggatagcccgcaacgcgcccatactcggcaccatcaaccccgcacagcaggtgacgaacctgttctacgacatcctgtactacgacagctaccggccgttcatcaccacctgcatcattctgctggcgatgagcgcggtattcctcttggccggcatcgcaatgctgaggaggcaacgttatgaacacctgtaaagccacgctgcgcgtgctgttcgcgcaccgggtctacctgatgatctacctcgtattcataggcatcctgatgatgtccatcagctgggcgatgctgacctccgcatccggctccatgtccgcggtgttcgaatcgaccaagacgcgcgtcgccatcatcgaccgcgactccgaccggggtgatatcgccacgtcgatgcgcgcctacctgcgcgattccagcgaactggtggacctcgacgacaccagcgaaacgctgcaacaggccgtcgcctcgaactgggtggacctgatcgtcatcattcccgacggattcgctgacgattatgtcgccgcggcggcggacggcgacaatccgccgaacgtggacacggttaccagctacgcatccggctccgggtcgatggcgcggatgaacgtcggcgggttcctctcgctcacccgcaccgcactgatcggcgcgcagacgagggtcgaccaggcggcgctcgccggcatgatgaacgctacaggaggggccgccggttttgatggcgcgagtctggaccaagacatgctggactcgctgccggaagggcaagtcgacaagccggatatcaaggatctgtcccaggccgccaaaatggccgccgaatcggccagcgatacagacgtgaaccatcagatcgccgtggtcgatacgccgaccgaggagtcggcaagcgctgcggatacggcggtcagcggattcggcggcaccatgaaaaccgcgctgtacccgctgtccctggcgatgaccatctgcggatcgatgatcctgggcgcgttcaccaccggcgaggtgcggcggcgtctcaccgcctcgccccgacgcatggtcctgatgggactccagcggttgctgacgttgggcggattcgcgctcgtcgtatgcgtcggctatttggtgctgtcaatcggtctgatgatggcggcggggctcgatccgttgcacctgagcgtcgggggagtgctgatgacgttcggcgcgacctgcgtgtacgcgctgatgaccgtcgcctgcggattcatgctcagcgagttcgggctctcggaagaggcggccaacgggttcgccaacatcttcggcctgctcatcatgttcacgtcgggtgtcgcattgccgattgacatgatgcccggcgtgatggtgaccatagccaagttcctgcccggctggtggtattgcaccgcgatcgacaacgcgctcggcttcggcacggcggcggaaaccggcataagcgtcgccggctggtccggctcgctgggattggtcgcactgttcggtgtgatgttcatctgcatcggcctggccgccggccgcttccgccgatcccgccccgccctggccgcgcctgccaccacgcagctggccgagtgagaaatcagcctttcaaccgataccgctgtgccgggtcgtcggcgaacttgacttgggcgacccgcccttccttcatcagctcgcgcataccggatgtggcggccagcggcgtcaactgtagttcgcgcatgatctccttgacgctcatggccgaatgccgctccagtacggtcataatcgccttgaccacgtcgcccggtgaactgttcgccatcgtgcgctgcttggtgatggtcatcgtgaacgtgttgatgtcgttgcgcgtggtcgccggctcgatgccggcctcgcgcaacgcggcggcgatgcgctggtagccgtcgccgccttccgggttcacaaacccgccgcccggatacggcgtggactccagcagcgtgaacaggaactggtttcgggtggagacgaacggcgcgcccgtcaccggatgagggctcgccagcacatcatgtgtcaccatgccgtacaggccacccggattggtgatctcgatgcgatcggtgaacacgctgatatgcacctgcgtgccgcgcgcatcgggcgaataatcacggtgggtgagcgcgttcgcaatcgcctcgcgcaacacgagcggcggatagtcgggcttcttcgcgccaatccaacgcatcaacgagtcgaccgcatcgtcgatcatcaccggaatcgaaccgaccaccgacttcgaggcgaccaatcgttcgtcgccccggaacacatcgtcccggctcgtccccggaaacacggctatcgaaatgccgagccgcggatagaacttctgcggatagcggcccaacgccagcagtccggccaaggtggggcgcaggattccgccgacctccgactcgtcggaatcatcatggcgcaacacctgcagatccagcagcacatcgatgccgtctcggtcggcgaacacgcgcggatgctgttcgcgcacgcgtgccaacagtccggcaacaagctgcgggtcgaggtcatcggtcgtggcgtcgggcacgatatccagatcgtatgtgggctgcagatgctcctcgatgagccggtcgacctcataggaggtcatgcgccggtcgccgtcgccggtacggatgaacgagccgccgtgcggtccgagcgcggtggtgaagcagggcttgtcgcgcggcagcatctcgtcgatgcgcgcgaacaccagattcgcgccttcgaacgggcaggtgacgattacgggccgcaccaccggcgtcatcttctcgcacgcctggctcagcgcctcctgcatggcgcgcgcgtcgaatccctcgaccggcgtgaacccgttcttttcggacaggcccaggataatccagccgccggagccattggagaacgcggacagcgtatcggtgatggtcgaggagatcttgcgcttgcattccttgacctcgcactgttgcgtatcgttgccgatcagacgcatgagttcgatcagctcagtcattttggcagtatagtcatcgaccatggcggcctccttgaaaccattgtgccccataatccgccgcccgctcgcctccagccccgccagttcaccccaattcatgcagaattcatgggccaaaccagacgaaacgaacgtcgatgtagggttcggttccgcgtgttcgccgatgatatcggccggtcgaggcgggcgggctatgttgggtggcgtgggaatcttgcgcgtgattgatgctacggctgtgtgcttcgctctgggtatatccggcccgatcagcgggactcagccaatgtgatgccgcccgcagccatctgcttgcgggccgcaacaccaagttcctcgctgaccggcacggtcagatcctcgaacacggtgacctcgaagccgagcttcttggcatcgagcgcggtgtccttgacacaatgcgattcggcgatgcccaccacatccacgcgactcacgccggcggccttcagcgcgttggccagcgtcttgccggcggattgctcggcctcgacctcctcgcgggtctggatacggtcggtattgtcctcgataccctcaaaaccggaatatgccgccgaatactggcccttcttgaaatgatgctcgatattcagcgccttgatcgccggatgcaattcggcgttcagcgtgccggccgcaccatgcttcggccacgtgtccacgaaatccggctccgccgaccagtgcgcgcccggctcgatatgccagtcctgcgtggttgcgatatacgcgtactcgctgcgatgcgcgttcacataatcggcaatccgctcggcgaccgcgttgccgcctgcgacacccagttcgccgctttcacagaacgtcggctgcacatccaccacaatcagtgccttggtcatcgtcattccccttattgccttggattcgttttgaatattgtctcgaactcgacgtgcgattgctctcatcatagccatgcgcggccctgtgggaaacgttcgggcttacactgcaagcagcaatcgaatacaagaaccaggggagggcgaccaagaccatgctggaccatctgacgttgcacgtgaaagacatcgaccgtagcatcacattctacaaacaggcgctcgcaccgctcggctatatcgtcaaggcgcatcatgagcctacgctcggattcggcgtggatgacggaaccctgcactccgatttctacgtgtcaccgattgaagggctggaggcggaggcttcgccggtcacgccggtcacacacatcgcgttcttggctgacagtcagcaagccgtgcaggcgttccatgcagccgcgctcgccgccggcggccgagacaacggcgctcccggtccgcgcccgtaccatcccggctattactccgcattcgtgctggacccggatggcaataacatcgaagccgtcgtggattgggctcattcgaacgagtaaaaacatatccgtatcgtgcctcaggcggcatcgacggcgtaggctccaaccagtcggatttgtggtcgcaacggcggtataggtcacatcacgcaagcgtgaaggtgatggtctgctcggcggtttcggtgccgatccatgtgccggctttgcggttccaatccatgccgtccgcgtgcagtgcgtcaatgccgtattgacgtgcatgcgtgaccagccagcctgccgtctgccagcaaagtcgagtgcggttgtcggcggacaggccgtccggcagcgtgatcgtcaacgttgtgctggccgtattggtcgcagcgccgttgttcgtgccggttttgccatttgggggcacaaccgagacattgacattcggcagtgtacctcctatggcgacaaccaacccgtccgcgtccgaggaggttgctggctccaacgcgcacgtgacgcccgccgaccgttcaccggtcagccccgaggcccaagcgcgtgccatcgcatcccatgcggcatatagttccgggtagcctgagcgctgcacctcctgcgcggcgtcctccaccggaatcgtctcccaatccggcacctgcagcagatgatcgtagaagatgtttgtcgcataggtcatgtcggacacctgctccgccgtgccccagccttggctgggccgctgttggaacaggccgagcgaatccaagtcgccgtagtccagattcgtcagcctcgactcctgcatggccgtggcgatggccaccgtcgccgcgtgatccggcagtccgcgcgtgacggcgatgttcgcaatcagcgccgcgttctgcgcctgatcaggcgtcaaggtgcggcgggctccgtcggacgacaccgccgcgcaatatgcttcctcggccgtgcgcgcggtctcgcgaggcgtgaatagccgtggcagcagcgtccatgccgcgatcagcgccgcaacaacaagtatgacggctgcaatcagcgcgcccgcgccatgggagcggcgtctgccgtaccgcacctgttgtcccattgcgcctccaatatttcggtgtcatggctgaccgtgaccggctggcctatgcagcatgcgggatttgccgtgttccggctcggccgtcatcatgacagcgtggcatatccacctgaacggcggctgcgtcatcacgcgactttgtgacaagtcttcacgcttcatgacatccgcgcaaatcagcccctcgaaaccgagaatggcggtcgggattgctccgacaccaagggagctgctgccgctattgtgtgaaaggcgatttgtaccgggttgaaggagaggaacacatggcgcaattgcagccgtactgcgcgattgagggcaatgatgatggattgcccgtcgtgttcgtgcatggcatgggtgtggaccatcgttcgctgatgatgctcgacaaggcgtttgacggcaatgattcaattcgccgtatatatctggatctgcccggtttcggccgtacgccggcattgcccgagcatgcctgcgggctgccggaaatggcggattggctgcaaacggccattgacggtcttgtcggtaaagcggctccattcgccatggtcggcaactcgatgggcggtgcgcttgtccgcgaagtattggcgcgcgaacctcgccgagtggccggtatggtattgatcgcgccggtcgtggacccgcagcatgccggccggcatgtggccgaacatgtggttgcacagcccaatcccaagctgacgcactccttgccgcaggaacaggtgttcgatttcattaccatgggcgtcaaccagtcattcgacgcgtggcgacgctaccaacggttcatcctgcccggcgtggcgttgtgcgaccgtgcggcatgcgaacgactggatcagcgctattggctggccgataatcccgaggaaatgctcggcacatatgcgggtccggtgctcatcgtcaccggcaagcaagaccagatcgtcggatacgaagatcagcaagccctgttgccgcactatcccaacgccaccttcgtgacgctggacaatgccggtcacaacgcgcacatcgaccaacccgaagccgtcatcacgctcgtgcgcgaatgggtggctcatatggcgttcgctccgttgagctgacggtctgctgacagtctgccgaagcctatatgtatacgagcgaccaatgccggttgacgcaatacgccttgcaaggtatatcgtttttcgatatagtcatatcgatgttcgcggtgtcgccaaaaaaacgtcggcacctgaaaggaccgggctatgaaaaactacatgaaccgatgggtgttgctcgcgttgaaagccatcgtgattctggtctggctggcctgcctatggggccaactattcgccgtaccgggattgagcggcgcgctggccggcctctacccgagccagacgtcgatgcactggccatatctcattatgggcgtgctgttcctgttctgcatcgaagcggcgttcgtggccgtatggaaactgttctccttgtccggctcgggcgcgaactcgagcaggtgatttgagatgacgattcgcatcaatctcgacgtcatgatggccaaacgcaagattggcgtcggcgagctcgccgaacaaattggcatcactcccgccaacgtgtccattctgaagaacggacgtgccaaagccgtccgcttcaccacgttggacgccatctgcaaggcactcgactgccaacccggagacatcctcgaatgggaagatgacgattgatcgacacgccaccggctcgaactcatggttcaacttgtagtctctcccaaaatcaatgatgccctatcatcctgcaagacgatagggcatcatcatgtgattatgcgcagctgatatgttgcgttgttatcactcggcgtccgcggccggtgcctccttgggcgcagagaggaagtgctcctcgctgggcagcacggtgttcaggatcacggccaccacgaacgccacggcgatgcagttcgaggcgaagatttgttggaacagtgccgggaactgcgtgaagatgtcgctcacctgggtgaagccgatgccgatggtcagcgaaagcgccgcaatcgtgatgttgcgctgcgtgaagcccgcctcggcaatcatctggaagcccgaaagaatgatgttgccgaacatcatgatcgtgcagccgccgagcaccgcctgcggcagcgagttgaacacctcggcgatggccggcacgaagctcgccagcaccagaatcagtccgccggagagaatcaccttgcggttgacgaccttggtcatggccaccaatccgatgttctgtgcgaacgaggtcagcggcagacagccgaacaggccggatacggtggagatcaggccgtcgccggcgatggcgcccgcggtctcgcgttcggtgggcgtacggttcaggcccaccttggtcagcgcggcggtgtcacccagcacctcgaccgaggagacgacgtagagcaggccgatggagatgatcgagccccagtcgaactcaggcttgaacggcatgaactgcggcacggacacgatggcgaggttctggaaaccggagaaatcgaccttgcccatgcagatagccgccacatagccgaccaccagaccgaacagcacggacagctgcttggccgtgcccttcatcaacagctggaacgccaggcaggcaaccaaagatataagcccgagcgtcaggttctgccaggaaccgaagtccttggctccgctgccgccgccgaagctcgtggcacccacgttgagcagcgagaagccgatcgacgtgaccacgatggcggagacgatgggcggcacgaaccgacgccaatacttggccgtcaaacccagcacaagttccagcagaccgccgaccattaccgcgccgaccaccgcgccatagcccttgtccgcgcagatcgccacggcggccgccacgtaggtgaaggagatgccggtgaccatcggaagtcgcgagccgatgagccacgcgccgtacagttgcaggcaagtgcccaggcccgcaaccagcaggccggactggatgatggtggccgattgggccggggtcatcttcgcggccgaggcgacgatgaagatcggggcgaggttcgccacgaacatggccatcacatgctgcaggccgaacggaatgcccttccagaaggatactggcgcgtccagcgaagacaacgcctcaaaggatacggaatgattggttttcttctctgacatgattctcttcttctctctgttgctcccgccggcgggagcagccaatgtgctcagtgcctaaatgtgatttcgccggtctcgggattcatggactcgacgatggccagcgaatccacatcgtagccttcagcgcgcagcgcgtcaccgccgccctggaagcccttctccacggcgatgccaatgccctcgaccgtggcaccggctgcttcgcacagatcgatcagaccgcgcaacgccttgccgttggccagaaaatcgtcaataagcagcacatggtcgccggcgttcagatacttcttggccacgatcaccgggaactccttctgcttggtgaaggaatagaccgtggtggtgtactggtcgccgtcaaggttgatggactgcgccttcttggcgaacaccaccggcacattgccgaaatgctgggccgccacacacgcaatgccgatgccggacgcctcgatggtcagaatcttggtgatgtgcttgccggcgaaatgagcggcccatgccgaacccatgcggtcgaacaggcgtacgtcgcactggtggttcagaaacgcgtccaccttgagcacattacccgccttcaccgttccctcgctttggattcgctcctcaagttcctgcattgaacctcccattgttgtatgtcagtgaatgatatggatactcgtaagtgtacgttgtcctgcgctgacccgtgcatgtggtaaacatgaatgtcgcgattcaaagggaggcaacagtgtacgacgagccggaagtcatcgcacgcagcgcacaggaactcgtgggcgacctgaacccgcagcaggcggaagccgtgcaataccgcggtcaggcgctgctgatcggagccggtgcaggctccggcaaaacccgcgtgctgacccgccgcatcgcctggatcttgagccagttcggcgcatggccgagccagattctagccatcaccttcaccaacaaggccgccgccgaaatgcgcgaaagactcggctcgctgatcggcccggtggcccagcgcatgtgggtctccaccttccactccgcctgcgtgcgcattctgaggcgcgacggcaagtccatcggactcaagtccggcttctccatctacgattccgccgactccgagcgactcgtcaaaatcatcgccaccgaattcaacctcgacatcaagcgctacactccacgctcgattctcggccatatctccgacctcaagaacaatctgaccggttggaaggaaaacctcgccgttcacgcgcccgacttcacgcccggccagcgcggctaccagttcggcacggtgggcgaccttgaagccatctacgcggtgatctacgccgaatacgagcatcgcttggccctggccaacgccgtcgacttcgacgatctgatcggccgcacggtcgagttgctgcgcactgacccggccgtcgccgagtactaccatcaccgcttccgttacattctggtcgacgagtatcaggacaccaaccacgcccagtacgtgctcgtgcgcgagctggccggcgtggacacgggggagaaggccatcccgggcgcgcctaacgccggcaagtccggccccgcctggatcaccgtggtgggcgattccgaccagtccatctacgcgttccgtggtgccgacatccgcaacattcaggacttcgagcaggacttcccgaacgccaagaccaccatgctcgaacagaactatcgttcgacgcagaccattctggatgcggccaacgcggtgatcagcaacaacgagggccgcaagcccaagaaactgtggaccgcgctcggcaagggcgagccgatcgtcggctacgcggcggacaacgcccagcaggaggcccagtgggtggccaccgaaatcgcgcgcctgcacgccgaagcgggcatcgcctactccgacatggcgatcatgtaccgcgccaacgcccaatcccgctcgctcgaagaggcgctgatcaacacgaatcagccgtatcagctcgtcggcggcaccaagttctacgaacgtcgcgaaatcaaggatgcgctggcctatttgcaggcgctcgtcaatccggacgacgatgtgaatctacgccgtattctcaacgtgcccaagcgtgggcttggcgaccgcgccgaaggcgtgctgctcgcctacgcgcgcgagcatggcaccagcttcttctacgcactcatgcacttggatgagatcgaggtgccgacacgcaccgccacctcgctacgagcattccgcgatctgatgggcgcgctctcgcagttcacgcgcgcgcacgactccaagcccagcgagatcgtggccgaagtattggagaagtcgggcttaagggccgaactcgagaaatccgtggacccgcaggacgcctcccgtctggagaacctctcccagctgcagtccactgccgccgaattcgaacagaacacgcctgacgccacgttgtccgcattcctggagaccaccgcgcttgtggccgactccgaccaactacccggcgaggcggaggactccggcaaggtgacgcttatgaccttgcacaccgccaagggcctcgaatacccggtggtgttcctgaccggcatggaacagggcaccttcccgcattcgcgttcgatggaagacaccactgaactgcaggaggaacgccgactcgcctatgtgggcatcacgcgcgccaagcagcgactgtatgtcacgcgcgccgccgtccgctcccagtggggccaggccgccgatatgatgcccagccagttcctcgacgagattccggattcgctgattgattggaaacgccgtgaagccggcgtggagcgtatgcgcgccagctgggagaccgatggattcgccgacgatttgggcggctgggatgatgacgatttcggcggcgccgcgtttggcgggtcgtcgacgttcggctcgcgtggttcgtccggttcgggttcgtcctatgggtcgcggtcgcggtatgggtcgtcgtatggctcgggttccggctcttcgtcgtatggttcccgttcatcgtcgtatggttcccgctccggctcgtcctcctatggttcccgctcccgttcgggttcgtcctatggttcttcaggctccggttcgaggtcgtcctacgggtcgcgttcccgttccggttcttcgtccggttcatatggtggcacccgtggcggcaaggtcaccacgcgccgtaccgcaccgaaatccgattcgaccggctctgccgtgcctagctcgaagctcaccaaggacaatggcctgaatatcgccgacttcgccgtgggcgacatgatcagccacgaccagtacggtctcggcaaggtcaccgacgcacaagacaagggccgcaattcggtaatcaccgtggacttcggctccgccggcgtcaaacgcctcatgctccgcgtagcgccgattgagaagttgtagataaattggcccctctgacgaggggctgagttatataccaaataaattcgcaaaaaacaagacttgtgttcttcatcacagtgtgggcataatgcggaggttgtgcctacgagccctgggaacaggggagaggaaaaagtagttatgaagaacaagctgtttgcatccgtgcccaatattctgttcggcgcgctgatcaccatcgcgccccagacctttgcgcacgcctgcaccggccatgacatgccgggtgcctgccactactcgcagcaggcggccaccggcatcggcgtcgtcatcctcgtgttcggcgtcgtggctttgttcgtcgccccgcagattcgcatcggcctcaatatcgccgccgcagccgacgccctgctactactcgccgtacccacctttctgatcggcatctgcaagggcgcgatgatgcactgtcgcatggttatgctgcccacgctcatcgtgctcggcgtgctcaccatcgtgttcgcggccatcgccatctggctcgactctcgcgccgccaagcgcaactgatcgagcagacggccggagcccagccattccgaacgctggactccggcctcgcttattgcaaccgcactataagcaacataaggattcatcgtgccatcccatatcgcattgcgcggccttccgattgaaaacctcaaacgcaagccgttccgcaccggcgcactgctcgccgtcgtcaccatcctcgcgctgacattcttcggcggcaccatgctgaccatgaacctcaacactggcatgaccagtatggaaaagcgcctgggcgccgacctcatggtcgtgccgcaaaacaccgtgcagaaggccgaagcgctgctcaccaacggcaatcccagcactttctatttcaccaaagacatcgccgacgaggtcatgcaggccgacggcatcgcacaggccaccgaacagacctatatatcatcgctggccgccgcctgctgtgccgaaaagctgcagatcatcggttacgacccggacactgacttcgtcatcgaaccatgggtcgcctcccagttcgaaggcccccttgaagacggtcagatgattgcaggcgcaaacgtcaacgtgtccaccgacggcaccatcgaactctacggccgttcatggccggtcgtcgcccagctcgccaacaccggcaccagcctcgacaactcggtgttcatcaaccaaaacaccgtgcccgacatggtcgccgcctcggccaaggtctccaagcaggtcatgtccgccgaatatgccggcaaagccgtctccaccgtgatgattaagacgcagcaggggtacgaagcgcagaccgtagctgagaacatcaagcgtcttgattcccgattcgccgatttggggtacgtataccccggcggcatcaccgccaacaccagaacttcgctgaccgcgcttgtcacctacctcaagattttcgtggcggtgatctgggtaatgggcgtgattgtgctgctcgccgtattcgcctcgtcggtgaacgaacgcaaacgcgaattcgcgtccctgcgcatcatgggcgccacgcgcggcatgttgaatgccatcattctgaaggaatccgccatcatcggtctgatcggtggcgtaatcggcgtcggcgcggccagcctggtgattttcccattcagttcgctgatcggcaaacagcttcaattgccgtatctgcaagccagcccggttgcggtgatcggattcattgccgtgaccattgtgtgctctacggtcatcggcatcatcggttcgctggccaccatgtggcgtctcggccggcccgaagcctacctgaccctgcgagaggggagtgatatgactgagacaactacgccgcttcagccgaccacggttgagccgaccaagctccagccgaccacgccagctcagccgaacgcgccgactgcgccggattcgccgcacgtaaccgagacgccctccccggaccatctgctgaccttgacggacctgacccgccagttcgtccgccgcggcacgccgttcgacgccgtcagccacgtgaacctcaccgtcgatgccggcgaattcatcgccatcgtcggccggtcgggcaacggtaaaagtacgttgatcaacatggtcgctgggctgattcgcccgacctcgggaaccgtgagcgtggctggacgcaatgtggccgacttgggcgataaagcactgtccgtgctgaggaatcgcaccatcggattcgtgactcaaagccagaccctgctcggcaacctgaccgtgctcgacaacgtgattctgcccgcaacgatgtttccggagccgctgccgttcgcccaaaacgcagaagcaacggatgccgtggcgcaagccgctgccaccaatgatgaagcggccgccgattcagccgccgacccgttcatgccggatgtcattgcgccaatcacagaccgggaaaacacgccgtcaaacacggctgcgagccgttcggacctgttcgccacccgagctcgcacgctgttcacccagcttggtgttgccgatctggcagacagctacccgcgcgagctgtccggcggtgaaatgcggcgcgtctccatcgcccgcgcgctgatgaaccagccgagcttgctcatcgccgacgagccgaccggcgacctcgaccaagagagcaccgacatcgtaatgcgtctgctcagagaccaagccaacaacggcacggcgattctcatggtcacccatgatcccgatgcactcgaatacgcagatcgggtgtatcgcatggacgccggagtgctgtccatagcctcggtgtaatatggtctgctggtgtctgccaacaggtagataccgtctggagtcatagcccatcagcgggtcggcggtaggtaatcgcaagaaaaccaacccgttcgtgtttattcacgacgaagcgctggggaggcccgactcagcgcttgttaggcatatgcaaggcaagcgttccgttcagataacgacagaaggattaatccaatgacgaacgttcagcgttctcgccgtcaggtgcgtctgtctcgcgccctcggcatcgcactgacccccaaggctcagcgcatcttcgaaaagcgtccgtacgctcctggcgagcacggccgtgaccgccgccgcaccgagtccgattacgcggtgcgtatgcgcgaaaagcagcgtctgcgcgctcagtacggcatctccgagaagcagcttcgcgccgcttacgagaaggccacccgtactgccggccagaccggtaacgccatgctgaccgacctcgagacccgtctcgacaacctggtgctgcgtgccggcttcgcccgcaccaccgcccaggcccgtcagttcgtggtgcaccgtcacatcctcgttgacggcaacatcgtggaccgcccgtcctaccgcgtcaagcccggccagaccattcaggtgaaggccaagagccagaccatggttccgttccagatcgccgccgaaggcgtgcaccgtgacgtgctgcctgcggtccccggctacctcgacgtgaacctgccgtccctgaaggccactgtgacccgtaagccggaggtcgaagagatcccggtgcaggtcaacatccagtacgtggtcgaattctacgcccgctgattcgggccctctggtcaacaaatccaggacataccgctcgaaccccgcgcttctttcgagaagccgcggggttcctgcgttgtagggcgattactggccgcacaccgcctggcgaatcatcgtcgcgtacgcataggcaccggtcatattcggatgaatgccgtcatcgttgaggtattcgctatgaccttcgctatacccatgccaatcgatgatgcccacgttcttgttcttcttggcggcctcacgcagcatcgtattgttgttgttctcctgccacgggtatggcatacggatggtgatgaagtatgtcggcttgccgccggtcaggtcaatgagctgttgcacttcctgctcattcgaaatcacgccgttcgtgccgaggccaaacaccaccacactgccactgtggccggcagcggtgtcctgctgatacacatccaccgcctgcggcagctgacggttcggcaggccatcgataaaagcgttcgggaatgcggcctggatggcgtccgaagtacccgacgtcactgaatcgccgaccatcatcatatccgcgttgcagctttccgttgccggatcataggcgtacttcgaaatgtcaagattgtttggcaccttttccgcaatcggtttgatgatgggcggctgagaatccgaaccgttcttattcgcgtcagcggtattggtttcgccgttcgcggcatttatggcagaagactcgggctcgggcttcgccggtttcttgaccggcttggcgggtgccgcgagttcggggcgcagctgaatggctcgcgcttgagcgatgccattccagtccaccggtgcccacgtcagcgccacaacggtcaccaatccgataaccgacatgacccacgcgcccgggcgcagccggtagccggctttcggcagcggcttggcgtgttggctacgaggcatctgcaccgatttacgggccgcctcgaccagctggtagaaggcttccgacgccgccaacaccacgacggcctcaagaacccaaccccaccacggcaacgcctgcgttcgtgtcgccgggttcatgaactgcagcagcggataatgcatgacgtacagcgagaacgatcgcgacccgatatagcgtaggggagcacaacccagcacgtgcgaccagattgagtcattgttcacggcacaggccaaggcgcacaacgatatgaacgcggtaatcaggtacccgccttggtacatgtacgacagatacccgttggcgaaccagaatccggtcagcagtgccgccaaagccgcggtgccaagaacattgcagacgatagtgagacgggcgcccgtcttgtcgccggcctgacgttcgatctgcactgtttgcgaagccgctccagcttccgcagcttccgtacctcgcgaggaaggcgcaatccagatagccaacagtgcgccggcggccagctcggcgaggcgagtatcggtaccgtaatacacgcgggaggtattggccgggtcaaacagcagcaccatgtcggcggtggaagcagccatgatgacaagaatcgccatggagcgcacccatttggacttggtgattttgccgagcaccaccatcagcaacggccaaaccagatagaactgcatcgtcacgcccaagaaccacagatgggtcagaggagaaggcaatccggccgcctcgaaatacggcaccttgcggaagatgtacacccaattgctggcgaacaaggcgctcggcagcgaatcggaaaccactttctgcaacaggctgggagcgaacatccaagtgagccaaggcaccacggcaatggtcgccagcatcaccggccataaacgagtaatgcggcggatcagatatcggccatatccaaaggacccggtgcggtccaccatgttcagtaccgaacgtgtggcaagaaaaccggtgataacgaaaaacatcgtcacgccaatgaatccgccctgcaatagcgacgggcgggtgtggaatgctatgactccaagaatcgccagagcgcgcagtccatcgatacccctgaaatgggcaggcacagacgatcgagatggtgcaggtttcaaggttatgctcacagtattctaagtgtactctcaggaatcgttaggtatactgcccggattacgcatatctcaggtagtgacctatgccgttatgacttatgacttccggcaacccgcaccgaaaccgccggaatggtgacataatcagaaccatgattcttcatctgcatctggtccgtcacggacagacctatttcaaccgatacaaccgtctgcagggatggtcgaattcgccgctgaccgagtcgggcgtcgccgatgccgtcaaggccggtgagcgactgaaaggattgacgttcgccgccgcctactgttcggacaccacgcgtgcccagcagacggccgagaaaattctcgacatcaacgaagccgcgggtaacccgcgccccgcactcgtgacggacatgcacttccgcgagcagttctacggctactacgagggacttgacatggccatggcctggtacgccgcgggagcgccccacggcgtcaaaacctacaaccaaatcgtcgagaagttcgggttgggggcctcgcgtgattttctcaaggaagccgatcccttccacgacgcggaatccgatgaggaatattggacgcgcgtcgaaggtgcgttccgtcttatcgccgacaacccgaatctcaaggacggcgacgatgtgctgcagatttcgcatggcaacacactgcttagcctcggtcaccggttcggcggccctgacctcgatctgaacgaacgcccggccaatggttcggtaaccgtgatcgacttcgacaccgacaagccgttcggcgaagccgtgaccatcgtttcgtacggcaagtagcaaatagcaagcaatacatatcgaatagcacgtacggtccacggcggcacgccgcaaacgaaagcgtcagcaggacagcctttcgcctatagccgcatacgcctacgcgcacggttttcgccctgcgcatgcaatggtatgccaagaaatagggaaggagtgctacccttaggcgagtaagtgtgaccgcaaggaggaaacaatgggagtcggagagatcgctggcctgatcgcggccatcgcgttcgcagtattggccggtttcatgatctatccgctgatcaggctgggcaagatgtttgatcagatatcgcagacggtccgggagtccggtgaacacgccatccccgcgctggacgaaggcgtgaccaccgtcaagcaggtcaacaagtcgctcgaagacgtgaacaagatttccgccgcggcttccaccaccgccaacaacgttggtgcgttgaccgatctgtatggctccttcctcggtaagcccatcatcaagatcgcttccaccttctacgcgctgaaaaccacgggtcagtccttccttgcgaagaacgccgcgaaaaccaccgtcaacgacaccgccgagaagggggagtgatgttcaaacgcatcttctgggtcggcgtcggcgtggccatcggaatcgttgccgtcaccaaggcacaggcctatgtcaaggccaatacgcctgatgcggcacgccagttcctgcttggccccgatcaggacaatgtgccgatgaaaacactcgaagggttggtcaacgagttcaatgccacccgtcgagcccgcgaggctgagctcaaccgtcagtacatcgagcgcgccaactgacacgcgcatgccgccttgccatctagtcactgaatcagctagaacaaactaatcctcataatccagtcttttccaccaataccaggcgcaactgcgcccattacccaaacaaggagttcatccgctcatgcgcactgcggacatcgcaaagcgatacctcgattattttgccaagcacgaccatctcatcgtgccctcggcatccctgatttccccgaaccccaccacgcttttcaccatcgccggcatggtgccgttcatcccgtacctgatgggtgagcagaccccgccgaagcgccgcatggcctccaaccagaagtgcgtgcgtacgctcgacatcgacgaggtcggcaagaccacccgccacggcaccttcttccagatgctcggcaacttctccttcggcgactacttcaaggaagaggccatccactacgcctgggagctgctcaccacctcgcaggatgagggcggctacggctttgaccccgagaagctgtggatgaccacgttcaccgacgatgacgaagcccgttccatgtggatcaacgagggcgtggaccccgagcacatccagaagatgggcatggaagacaacttttggaccaccggtggccccggacccggcggcccctgctccgaaatctacgtggaccgcggccccgccttcggcaaggaaggcggcccgattgccgacgagaaccgctacatcgagatctgggacctcgtgttcgagaactacgaggtcgacaacgtcaagtccaagaccgacctgcacatcgtgggcgagcttgagaacaagaacatcgataccggtgccggcttggaacgtctggcctacctgctgcagggcaagaacaacatctacgagaccgatgaggtcttcccggtcatcgaggccgccgagcagctctccggcctgaagtacggcgagaacgaggacgccgacgtgcgcttccgcgtggtcgctgaccacgtgcgctccgccctgatgatcatgtccgacggcgtgcgcccgtccaacgtgggccgtggctacgtgctgcgccgcctgctgcgccgcaccgtgcgctccatgcgcatgctcggcgtgaccgatccggtgctgcccaccctcttcccgacctccaaggccgccatggaggccagctacccggagctcaacgacaccttccatgaggtgtccgaatccgcgtatggcgaggaagacgccttccgccgcacccttgagaccggcaccacgattctcgacgtggccgtcaacaaggccaagagcgattccgccgagcccgtcgtggccggcgaggacgccttcaagctgcacgacacctacggcttcccgattgagctgaccctcgagatggccgccgaacagggcgtgaaggtggacgaggccaagttccgcgaactcatggccgagcagaagtcccgcgcccgcgccgacgccctcaagaagcgtcacaacgtggatctttccgtttacgacgacttcaagaagacgctcgtcagcccgatcgacttcctcggctacaccgacatgtccgcccgcgccaaggtgatcggcatcatgcaggaaggcaagggttccgtgcccgccgtgaccggcccggccaacgtcgaggtcatcctcgaccgcaccccgttctacgcggaggccggcggccagctcgccgaccagggcgagatcctgtccgacgacggcgccgtgctcgaagtcgacgatgtgcagaagcccatcaaggacctcatcgtccaccagtgccgtctgaccgaaggcacgctggtcgtcggcgccgaagtcaacgccaacatcgacctggcccgccgtggcgccatcgcccgctcgcacaccgccacgcacatggtgcacaaggcgctgcgtgaggagctgggcccgcaggccacccagcgcggctccgaagacgccccgaaccgtctgcgcttcgacttccagtggtccaaggccccggccaagtccgtgatctccgcagtcgaggagcgcgtcaacgacaagctgcgcgacaacctcgccgtgaccaccaaggaaatgaagttcgacgacgccatcgccctcggtgccatgcacctgttcggcgagaagtacggcgacatcgtacgtgtggtctccatcggcgaagacggctggagccgcgagctgtgtggtggtacccacgtggaccacgtcggcaagatcggcatggtcaacatcctgtccgaagcctccatcggctccggcgtgcgtcgtgtcgacgccgtcgtgggccagggtgcctatgacttcaacgctcgtgagcacgcgctggtctcccagctgtccgacaagctcaacgctcgtccggacgagctcgccgagcgtgtgaacgccctgctcgccaagctcaaggaatccgatcgtcgcttggcctccatgtacgagtcccagctggccgcctcggttccggcgctggttgctgacaccaagaactccgcggccccggtcaaggtggccgtcaagaacgtgggccactttggcgcggtcgatgccctgcgcaagaccgtactcgacgtgcgcgcccagctcggtgaagacgcccccgtggtggtggcccttgccggcgtgaacgaggatgacaagccgatggtcgccgtggccaccaacgaggccgcccgcaaggccggcatcaaggccggtgatctggtgcgtggcgcagccaaggtcctcggcggcggtggcggcggcaagccggacttcgcccagggtggcggtgtcgatgcctccaagatcgacgaggccctcgaagcgctcaagcacgaggcgcagaaagcctgattccgccagtggtgtggttaggcgttgatttgggtaatgcccgggtcggactggcactgtccgacccggagcttacctttgcacatcctgctggcaacattcatgttgccggcgactatttctttgctattgacgaggtcctgaacgtcatcgaagacgaacatgtggaccatgtaatcgtcggactgcccctgcagatggacggtacagaaggcaaaagcgccaaaaaagcgcgcaggtgggcggccaatctggagaagaggctgcaagcagagagtgaagacagtgattctacggagtatcagattccgcaggtatcattgatagatgagagattgacaacagtcagtgcgcatcgtcagctgttcgaggcccataaagcttcgaacaagcacaggccggtggttgaccagcagtcggcagtggtgattttgcagacggcactcgaccgtacccgggagcagtgaggtatcggttatgaccgatgattttaacgagttctttgatgacaacacgcattgggtcgaacaggggtcagaaccaatgcgcggggccgagccgccagaaccgccgaaatcccgcagggagatgcgcaagcgacgtgcacagcgcaggcgcaagcgtatcagtggcattatcatcgctatcgccatcgtcgccctgcttatcggcggcggctatttcggcgtaaccaagctcatcgcatggcgcgacagccggagcaaccagtcgacggccatcgcggactatccgggaccgggctatggcgaggtcgaattcaccgtgagcgagggccaaggcgcggcggagatcgccgataatctgctcaaggccgaagtcatcaagtctactgccgcgttcaccagcgtggtcaacgccaatagcacgacactctatccgggaacgttcacattgaagaagcatatggccgcatccaaagtgatcgacgttctctccgacaccaaccaggcggcgggcttcctcgaggttcgtcccggtgaacgtgccaccgatgtgttcgccaacgccgcgaagctttccggcattgcccaaagcgaattcgacacgattatcaagaacgagggtaaggatattctgcccaatgaagcgggcggtagctttgagggatggctggagccgggaacctacaacgtcaagagcatgaagagcgcttcggaaatcctcaaggccatggtcgataagcgtatcgccaagttggatgaattgggcgtgccggccggcggtgaccgcgaacgggtgatgatcatcgcctctatcgccgaggccgaggtcaacaaagccgattactacggcaaagtgacgcgagtcatcgagaaccgtttggagcagggcatgtcgttgggcatggattccaccgtggcctatggcaataacgtcaagcccgcgcaggtgaccaccgagatgacccaagacgagtccaacccgtacaacacgtacaagatctccggcctgccgcctacgccgatcagcaatcccggcgataacgccattcaagcggcactgcaccccgaaggcggcaattggctgtacttctgcacggtcaatctggacaccggcgaaaccaagttcgccgcaaccgccgatgaacatgaccagaacgtggccgaactacgcaagtggcaagccgaaaaccagtagtcatcccgttagcttccttcgcttggggaagctgatcggacgttggtctcttcattggctccctcgccgaggggagctgtccgcaaaaaagcggactgaggggagcactgcagggaatgtaacgctcaacttaagcccggggctcccgcgaagcggatggaagaaatctaggacaacaccccaacagccaccgccacaatcgcgcccgccaatatcaccggcacatacggcaccttgcccgcatgtgccggtgatgtgcgttgtgggtcgaatcgcgtccacaaggcaatccatgtgatgccggcaacgcccatcgccagccaccagaccaccacaggcaacaggccaaacagtccgacagacaatcccataggtatcagggcggtcacatcgccgaatcccaatgaccgaggcaccagcaacgccaacgcgaactggatcaggcaacatagcacggtgaacaacagcgcctgcaacagcacgaacaggtcgttcaccaccactccatacgcgaaatcggcggccagctgaagcaacgcgcccgcagccacccacgcgatcggcacccgccgatgacgaacatcctcaatggacagtgcaagcccacatagcagaccgggtagcgtgaacaggtatggcatggcttaacattaacccctagctagacgtacacatagacgtacacacatgaaacgagggaagttatgctgcgttggcagacggcaggggagtctcacggagaagcattggtggccatgattgaagggttgccggccggcgtgcgtattagcacggacgatatcgtttccgcactggcacgccgtcgacttggatatggtcgcggtgcccgcatgaagttcgagcaagacaaggtccgtctgctgaccggtgtacgccacggcctgaccctcggctcgccggtggccatcgaaatcgccaacaccgaatggccgaagtggaccgaggtcatgagcgccgatgcactcgaccatgacctgccgcgcgaaggccgcaatgcgccgctgagccgcccgcgcccgggccacgccgatctgaccggcatgcgcaagtatggttttgacgacgcccgcccggtactggagcgctccagcgcccgtgagaccgcctcccgtgtggctttgggcgaggtggccaagcagttcttggatcaggcgttcggcatccgcaccgtagcccacgtggtggcgcttggtggcgtgcagaccaaccccgacctgcctctgcccacccccgacgatctggaagcgcttgatgcctcgcctgtccgtacgctggacaaagaggccgaagcccgcatcatcgaacgcatcaacgaggccaagaaggcctccgatacgttgggcggcgtgattgaagtgctggcttacggtgtgcctgccggcatcggcacgtatgtggagtccgaccgccgactggacgcggctctggcctccgcgatcatgggcattcaggcgttcaagggtgtggagatcggcgacggcttcctggaagcctcccgccccggttcgcaggcgcacgatgagatcgtggtcaacgccgacggccgtatcgaccgtctgtccaaccgcgcaggcggcattgaaggcggtatgtccaatggccaggtgattcgcgtacgcggtgccatgaagccgattccgtccatccccaaggccctgcgtacggtcgacgtgctgaccggcgaatccgcacaagccatcaaccagcgttccgacagcaccgccgtgcctgcggcatccgtggtggccgaggccatggtgcgtctgactttggcgaagtacgcgctggataagttcggtggagacagtgttgccgaaacacggcgcaaccttgagtcgtatctcgcctcgtggccggagcacatgcgctgaacgaagggcgtatggtttcgtgacgactgccgcggaaccatcagcaactgtactcaccaatcgtcgagaggattcgtagattatgaccgcacgcccccgcgccgtcatcatcggcatgatgggagccggcaaaacacgtgtcggtaaggaagtggcgcatatgttgcgtctgccgttcgccgatgccgatgtggagatcgaacgtgaagtgggcatgaagattccctcctacttcgaggaatacggtgagccggcattccgcgaggtcgaggccgatctcatcgccgatatgcttgaggatttcgacggtatcttttcgctgggcggtggcgctcccatgacgccatccacccagcatgccctcgcctcctacatcgaccatggcggtcgtgtggtctaccttgatgccgatccggcggaagccatggaacgcgcgaaccgtgggggaggccggcccatgctcaatggcaacgccaactcccgttggaaaaaactgttcaagcagcgtgacccagtattccgcgaggtcgccaacgttcatgtccatacccgggggcttacgcctcagggcgcagcgaagaaagtgattgatatggtatctgagcgagcagtgcatgttaccggagcggcaattgagccgtatgatgtggtcattggcgaaggtgccatgaaccatctggtcgacgtgctgggacccaaacccgccaaaatcgcgcttatccacactcagccggtgcagcgacactccgatcgtgcccgcgccctgttgcgtcagggcggctatgaggtttccgacatcgtgattccggatgccgaacccggcaagaccattaccgtggccaacggcatttgggaacgccttggcaacgaaggtttcacccgatccgatgccgtggtggggcttggcggcggtgccgcaaccgatttggccggtttcgtggctgccacgtggatgcgcggcgtgcgctatgtaaactgcccgacctcgctgctggccatggtcgatgcctccaccggtggcaaaaccggcatcaacaccccgcagggcaagaacctcgtcggctcgttctacacgcctgccggtgtgctggccgacaccaagacgctggctacgctgcccaatgacatcttcatcgagggtctcggcgaagtcgccaaatccggtttcatccgcgaccccgaaatcctgcatatcctcgaagaccacgcagctgaactgcgcgctttcgacggctctacattcctcggctcgccgctcgaagacgtggttgccgagctcattgagcgcacggtaaaggtcaaggcctaccacgtctcctccgatttgaaggagaagggtctgcgtgaattcctcaactacgggcacacgatgggccatgccatcgaaaagctcgagcatttccgctggaggcatggcaatgcggtggccgtcggtatggtgtatgccgccgagctggcccatctgatcggttacatcgatcaggatctggttgactatcaccgctcgttgcttgcttcgatgggtctgccgacgtcgtggaatggcggctcgttcgacgacgtgctcgcattgatgcatcgcgacaagaaggcccgcggcaatgagctgcgcttcgtggtcctcgacgagattggtcacgtcgtacacctcgacaacccgcccgccgaagccgtggaagaagcattccgtcgtatccagcagtaattgaacggccgtaggccgtgccgttcgccatcccctcagaaaaaagtacttggctcccctctaacggaggtaccccggagtcggatttaccttctacctccctctgatgagggaggtgccccgaaggggcggagggagagaagcacaaacaaaaggagtcccaatgaccaaagtcatcgttgtcaatggccctaacctcggacgtctcggcgtccgccagcccgacgtctacggtcgtcaagacctcgacaccctgcgcaagctctgcaccgaatggggcaaggacctcggcctcgaagtcgaggtgcgccagaccgacgacgaagccgaaatggtgcactggatgcaccaagccgccgacgagaaaaccccggtggtcatgaaccccgccgccttcacgcactattcgtatgctctcgccgacgccgcgcacatggtcattgacgagaacctgccgcttatggaagtccatatttccaacccgtccgcccgcgacgagttccgcaagcgttccgtaatcagccctgtggccaccggcaccatcaccggcatgggtttctacggctacaagctcgcgctcgatgctgtggcgcacttgctgagcgaatagaaccaagccctccagccaatcccgggtagcagtcgacgttgcgcccgggattcctgttacctgaggaaaccataagcgtccaagtaaaggaagccatgactctcaccgccacggaacgtgatctcgtcgatgccgcgtcacgctggtttgacgcccaccgcgcacagttcgtcgatgagctgtgtgagctgctgcgctacccgtcggtttccgacgaatcggacccgaatcctcgtccgggcgcgccttatggacccgaagtacgccgtgtattcgaccatatgctggccaaggcaggacgagacgggctgcctacgcgcgactacaccggccacgtcatggaagtcgtttatccacaggagaacgtggagaccgaccgtgacatcgccttcgtcgaccacctcgacgtagtccccgccgacgacggttggacgcacgatgccttcgatccgcaggttattggcgatattgttatcggtcgcggctcattggacaataaaggcgtcgcgctgaccagctatttcctactccgtttcttcaaggaacacgaccaccgtttccgccaccgcgtacgtatactgttcggcggctccgaagagatcgcgctcaacgacatcaaatggttcgtcgccaacatcggcgcgccgtaccaggccatcgtcaccgatggtcccttcccggtgaacaatatccaaaaagggctgctcgatgtggatgtcgaactgccggtcgggccgcaattgcgcggttggcatgccggcaccgccactaacacggttcccggggccgccgcaatcaccctcaccggcgtcgacgaatctaccgtgcggcaagcattctgccagagcggcaacatcgctccagatatcgccgagcgattgcatatcaacgcaacagcgcaaggcgtcacgattgaggccaccggtgtcgccggtcatgcctgccagccgtccggtaccgtaaacgctatagcggtgctcactacggcgcttgcccggtccggtctgctcgaaggccgtgacctcactgcagcgcaggcgattgcccaatggacaaaagactcatatggcaccggcttgggtatcgattgcgagaatgcggaaagcggaccgactaccgccaatggtggtttgattataccggcgaatgagttcgctgaagcagacaaggtattaggcgcggtatcaggtgagacttctgaagatgccatcgtattgcacttcgacatccgttatgcggtaggccaggcacacgaacaaatcatcgagcgtattcaagcacaagccgaagcggcgggcggccgcattgtcgacatccttaacgatgacccatactacgtgcaggctgacgacccgcgtgtccagttgctcaccgcaacctacaacgacgtgctcggttgcgaggctcgacccgtggctgtcggcgacggcacccacgcccgctttatcccgcgcgcactcaacttcggtcccgaattccatgccgaccatgtgccggcggtcgacggcatcgacctggagaccccgccattcatcgcaccaggtgccggcaacgcgcacggtgccgatgaatgggcctcgctgaaaaacctgaaaacagcgtttgtcctatatgcgttaggcctagtgcgtctcgaccaatacctgcaatagctggcggataagacgtttgacgtgattatgaccttgcgtatgctttttgacgagcctactattcgtattgttcaagtacgccatgtcggggccgacgcgtctggtgaacacgccgggtcatacacggatgatagagtgaaattccatggttagaagaacacatggtaattctcaagaacacgtcaccaagcatattttcgtcactggcggcgttgtctcctctctcggcaagggcctgaccgcatcttcgctcggtcgtttgctgcgcagccgcggtatccatgttctgcagcaaaagctcgatccgtacatcaacgtcgacccgggcaccatgaacccgttccagcatggtgaggtctacgtgaccgaagacggtgccgaaaccgatctcgacatcggccactacgagcgtttcctcgacgtcttcctgagccagaaggccaacgtcaccaccggtcagatctatcaggaagtgctgcgcaaggagcgcgccggcgaatacctcggccagtgcgtgcaggtcatcccgcacatcaccaacgaaatcaagtctcgtatgcgcgcccaggcttccgatgacgtggatgtgatcatcaccgaaatcggtggtaccgtcggcgacatcgagtcccagcccttccttgaggccgcccgcgaagtgcgccgcgatctcggcccggacaactgcatgttcgtgcacgtttccctggtgccgtacatttccgccgcccacgagctcaagaccaagcccacccagcactccgtgatgatgctgcgccagctcggcatttccccggacgcccttgtgctgcgctccgaccgcccgctcaatcagtccatcaaggacaagatctccctgatgtgcgatgtcgatgccgaaggcgtggtcaactgcgtggatgcgccgagcatctacgatgtgccgaagatcctgttcgaggagggcctcgacgcctatgtggtgcgtgagctcggcctgccgttccatgacgtcgattgggacgaatgggccgacctgctggagcgtgtgcaccaccccaagcacgaggtcaacatcgccatcgtcggcaagtacatcgatctgccggacgcctacctgtctgtcaccgaggccatcaaggccggcggctttgccaactgggccaaggtcaacgtcaagtgggttgcggccgatcgttgcgaaaccaccgaaggtgcggccgccgctctcgacaacgtcgacggcatcgtgatccccggcggcttcggcatccgcggcatcgacggcaagatcggcgctctgaagttcgcccgtgaaaccaagctgcctgccctcggcctgtgcctgggcctgcagtccatggtcatcgaatactcccgccacgtgctgggcattgaagacgcgaactcttccgagttcgagcccgattgcgccaacccggtgatcgccaccatggaagagcagaaggacatcgtggccggcaagggcgacatgggccacaccatgcgtcttggctcctacccggctgagctggaggaaggctcgctggtcgccgaactgtacggcaccacgcatgtcaccgagcgccaccgccaccgttacgaagtcaacgtggcctacaaggatcgtctgcgcgaaggcggcctgcgcatctccggccagagcccggacggcgagctcaccgagttcgtggaactgccgcaggacgtgcacccgttctatgtggccacccaggctcacccggagttcaagtctcgcccgaccaagccgcacccgctgttcgccggcctggtcaaggccgcgctcgaccatcaggcggcacgctgactcacttttgtgccgtgcataatatcgcggcatgatgtgctggctgccgtcatcggcgtagcgcaagacatacggtaaagacgtggtggcgaaacatctaatgatgtttcgccaccacgtctttttttgttgtatgagcatcatgcagcatgatgtattggaaggcgacggtaaaaaattaccgtttctatggtgtgttggtagtatgcagataacgcttagtaggccatcgcagaaagaccgaccatgaccgaacaccttgatgactcgacccagcagtttgcgcctctgtttggtgcgaataatgccgtcagcggcactgtggcagacagtgtggatgctgctgcatcagattccattcagggcgatgagatgaggaggcgccgcatctggccgtgggtggtgattgcttgtctgctggttgccttgggggctgcctgtggcggcggtgtttggttcttccaagatcacgtgctgcctggcacaacgctatggggaaattcagttaccggcaaaaccgagcaggagattgtcgacctaatcaacgaccaggtcgacaacaccgcggtacgagcgaaataccaggggcagtcggcgacgttcacgctgaaagatctcggcatcgaagttgatggtgaagcaatcgcatccgatgtcatcaatgcccaacgcggtgacgcatggtggcaacagtatgcgttctggattacgcatgatgtggccccgcaaatcaatcccgagctcgctgatggcagtgtggtagataaggcgctgaacattgatgcacaagaacctgttgacgcgcaagtcgcattgaacgataacaacagtggcttcaacgttattgcgggagaaaatggccagggagccaacgccaccagcattgcgaagcaagccatttccacagtggagtcattgggcagtgtccagccacagaccgttcgggtggaactcgacgtaaccgaaccgacgattaccaatgcaattgccgatgaggcgaaaaccacgctggaaaccctagtgaacaatgccgtggccatcaaggtggcggataaagacatcgccaccgtgaatgcgtccatgctgggttcggccatgcgcatcgacgccaaccagcagtcaaagctgaaagacaatgaagtacgtaatggctacgtggtctttgatgccgataagctgcagcaatactatgacgagcaaatcaagccgaatctcaaattggaacgtgaagacaagaaggtcgtcgtcaataatgctggcgaggtgctgagcactgaaacagaaggccatgatggcattgtgattgccgatggcgcggatacggaggttggtgctcgcttggctcaggtgctggccacgggaactggctcagtgaatgtggacggcaaggtagatcccaaacaggaagtcaaggtcgctcatcgcgtggcgattgacctgtccgaccgtaagctctatgcctatgagaatgacacggtggtcaagacattgaatgtcgtggtcgcggagggcaacgacaacgtcaccggcgaatgcgttggcatgatgtgtacgccgacaggtgacttcaacgtatggcaaaagttgcccagtcaagatatgagcggcacgctgaatcttgccgatggcacggtggaaacatgggatgtcaaagacgtgggcttcgtcaattacttctcctccggttgcgcaatccaccgtattgccggcggatatgtagcggatgccgtaatgccctccattgccaacggatctcatggttgcgtgggtatcggatgggatgtggccgaatggttctacaactggtgcaatatgggcacgagcgtgcatatccaagtgtgatatgcaacagtgtgatatgtaacaaatacggcatgcagtggtgcgacacataatgccgcatacgcgatgttcggtgtgcatgggacaagcttgcccggctccaatatcgctgtatcgcattcgtgtaatcaagcccacagccaatatgcgtcagggcggctagtgtttgcacttgggttctgctaggttttcataggattaagtgtgatacaaggaaggcaggatggtgaccgaaaacacagcaccaaacgccgccgctgacgtggagatgagccagtatgtggctgatcgtacccgcgtcaacgaggacaagatcaagaaggatgacgagatcatcagccagttcggcgactacaactatggttggcatgattctgatgccgccggcgaagccgcaaaacgaggcattgatgagaacgtcgtacgcgcgatcagcgccgacaaaggcgagccgcagtggatgctcgacatgcgtctgcgtggattcaaggcgttcctcgaaaagcccatgcccgattggggtgtggatctctccggcttcaacgcagacgacttcaagtactacgtcaagccaatcgacaagcaggcgaaaagctgggacgaactgcctgacgacatccgcaacacctacgatcgtctcggcatcccggaggcggagaagaaccgcctcgtctccggcgtggccgcccagtacgagtcggaggtcatctacaactccatccaggaggacctgaagaagcagggcgtcatcttcgtcgacacggacaccgctgtgcgcgaataccctgaactcgtcaagaagtacttcggcaccgtcgtgcctccggaagacaacaagttcggtgccctcaacaccgcggcatggtccggcggctcgttcgtatacgtgccgaagggcgtgcatgtggacatcccgttgcaggcgtacttccgcatcaacaccccggccatgggtcagttcgagcgcacgctcatcatcgcggacgaaggctcctacgtgcactacgtggaaggctgcaccgccccgatctggtccgaggactcgctgcacgccgccatcgtcgagatcatcgtcgaaaagcacgcccgcgtgcgttacaccaccgtgcagaactggtcgaacaacgtctacaacctcgtcacccagcgtgcctacgtgcgcgagggcggcacgatggaatgggtcgacggcaacatcggttccaaggccaccatgaagtacccggcctgcatcctcgccgaaccgtacgccaaggcatccaccatgtccctcggcttcgccggcaagggccagtaccaggacacgggcgcgaagatgattcacctcgccccgcacaccagctccaccatcgtcgccaagtccatttcccgtggtggtggccgctccgcctaccgcggtctggtcaaaatcgtcaagggcgcgtacggttcgtccaactcgaccgtgtgcgatgccctgctggtcgacgacttctcccgctccgatacctacccgcatgtcgacgttcgcgaagacgacgtttcgatggcccacgaagccaccgtttccaagatttccgaagaccagctcttctacctgatgagccgaggtctcacggaggaagaggcgcgaggcatgatcgtgcgcggcttcgtcgaaccgatcagccgtgagctgccgatggaatacgcgcttgaactcaacagacttgtggaacttcagatggaaggatcggtgggctgattccgatgaccgacaacacaacacccgtcaaggaaatcaagattccggtcgccgaccccaacgacccgtacgcgattccggccgctatgccgtcctccgtggaccatgccgtgcgctcgttcaacgcaggcgactacccggagcccagccgcaagcaggacgaatggcgctacacgcctatcgagcgcatcaacgagttcttcaccgtgttcaagccttccggcgaaacgcagatcgaagtctccatgattgacggctcgccgttggccgaaggcgtgaagctcagccagatcaagctcggtgagggcctgtccggcactgtgtccaagcccaacgaccgcgtctccgcagtcgaatgggaatccggccgcaccgcaaccattctggaactgtccggtgagatcgcccagcccgtgctcgtcaaggtgcacggcgcgggggaggacctcgacgctttccatctggtgatcgccgccgccgacaaggctcatgcggacgtcgtcgtggaacacgacggtgacgcacgactggccgaaggcgtggaaatcaccaccggcaaggactcgcacgtctccaccacgttcgttcaggaatgggccaaaaccgccaagcatgtggccaaccaccgcatccacgtcggcgaaggcgcatccctgcgccactccgtcgtgaccttgggcggcgacatcgtccgcatccgcatggatcaggacttcggcggcgaacagggcgacctcaacatgctcggcatctacttcgtggaccccggcgagcacatcgaacaccgcacgatggtggtacacaaccaccccgactgcaagtcccgcgtggtctacaagggcgcgcttgacggcaagggcgcgcactccacttgggtgggcaacgcgctcatccagcccaccgccccggcaccgactcctacgagctcaaccgcaacctggtcctgaccccgggcgccatcgccgattccgagccgaacctcgaaatcgaaaacggcaacatcatcggtgccggtcacgcctcttcggtgggccgcttcgacgacgaggaactgttctacctcgaatcccgcggcatccccgaaaccgacgcccgcaagctcgtggtgcgcggcttcttcggcgaactcgtcgaggagatcggcattcccgccatctccgaacatctgatgaccgtgattgaccgccgactggcccgtggtgaaaacgacgccatggcacaggtcctcgaagacaagtaagaacagcatttttaggagcacaacaatgtcaacactcgaaatcaaggacctgcacgtccacgtcgaaaccaaggaaggcatcaagccgatcctgaagggtgccaccctgaccgtccactccggcgaaacccacgccatcatgggccccaacggttccggcaagtccactctcgcctacacgttggccggccaccccaagtacgtggtcgactccggcgaggccctcctcgacggcaaggacatcctcaagatgactccggacgagcgcgccaaggccggcctgttcctggccatgcagtacccggtcgaaataccgggcgtgtccatgaccaacttcttgcgcaccgccaagaccgaaatcgacggcgaggctcccggtattcgccagtgggccaaggacctgtccgcagccatgaagcgcctcaagatggacccgaagttcgcctcccgttccgtgaacgaaggcttctccggcggtgaaaagaagcgcgccgaagtgctgcagctcgaactgctgaaaccgaagtttgccgtccttgacgaaaccgactccggcttggacgtggacgccctgcgcatcgtgtccgaaggcgtgaaccgcgccaaggaagccaaccagttcggcatcctcatggtcacgcactacacccgtatcttgaagtacatcaagccggacatcgtgcacgtgttcgccgacggccacttcgtcaagaccggcggccctgagctggccgacgaactcgaagagaacggctacgaccagtacctgcccgaaggcgccgactccgagtccgcactggcctgagtccgtgaccgtgggagtctgacatgccctattctcgacacgctccgggccgcttaggccaggtctttacggtcgcgaacaggccatgtcagactcccactcgtttcgtacaattgttacgtaagtagggggaacataatggttgattttaaggcgattcgggcgcagttcccgattctggatcaggagattcacgggcacccgctcgtgtacctggattctgcggccacctcgcagaagccgaatgcggtgatcgacgccgaggcgaacttctaccgtacaattaacgccggcgtgcaccgtggtgcgcacgagctggccgcccgtagcaccatggcctttgaggaggcccgagccaaggtggccaagctggtcggcgcgaatgcggccgaaggtgaagaggaggtcgtcgtcaccggtggtgccacggccggactgaacctgctcgccaccgcattcggcaatgcatcgctggggcgtgggggagaagccgccaagcgttttgccctgaagccgggcgatgagatcgtcgtctcgcgtgcggaacatcattcggtgctgctgccgttccaggagctgtcctaccgtaccggcgccaccttcaagtggatcgacctgaccgaggacggccgtgtgcgtacggacaacctcgacgaagtcatcaccgagcgtaccaaggtcgtggccgtcacccacgtgggcaacgccacgggtgccatcaccaacatcgccccgatcatcaagcgtgcgcatgaagtaggttcgatcttcatcttggacgcttgccagtccgtaccgcacctcaaggtcgatttccacgcgcttgatgtggacttcgccgcctggagcgcgcacaagatgtacggtcctaccggcgtcggtttcctgtacggtaagcgcgacctgctcgaagccctgccgccggccaacttcggcggctccatggtcgagctcgcctacatggaccacgaggcccaatacatggcccctccggcccgcttcgaggccggcacccggccggtcgcccaagtggtggccgcaggcgtcgccgccgaatggatgatgaacatcgggctcgagaacatcgaagcccatgagaagaccatcgccgccgaactgctcaagctcggcgacgtcgatggcattcgcatcctcgggccgcgcgaaaacgtggaccgcatcggcaccgtggcgttcgacgtggccggcgtgcatccgcacgatgtgggccagttcatcgacgcccagggcatcgcgattcgcgtgggacaccactgcgcccagccggtacaccgccacttcggcctatacgcatccaaccgtgcctcctccggtgtctacaattcggtcgaagatgcccaagcgttggtcgaagcggccaagggcatccgtaagttctttggagtggagtaaaacagaacaccatgaacgaattcggtatgagcggggatgacctcgaacagatgtaccaagaggtcatcctcgaggcgtcgaaacatccgcatggcaaggaatcctttgcgcccaacgcagcggtcgaacagtccgcggacgcagcggccaatgtcaccgtacaagccagccacgaatactgcacgcccggtgaatcgcaccagttcaacccgacctgcggcgacgaggcgaccatccatgtcgaagtctccgatgacgaaccgcacaccatcaagcgattggtgtgggacggccacggctgctccatttcgcaggccagcctgtcggtgatggtcgatctggtggacggcaaaaccgttgacgaggccatggatctggaacagacattccacaagctgatggaatcgcgcggtgccggtctggacgacgagaacctggaagaaaagctcggcgacgccgtggtattccaaggcgtgtcgaaataccctatgcgcatcaaatgcgctctgctaggctgggaagggctgaaggactccatcgccaaagccctcgctgcaaagaactgaggaaatatgtccaacgataatttggttcccgaaccacagccgtccgttttcgatgctgtcaacggcgtcctgcaggacgaggaggccgctcgccgcgtgatggccaacccggccttggccaagggcttcccgaacggacgcccgatcgagcactctgctgcgtccggcgatgacacctgtgcgtgtggcggtcaccacggcaaatgcggttgccaggatgacgaacagtccgatggcagcgagattccgatcaaggcgattgacgatatcggccgcgccactgccgaagacgtgcgcgaggcactgcatcaggtgattgatccggagcttggcatcgacgtgatcgatttgggtctggtctacggcattgagatcgatgagctaggccgcgccattattacgatgacgctgaccacgccggcctgcccgctgaccgaccttatcgaggacgaatgcgcatccacgctggccggtctggtcgaggagttccgcatcgactggacgtgggatccgcgctggaccatggagcgcatcacgcccgaaggccgcgaccagctcgccgccctaggcttcagcttcgacaatatgccaaagtactgatagcgcttagtaagttccctcatcagagggagctctatacgagaaaagccccgcatgatgcggggcttttccatgtctggactggtcaatcagtcatcgacgatggtgttcttcgggacaaccgtgatgccatccggcgtgacggtgaagccacgggccagatcgtgctcggtatcgatgccgacagtggagttctcggtgagcaccacgttcttgtcaagaatcgccttgtacacgcgggcgcggcggttgatgactacaccgtcgaacagcacggaatcgacaatctgtgcccacgagtggatacgcacattgggggagagcacggagtggtgcacttcaccgccggagacgatcacaccgggggagacgatcgaatcggtggcgtggcccagacggtcgcggccggcgtgcacgaacttggccggcggcaggttgccggacatcgtgtaaatcggccaatcctggttgtacaggttgaactcgggcacataggcgatcagatccatgtgcgcatcgtagaactgcttaatcgtaccgacgtcgcgccagtaagcgtgatcagtggccgtggagcccggaatctcgttcgagttgaagtcgtagacgccggcttcgttgcgggaagcgaagtacggggcgatgtcgccgcccatgtcgtgcttggtgtcggcagccttctcatcgagagccagagcctcgaacagggccttggtgttggcgacgtagttacccatggaggccagaatctggttcggattgtccggcagaccggtggtggtgggcggcttctcctggaagttcttgatcatgttcgggtgatcgggatcgacctcaatcacaccgaactggttcgattcctcgatgggctggcggataccggccacggtgaactcggcgccggactcgatgtgctgctgtaccatctgttcgaagtccatgcggtagacgtgatcggcacccacgatcaccacgatgtccggctggacatcctcgatgatgttgatggtctggtagatggcgtcggcggagccgagataccagtgcttgccgagacgctgctgcgcgggcacaggggagacgtacgagccaagcagcggggagaaacgccagacctgggagatgtggcggtcaagcgagtgagacttgtactgggtgagcaccacgacctgacggtacccggagttcaccaggttgctcaacgggaaatcgatcagacgatacacaccaccgaagggaacggcgggcttcgcgcgatcacgggttaacggcatcaggcgggtcccctcaccacctgcaagcacaatcgacagaatcttgggattcttggtcatcgtaactgtcctctctgttactgagcgtctttcgacaccgcactgccgggccggatgcttccttgcattcggtttacatagttaataattgcagaaaaaaacgaacatgcaaggctttcgcccccgcgtgccgtgaacttgcgatgaacagtttcgtagatttgttaaggatccggccttttcggagcgcgtgcgattccttagcgtgtcgcgtagaacgccactgcgctggatgccgccacgttcaggctatccacgccgtggctcatcggaatcttcacggtcaaatcggcgcgggcaatcgtatggtgggacaggccgtcgccctcggtaccgaagatcagcgcgagcttgtcgatatgcgtcggatcttcggcaggcgcgtgcagacggcgtgtcagttcgtccaacgaaatcgaacgatcctccaatgccatggccacggtggtgaagcccagcgacttcaactcgtcgatgccctggaacggccagtaatgcttgttttcggtgccgtcgtcgttgaacccggtgatacgggtccacggaatctggaatacggtgcccatcgacacgcgggcggcgcgtcggtacagcggatcaccgcaggagggtgtgaccagcacggcatccacatcgagcgcggccgccgaacgcatcagtgcgcccacattggtgtggtccacgatgttttccattactgccacgcggcgggcgctcttgcagacctcggctacggagggcaacggccagcgtcgcatcgcgcatagggcgccgcgatgcaaacggtagccggtcagacgcttgagctgctcaggtgaggccacgtagacgggaatatccgcgccccagcgcccgtcgatgaagtcgaaggtgtctttcatgccctccagccaaggttcctcgaccagcagtgacagcggttcgcggtcagcggccagcgcgcggtcgataaccttgggggactcggcgatgaacacgcccttggctggttccaagcgattacgcaactgcatttcggtgaggctcacatacgcttcgacgcgcgggtcgtcgacggtgtccagcgtgatgaactgcattggtggcctttcgtgtgtgcagataacgaaaaaccccttgcaatgcaaggggtttatctgtgcccgagacgggacttgaacccgtacgcctgtataaaataggcactagcacctcaagctagcgcgtctaccattccgccacccgggcaggtgtcgtttggacaacgagtagatagcttagcatgaaattacagggatgcaattcgcgcgtgtgcccggcgtgtcgcgtgtagccttgaagtcatgactgatgccctttttcttttcgacccgcaggtcgacgacgtcccggtgaacagcgacgaactccacgccggctggaagctaaccctgcccgctcacatcaagcgccatgccgtgcaggccatgcgactcaaggcaggggacagcctgcaactttccgacggcaacggcttgagaatccaggcagtgatggccgatcctgaagccggactggctgaagtcgtggaagtggggcgcgaacccgagccgctcacccgtttggcgctgattcaggcattggcgaaaaccggccatgatgagcaggccatcgatatggctactcagattggcgtcgaccaagtggtgccatggcaggcggaccgatccattgccaagtggaaggtcggccgtacagacaagaagtggaattcggtactggatgccgccaccgagcagtcgcggcgcgcctttaagccgcaactggaggcgtgcgcgtccagcaaggaggtcgtggccatctgccgcagggcctgcgtgcatggcgatgtggtgattgtgctgcatcaggatgctaccgatacgtggtccggcgtggaggagaaggttgcgcagttggtggaacgcacgctccaggacggccggccgcggactgtcagtgtggtggtcgggcctgagggcggcatcagtgagcaggaggtagctgatttcgtcaaggccggagcggtgagctgcgtactggggcgcaatattctgagagccgcgacggccggtcctgtagcgttgtcgctgttgtctcgggtgttgggacgttacgagtaacgcccacgcgctaagctggtgcgtagcaacatcaaaccaaggagcatgatgagcgaatccgacgattgcctgttctgcaagatcatcgcagggcagattcccagcagcaaggtctacgaggacgagacgacctacgcattcaacgacatcaatcccaaggccaaggtccacgtgctcgtggtgcccaagaagcactacgccaacgtcgccgaacttgccgccggtgacccgaccgagctggcccacatcgtctccattgcgcagaacatcgccgacaaggaatttcacggcgcctaccgactggtgttcaacaccggtctcgacgccggccagaccgtcttccacgtgcacgcgcacgtgatgaccggcgaaaagctcgacgagtagtaggggaatatccgcttcgtggcaacgactacacgtaccatcaccatcccgccccaacttgaccccgtcgccgtgctcggcccggttgacgaggtcattcgcgaggtagagcgcgcctttccggacctgacgattatcgtgcgcggcaaccgcgtggcgatcgtctcccgctccaagcagaccgaagcccaggccgcacaggccgaggatttggtcaataccatcatccaagccgcctacaccgcgcctatggacgccgacaccgtgcgtcgcatgctcgaccagaacgtgctcaagaaccacgtgcgcctcgaacatcccggtcacggcccggtgcgtgacaaactggcgcaatcgacctcaaacgaacgcgcccatgcacgttctgccggctcccacgacccgacgtaccgcaagcccacggttcccggcgtcatcacctttgctgccggcgtgccggtccgtgcgaaaaccgccggacaagtggcctacgtgaacgccatcgaatcgcacaccatcaccttcggcattggccccgcaggcaccggcaagacgtatctggccgtggccaaggctgtgcgtgccttccaggacaagcagattcgccgcatcatcctcacgcgcccggccgtggaggccggcgaaagcctcggctttctgcccggcacgctgaatgacaaggttgacccgtatctgcgcccgctgtacgacgcgcttggcgacatgctcggcgccgaccagctcaagcggtacatggacgacggctccatcgaagtggcgccgctcgcctacatgcgcggccgtacgctgaacgacgcgttcgtgatcctcgacgaggctcagaacaccaccgaacagcagatgaagatgttcctgacccgtctgggcttcaacaccacgatggtcatcaccggcgatatctcgcaggtggacctgaccgtgcctcgctcgggactggccaccatcgaacgcatcctgggcggcatcaacgacatcgcattcgtgcatctcaaaaccgaggacgtggtacgtcaccagctggtcggacagatcgtggccgcctacgaccgtcactccgccatcgccggcgaccaccgcgacatcgaacgcaagggccgccgcaaccataccgacttcgatgcccgccagcaagcggattcaaccaaccaaagcgagacagacgatgagcgttgacgtcaccaatgaaacccagtgggtcatcgaccccaaggtcttctccgatttgggtatttgggtactcgaccagatgcgcgtgagcacccagtccgacctgaccatcatgttcgtggatcccgatcccatcgccgaactgcacatgcgttggatgaacctcgaaggcccgaccgacgtgatgagcttcccgatggacgagctgcgccccggcgacggcaaaaccgtgatggaaggagtgctcggcgacatcgtcatctgcccgtgggtcgctgcccaacaggctgccgcagccgggcacagcaccatgcaggagatgctattgctcaccatccacggcatcctgcacctgctcggctacgaccacgtgacccccgagcaggagcgccagatgttcggcctgcagcgacagctgctgctcaccttcttcgccctacgccacgatgccaacgtgcaggccacgctgcccgccggcacacccgacgcgctggccctgtacgacgccgcgcacggtgctggccgcgacctcgattccaaataagctcccaaatcaatcacaccaaatccggattattcgataccgttcaaggacattcaaggacaccgaaaaatcattatggagtattccagtaccacgccgatcgccatcaccgtcattcttgtactcgtggcggccctgttcgtctggctctcgctgaccatggccgccgctgaaggcgccgtggcccgcgtaacgcgagccagccttaacaatctcatcctcgaggtgcagaccgactccgaagcaagccagttcctcaagatgaagaagatcgacaagattcatcgcgtgcaacggctcatcgccgaccgttacgccaccgccggcagctgtgcgttcttccgcatcgcctgcaatgtgctcgacggcgtactggtgtcttccatcgcatccctgtggggtgcggaactgtggattgaactgctctccggattcctggtcgcgattatcgtagccgtggtctccgtactggtccgcccgcgcaccgccggcatggccaagccggtcggcatcatgatttccaactcgcgcatcgtgtcgttggccaccaagctcacgccgttcgcacgcatcggtggcgacaagtccggttccaagggaccgggccgccgctccaaggactccgatctgtccgacgacgaggagcttgagaagattcagctcgagcagggcaaggccgccatcgaccgactggtggagtccaacgacttcgatccggaagtctccgaaatgttgcgcaacgtgctcaccctgtctgatacgttgactcgcgagatcatggtgccgcgcaccgatatgatctgcatggagcgcgactccacactgtcttccgcgctgaaactgttctcccgctccggcttctcccgcgtgccggtgatcggtgaggatgtggatgacctgatcggcgtggcctatttgaaggatgccgtgcgtgccaccgccttcaacccggcggccatggagcgcgcggtcgaatccatcgtccggcagccgctgcttgttcccgaatccaagccggtggacgacctgttccatgagatgcagcgttcccgccagcatgtggccgtggtggtcgatgagtacggcggcatcgccggcatggtgactatcgaggatgccatcgaacagatcgtcggcgagctggaagacgagcacgaccgcacccagcgtactgagccggagaaaatcggagacaacaagtggaagatgcccgcccgtacgccgattgccgatctggaggagatcttcgagatcgacattgatgaggacgatgtcgataccgtgtacggcctgctgaccaagattctgggccgagtgccgattgtcggtgcctcggctgtgacgcgcggtctgcgactgaccgccgtggactccgccggacgccgcaagaaggtgtccaccatcgtcgtagaaccggcgcacgtcgagggcggcgaggaaaataacaagacccatgaggaaactgacggcgagcccgtcgaaggcgatgataccgccagcaaggagtgatatgaccgatcagaacaacagcacgaacgacgtcgatgacattgacgttaccgatgcttccgatgttgccggcgttgccgaagtcgacgcgaccggtgaaacggcgaacgtgaccaagcaggacgtgccgtatcgctccggattcgtggccgtggtcggccgcccgaacgtcggcaaatccacgttgatcaacgcgttgatcggcaagcagatcgccatcgcatcctctcgcccggaaaccacccgtaaggcgatccgcggcatcctgaccgccgaccacgcgcagctcgtgctcgtggacacgcccggtattcaccgtccgcgtacgttgctcggccagcgtctgaacgacgtggtcgacgaatctctggccgatgtggacgtggtggccttcctgctgcccgccgatcaggaaatcggccccggcgacaagcgtattctctcccgactgcgtaccgacttcgccaccaagcgtgaggacggtacgttcaagtggcgcatcccgctgattgccatcgtcaccaagatcgacgagcttggccgtcagcaactcatcaacaagctcatcgaaatcaacgatttcgccgatttctcggacatcgtgccggtgagcgccctgaagcacgacaatctggctgaagtgaagaacgtgctcattgagcacacgcccgagggtccgcagatgtacccggacgatcagatcagcgaggagcgtccggaagacaccatcgccgaactcgtgcgcggtgcgttccttgagaccctggacgacgagctgccgcattcgctggccgtggtggttgattccatcgactatccggaagacaacgagaccggtcagggctatgacggcaaggcgcaggtcaacgtgtccatttacgtggagcgtgactcccagaagccgatcatcatcggcaagggcgcctcgaacctcacctacgtcaagaagaagctgcgcaccccggtcaaccgcatcgtcggccaaaaagccaagctcgacctccacgtcaaggtagccaaaggctggcagtccgaccccaagcagctggagcgcctgggcttctaaggcttatagacgaaaaaagctccctcgtcagagggagcttttgctatacggtttacttccgcttcgtgtacatctgggtgttgaggagggtggagtagcgcttgatgaccttgggacgaatcaccttcatggaagcggtcatcaggccgttttcctgagtgaactcctcgggcaggatgatgaacttgcgcacggactcggcgcgggagacgccctcgttggcctgatcgacccacttctgcacttcggcgcgcacggcggcgttcttggcggcatcctccagcggcatgttctcgtccaggcccttggcggccagccacgggcgcagcgactcctcgtccagcgtcaccaatgcggagatgaacggacgcttatcacccagcaccagcgcctgggagatgaactcgcaacgctgaatgacttcctcgatcgggccgggggagacgttcttaccacctgcagtgataatcagatccttcttacgaccggtgatgtacaggaagccatcgttgtcgatacggcccaagtcgccggtgacataccagccatcttcggtgaacgacagctcagtggcctcgtcgttcttgtgatagcgcgggaacacggcacgacccttgacctgaatttcgccgtcctcggcgatgcgcagggagaatccggggaatgcgatgcccacggaaccagcgtggaacggcgtacccagcgggctgaacgcgcacggtgcggtggtctcggtcagaccatagccctcgtatacaggcacacccgcgccacggaagaaagccagcagttccgggtcaagcggggcaccgccggccacaatccacttggcgcgaccgccgagcacttcgcgcagcgaagagtagacaatcggatcgaaggcagcgcggcgagtgcgggtcagtgcacctgccttgccattggcggagacctccttcatatagttctgcgcggccaccacggcggaggcgaacaccacgcccttggggccgtggccggccttctgggacgcggcgttgtacaccttctccagcacgcgcggcaccacgatcatgagagtgggcttggccacctgcagatcgctgatcagcgtcttgatgccggtggcgatgtagatgcggacgttcgaggagacgacgatgtagttgatggcgcgggcgaaggaatgggcctgcggcaggaacagcaggatggtgttcctcttgtcgtgcagcagatcgggcatgtaggccggcagattcagcgcggtctggcagtagtgctcgtgggtcatctccacgcctttcggcgcggccgtggaaccggaggtgtacacgatggaacacaggtcggtcttcttgaccgaatcgatgcgctcgtccagctcctcgtccgagaccgtggtgccgtaggccttgatctcgtccaagccaccggtctcgatggtgatgatgtgctccagggacgggcactcttcgacggccccatccgccttcttacgcatgtccgtgtcctgcacgatcagcagtcgggcatcggagttgttgacgatattgcgaatctgctcggcggaatcggtgtcgtagatggtggcgagcacgccgccgcacgccatgatcgccgcgtcggtcaggtcccagtcgtaggaagtgcggcacatgaatgccacggcatcgcccttcttcaggccgtaatgaatcaggcccttggccacggcacgcacgtcagccaggaactcgttggcggtgacggtcacccaatcgttgccggacttgtaggtgtacagcggctcatcgcccatacgttcggcgcggtccgcatacaggtcgtagatggacgtaccttcgtccagcggcggattgccttcggtggaggtggtgagcaggccggtggcggggtcgatgtcggtgacggtcaggtggccgtcgtcccaatcgtcgctgtgaggcaaagcgatattggcctcgaccggcacgtcggcgttggacaggtaatcgggctcgtccggggtgtcgtcgtggaccgggtggacgaagtcggatcccaacctgagcgccttacgggtgagattgatcgtgtgctgcgtgaaggaattgataaccgacaagtcttgctcctgtaaacctttcagtgtcgtccagccatgaggcgaacgcttctcaaagttcaaattgtaatcgcccaaaccgaactcgtcaccttacgcaaccgtaggattctggcgggttaggggagtgcgtggcaaaatattgcacaggtcccgatattgttgagtaaccgtgagctacgaaacggtgattgtcgataattattgagcggttggttgctgatcgatgccgggtgattgttggacgacttccgagcaattcatccgcaatgcacatggacacattcgtatttcttactaatttcgggttcgtttctatttcgattggcggaatctcaagtcatggtctttacctttcgactacacttaccatgcggataaccatgtccattttgaagtagaacaagaaagggctctcatggcgcaaaacccagaagccaccgtggtgttcggcgttttgaacgaaacgtccgaaacggaatcccgcgtcgcgctgacgccggatatcgtcacccggctgaagaggagcggtgtctcctcactgattgaagcaggtgccggcattgctgccgactacaccgatgaggattacgaaaaggccggtgcgaaggtgaccagccgtgacgaggtgctcgccgaagccgacgcgctcggttttgtggaccgaccgtccgccgagaccgtggccaagctcaaggccggccagtgggtcattggcatgctcggttccttcaccgatgccgattacgtggccgcgctcgagaaggccggtctggtgggcatcgccatcgaaaagctgccccgtaagctttccagcgcccagtccatggatgagatgacctctcagaactccgtgatgggctacaaggcagccatcaccgccgccgatgcttacggttccttcctgccgatgatgaccaccgccgccggcacgattcgcccggctaaggcgctggtgctcggtgccggcatcgccggcctgcaggccatcggtacgctgaagcgtcttggcgcggtcgtcaccgcgtacgacgtgcgtcccgcctcccagggcgaggtcgagtccctcggcgcgaagttccttgatctgggacttgacttctccaagggccagggcgagggcggttatgcccgcgcgctgagcgccgaagagcaggctcagcagcaggctgccgtcgacgaaaaggccgccggctttgacatcatcatcaccaccgccaaggtcccgggccgtaagcccccggtgctgctcaccgcagccggcgtcaagggtctcaagcgtggtgccgtgatcgtggactgcgcagcatccgacctcggcggcaacgtcgaaggctccgccgttggtgagcaggtcaccgagggcggtgtcaagctgatcggcgctccctacctggcctccggcgtcgccaccaccgcatccaacctgctttcgcgcaacgtggccgacatcctcgtgcacttcgtgcgtgacggcaagctcggccaggatctcaccgaagaactcgacgacgcgctggtggttgccggccgcgccgccgccccggcagctgctgccgatgccgagaagtccgagaagtaaggaagaaggaataccatgcctactctcgtcgtttccattaccctgttcgtcctcgcgctgctcatcggcatcgaggtcatcggcaaggtgcccgccaccctgcacacgccgcttatgtccggcgcgaactccatccacggcatcgtcatcgtcggcgttgtgatcgtggcagccgaagccaatagaccgctggcctacgtgttcatcttcctggccgctgtgctgggcaccatgaacgtcgttggtggctacgtggtcaccgaccgcatgcttgagatgttcaagtccagcaagaacgagaagaagggggagtcgaagtaatgacctccgcaaccgttggcgccatcgacatcgtcgcttggttcgtctacctgttctctgccgtcctgtttgtggtcggtctgcatttcatgaattcgccgaagaccgcccgcaagggtaaccagatctccgcgttcggcatggtcgtggccgtgctcatggcgttcatcgtgctcttcgccaagggcttcgtgaacattgtcgccgtggtggtgctggtcgtcggcatcctgatcggtgccgtggccggtgtcgtctccgccaagaaggtgaagatgaccgatatgccgcagctggtctccgtgttcaataccgtgggtggtggcgccgccgcactcgtggccctgaacgacatcctgaccaaggaaggcaccccggacatcgtggtgctcatcaccgctggtctcggtattctcatcggttctgtgaccttcaccggctcgctcatcgcagccggcaagctgcagggtatcaagtgggtcaagaagctgaacctgccgggcaagggcgtatggaacattctgttcgccgtgctgtctgtcgtctcgctggtcatgctgtgcgtccagcccgaacagcgtctgctgtggtcgattctgaccaccgtgttcgccctgtgctacggcttggtgttcgtgattccgatcggcggcgccgatatgcccgtcgtcatctctgtgctcaacgcatgcaccggtacggctgtggctatgtccggtctggcgattgacaatgtcgccctgatcgtggccggcgcactcgtcggttccgcaggtgtgaccctgtccatcctcatggctcaggccatgaaccgcccgctgctctccgtcttggccggtggcttcggcggtggtgctgacgccgccgctgctggcgatggtccggaaggaaccatgaaggagaccacgccggacgatctggccgttcagctcgtctacgcgcagaaggtcatcttcgtgcccggcttcggtttggctcaggctcaggcccagcgcgagctcgctgacctcggcgaactgctcaagggccacggcgtggaagtctcctacgccattcacccggtcgcaggccgtatgcctggccacatgaacgtgttgctggccgaggccaacgtgccctacgaggagctcgtggatcttgatgagatcaacccgcagttcccgcaggccaacgtggctctggtcgtcggcgccaacgatgtgaccaacccggctgctcgccgtcccggcaccccggtctccggcatgccgattctcgacgtcgacaagtcccagaacgtcgtggtcatgaagcgcggccgcggtatgggctacgccggcatccagaacgagctctacttcgaagacaacacccagatgctgttcggtgacgcgaagaagagtctgcagtccgtcatcgccgccgtcaaggaattgctcgcgtaaccattcttggctcccctctgtgaggggagctgtcgaacggagtgagactgaggggagtagcccatacgcgggtgctcccctcagtcagcttcgctggcggctcccctcacagaggggagccgagctctatatctactacagcccaaacacccgcttaacaaagctgttaacgcgacgccaatagcggtccggatcggtgctggcgctcatcgtgtggtcggcgccgggaatcagcagcttctcgcggtcgatgctggcgcaggcgttgtaattgatgtccagatacttcggattgacaaaagtatccgctccgccatgaatgaacatcatcggaatagtcgcgtgccgtaatgccttcacacaggaggcgtcctcaaaccggtatccagccttgcgttcagacacatgactggccactttgaccagcagcacggccaacgagtgcggcaaacggaacatcgcctcggcattatccgtaaactgcgagaccacggaactgtatccgcaatcggaaatcgcggcgacgacgttgcgggggagtcgcgcatcgccggccgccatcatcaccgtggcggcgcccatcgaattgccatgcaacagaatgcgtgcatccggatcagctgcggtgatcagcgaaacccagcccaacagatcgtcgctttccagcaatcccatacccacgtaacgcccttcgctcaactcatgggcgcgctgcgcgggtagcaggaccgtaaaaccgagttgcgcatagcgatgcgcccatttggccatttccgcgggctctccggcatagccatggcagcagatcgcgtatagatgcggctgtgggtcggaacaatccgggtccaacagccagccgtggagtttcaatccatcatggctgcgcagcgtgaccgattgcttggcctcctcgaaccaccgggcggcctcaagctgctcggacatgtcgaattcgatgcctttcggtgtctcctcgtgcggcatgttgaacatcgaacgtttggccttggtgtccagcgcgaacgtgaacatgacgttggcggccgcggctgtgacgccggctcctgtggcggctatcgcggcaagtgccgcagccatacccctgacaacgcgagtgtgtgcggcgatgacgtcatggccatcctcattgatgacgtcgtccgaacgagtcatatcaacctcccgatacggtactcaccatcgtacgttattttcgaaatcatccccaacttcgtgaaagaccgtacactgagtgtcgctgagcgtacgattttcacgaaatggcggacgatttcgtgaaaaccgtacgttgagaacgggtaagcgtacgttcttcacaaagttagggattatttcgcggaaaccgtacgttgacgtggctgggacggccgggatgcagtgtcatcgaagcatcaccgcgccaaagtccggagttggcgtatacttgacaattgttgctttggcgagggaagtgtgcgtgctgacacatgacacagcttccgttatcgactcggtgtatttcactccttgtagggtgtctttcggcgtgtcgtggcgtctgagcgagacagaacgaaacgaaactacaaggagtatccattatggctaccaccattaagcttgagggcgaggcccgttccgagttcggcaagggcgttgctcgtcgtctgcgcgttgccaacaagattccggccaccatctacgccggcggcgaagagcccgccttcgtgaccttgccgatgcgcgagaccaccctggccctgcgtcacaccaacgccctgttcaccatcgccttcgacggcaacaccaagatggccgtcgtcaaggacgtgcagaagaacccggtcaagcgcatcatcgagcacgttgacttccttgaggtcaaggccggtgagaagatcgacgtcgaggtgccggtcttcgttgaaggcaccccgaagggcgctgctgtggcattcgtcgacattcaggagctcaaggttcgcgctgacgtcgccaacctgcctgagaagatcgttgtgagcgtcgagggcctaaccgacggcaccaaggtgttcgctaaggacgttgttctgcctgaaggcgttgagctcgacgttgaggacccggaagagtccgtcgtcaccgttgaggtgccggaagatgcttctgagtccaccgccgctccggaagctgctgctccggctgccgacgctgctgctccggctgccgacgccaagtgagtcgatcgcttcgatagcgaacaattcagaacataactgaaacgtggaagcccgcagccgttgagaacggtgcgggcttcttcgttttttcaccatgtgaactctgccacacgagtaacacatgggtgtgcaaaagtatgcaacagagctcgcgccacaagcgcacagcacacaccccatatggtggctttcgggccgccaaagtcaagaagaagtagctagtaatgactgaaaacacgcaccacgatccggcagcgctcgacaagctcgccgaaccgttcaccgtactgccgaacgacaaccccgcatccgatgagaagcgccagtccctcatcgacaagccggctttcggccaggtgttctccgacaacatgacccacatgacctggaccaagggcgaaggttggtccgaccgccgcgtcgaaccgtacgcaccgctcaagatggatccgggtgcttccgtgctgcactacgcacaggagtgcttcgagggcctcaaggcttaccgtcatgccgacggctccacctggctgttccgcccggatgcgaacgccgagcgtttccagaactccgccaagcgtctgtacctgcctgagctgccgattgacgacttcctcggttccgtggccgcgctggtcaagcgcgacgccaactgggtgccgtcccgccgcgagtacacgctgtacatgcgtccgttcatgttcgcttccgagccgttcctcggcgtgcgcgccccgcaggaagtcgactactgcgtgatcgcctccccgtccggcccgtacttcccgggcggcgtcaagccggtgagcatctgggttgaagacaagtggttccgcaccggccctggcggcactggtttcgccaagtgcggcggcaactacgccgcctccctgctcggcgagtacaagggggttgagaacggctgcgagcaggtgtgcttcgtggacgccgccaccaagacctacctcgaagagctcggtggcatgaacatgatggccgtgcacaaggatggccacgtggagaccccgtccctgaccggtaacattctgccgggtgtgacccgtcgctccctgattcagctgctgcaggacaagggccacgacgtagtcgagaccatgattgccctcgaccagctgctcgaggacatcaagtccggtgaggtcaccgaggtgttcgcttgcggcaccgcagccatcatcaccccgatcggtcgcttcaagtccgagaagttcgatgtcgccgtcgccgacggcggctccggcaagctcacctgcgaactgcgtgacgagctgctcggcatccagctcggcgaagtcgaggacccgcacaactggatgtggaaagtgtgctgaatcgccttttgtttctgactaagaccccttggaacagcaacaattccaaggggtcttggcgtattggaaatgttcttggctagagagatacagatggatttagcaacattccgcaacaaataatatgatctaggtcttctgcacgttgcgggggtggttatggttcatccagatgagaacaggagcaaacctatgagcaagatgagtgacatgacggaataccatgcttcagcctaccgtttgccgtcaggcttcgaacactgctcgaaattgaagccggtggctgaggcagcgacggcgctggaccgggtcaaggccgtggtggatgtgctgtattcgccgggcggctgcccgtgggacggcaagcagacgaacaagtcgctgctcaagaatctgctcgaggaaacctacgaatacgtcgacgcggtggagactcacgaccgtgacaacatgcgcgaggaactgggtgatgtgttgctgcaatccgtgtttcaggcgcgggtctgcgaatcggatactgaggacccgttcggtattgatgaggtcgccgatcggttggtgaacaagctcatcactcggcatccgcatgtgtttgcggctgatgatgccggcaattcctctgattcttctgatgcttttgatgctgacagtaacgacgggggagaagctgcccaacccgaatccccggaagctgtgctggctctatgggaaaagatgaaacagcaggaaaagcatcgtaaatccgtgcttgagggcatttcccgcgttcaaggtgcgttgcctcgcgcggccaaagtcgtttctcgtatctccaaatcgccgaatgctgatagattgttcgcggcgtttgatgagtcggctgcggctgatgctcagcgagatgatgtacatcctcaagcggcgaaccaatccgaatcaagcggcgacaattccgctgaacgggagaaggccgatgcctacgccgatgaaatcctcgccgtcgtgcgcaaggcccgcgttgacggcatcgatatcgagtccgcactgcgcaatcgcttgcgtgatgtcgaagaaaaagtcgccttgattgaatcagaaatcaacaacgattaagtccatacatgttttttgatcacggatcgtaaaacttagaggtgctgagttgccaacgactaccggcaagctggcgtcattgccatcctattcacgtcttagtggccccttcctccccggccatactactcaggcaaggcctgttgtaggctcgggtacgacgggctgtagcgccgaataaggatgaacgggaacagaacgaagacggactgagacgaaccgaagcggtaccagaggggagtggctcatgcaggtggcgttggagaacaacatcgtttttgtggtcatcgagtatttagcaatcctgtgttggggattatcgggcggacttgccgccattcgcaagggctacgacatcttcaccatcatgctgtgcggatggcttaccgcactcggcggcggtcttgtgcgcgacgtgatgctcggtgccctgccgccggtcggcatcaccgacaaaggctatgtgctcaccacgctgttttccggcattatcgtggtggtggcccatccggagatcaccaaactcaaatggacgatgactgtcatcgatgctctgggcctcggactattcgcagtcagcggcaccgcaaaagctctggcctacggttcctcaggcatgacagccgtattccttggcatgttcacagcactggccggcggcctcattcgtgacatcttcattggcgacgtgccaatgattattcgagacaaacacctctatgctgtgccttcgttcatcggctgcatcctgaccgtgctggtatggcgcggcgtaagctacggctggttcgacatgcgctcggaaatgctgctcgacgtgctgatcgtcatcatcgtggtggcgctgcgactgctctcggtaggcttcaacgtcactctgcccggagccgtcgaacgtcatcgcgtctacctgcccagcgaaagccgatatctcaagcgcccggtcatccatccgcacgccgataccgtcgatcccggcgataccaccaaggacgaagaagacaagcctcaggatggttcaaggccgcctcagggctaactgtcttcaaagaggtacatctggccttctgcagaatgctaactgctttcaaagaggtacctgaagcacgaaacgttgagtataagtgttgcaatgatggcgtttatagttggtttttcccgtattcggtacctctctgaacggagatgtcatttcgcaagaccgccaatgtacctctttgaacggagatacaaaaagtcccgcaagccagatgacttgcgggactttctaaaaccttaagaggcttatgctcacagagcgttgatcgcaacagcgaggccggacttgcggttggcggcctggttcttgtggatcacgccagcgccagcagccttgtcgagcttctgggcggcaaccttgtaggcggcctcggcggcagccttgtcaccggcggcgatggcttcgcgggtggcgcggatggcggtcttcaggccggacttcacagccacgttgcgaaggtgcgccttctcattggtgagcacgcgcttcttctgcgacttaatgtttgccacgtttactccaaacgatgtgtgttataaggacatacaaaagttagaggatagcatgagccccggaaaaacccgcgcaatgccacgccgaatacagtccctcggctacactaggtgaagtttgagtatatgccaagaggaggaatgcgttggtcgtccaacacaatcagccgggttccacggatcagtcggtgattcgcaacttctgtatcatcgcgcacatcgaccacggcaagtcgaccgtggccgaccgcatcttgcagttgagcggcattgtgcccgagcgagagatgcgcgatcgcttcctcgaccgtatggatatcgagcaggagcgtggcatcaccatcaaatcccaggccgtgcgcgtgccgtggacctttgacggcaccgaatacacgctcggtatgatcgacacccccggccacgtggacttcacctatgaggtgtcccgcgcactggccgcctgcgaaggcgcggtgctgctcgtcgacgccacccagggcatcgaggcgcagaccctgtccaatctgtatatggccatcgaccatgatctggccatcatccccgtgctcaacaaaatcgacctgccgtccgccgagccggacaagcatgccgaggagatcgcaggtctgatcggctgcgagccgagcgacgtgctgcgcgtctccggcaaaaccggcgaaggcgtggccgacctgctcgaccagatcgtcatggacgtgcccgccccgcacggcgaccccgatgcccccgcccgcgcgctgatcttcgattccgtctacgactcctaccgcggcatcgtcacctacatccgtatggaggacggcgaactgcacgaccgcgaaaaggtccacatgatgggcattggcatgacccacgatcccattgaaatcggcgtgatcagccccgatatgacccgcaccaaggcactcggtgccggcgaggtcggctacatcatcaccggtgcgaaagatgtgagtcagtccaaggtgggcgacaccctgacttcggccgtccgcccggccgccgagccgttgcccggctatcgcgacccgaagccgatggtctacgccggtttgttcccgatcgacaacgcccagttccccgaactgcgtgatgcactcgacaagctcaagctcaacgacgccgccctgatctacacgccggaaacctccgtggccctaggcttcggcttccgctgcggcttcctgggtctgctgcacatggaaatcgtcaacgagcgactctcccgcgagttcggcctcgacctgatccagaccgccccgaacgtcacctacgacgtgaccgccgaggacggcagccagcatcatgtgaccaacccgagcgaattcccggacggcaagatcaagaagattgtcgagccgatggttgccgccgacatcatcacgcccaaggaattcatcggtgcggtgatggatctgtgccaggaccaccgtggcattatgggcacgatggagtacatctccaccgatcgtgtcgagatgcactaccgcattccgctggcggaaatcgtgttcgacttcttcgaccagctcaagtcccgcaccaagggctacgcttcccttgattaccatgaggatggcgagcagtccgccgatttggtcaaggtggacatccttattcagggcgagaaggtcgatgcgttcagtgccatcgttcaccgcgataaggcgtattcgtacggtgtgatgatgaccaagaaactgcgtagtctgattccgcgtcagcagttcgagattccgattcaggctgcgattggttcgcgcatcatcgcacgtgagaacattcgtgcgttacgcaaggacgtgctcgccaagtgctacggcggcgacatcacccgtaagcgcaagttgctcgaaaagcagaaggctggcaagaagcgcatgaagatgctcggccatgtggaggtgccgcaggaggcgttcatcgcagccctgtccaccggcgaggactccaacgaccgcgacaccaaagacaagatccgcgccgctcagaagaccgagggctagtgttcgaggtctacatccacgtcccgttctgcttgcggcgctgcggttactgcgacttcaacacctacacggctacggatcttggtgcgggggcctcgcgcggcaactatgccaatatggtcattcgggaaatgaaattgaccaagcagtggcagctcgaccacggcatcgaggagccgccggtttccaccgtgttcttcggcggcggcacccccacaattctcgccgcccgcgatctggtcgccatgctcgatgccgtccgcaagatctggagcatcgcgcccgacgcggaaatcactaccgaagccaatccggacacggtcaacgagtattacatcaatgagctcgctgccggcggcttcacccgtgtttccttcggcatgcaatctgccgtgccgcacgtgctcaaaaccctcgaccgcacgcatacgccggccaacgtggccgtaggcgtcaatgcggcgaacaaggctgggctgcgctccagcgtggatctgatttacggcgctccgggggagagccttgacgattggcgcacctcggtcacgaccgccatcgatcttggcgtaaaccacatctccgcctacgcattgaccgtggaacccaccacgaaaatgggccgtcaaatcgcggccggcactctgcccaagcccaatgacgatgacgaggccgctaaatacgagatcgctgacgacctgttcgccgccgccggcctcgaatggtatgaggtctccaactgggctcgccccggatacgaaagccagcacaacctcggctactggcgcaacgttgattgggccggtctagggccaggtgcccactcccactacaacgcggtgaccgaggctgaccacccccagtcggcttcgctgacagcccccgctggcgggagcaagtccgaagccattgcctctgcctcagctgatggacaggccaacgccgaactaggtatgatcaacgcgcatgggaacaactcccaagaaattcatgcccccgctggcgggggttgtccggcggatgccggactggggtggtttctgtctcacacggtctgcgcagctgggacatcgcgcacccgcgtttgtggggcacggccatcaacgagaaccgtgtgccgtgggccgatagcgagacgatcactcccgaggaaaacctcgaagagctcatcatgctcgggctgcgcctgcacgagggccttgacctcgaccgcatcaaccgcgccatcaacgatgcgggtatgagcagcacgccccagactctccgtaatgtttcccttgaccaactcgccccaatggtcagcgaaggcctgattaccgtatccgataatcatcgagtggtgcccactcgtcgtggccggttgctcaatgactcggtaatcgaacagttcttcgatttcgtcggtgtatgagtcggtggtatggtgcgcggcagtcgccattacctgttcgctagttgtggttacaccgtcagagggagctatttttgttttaccggcgggggagggaaccgcgtaggactacgtccggggcgctttgcacgtagatcaggcggttggcagtgccgccggtggcctccccgtcatcgcggttggacaggatgctgtccacggcggcctggcccatttcggccagcggcagatgcacggtggtcagtggcggaaacacgtcggcggagtaggggatgtcgccgaaaccggtgacgccgatttcccgacccggctcgatgccgttggcgcgcaacgcggtcatcgcaccgatggccatcacgtcgttgagcgcgatgattgaatcgatgcctttgccgtcgtacagtgcgccttcgcccggcttcagcagtccggatcgggccatttgcatgacggccgcatagccgtcggtacggctgaacttaccattcgccacggctttcggatccacggtgatgcctgcctcgtccaacacttccatcacgccggccagtcgttctttggaggagcgatgtgcgtcatcgcccttgagaatcgcagggcgcgtatacccggaatcgacgatcagctttgcgatggcgcgcgcgccgacatcgttcgccatgtccacggccgggaagggcaggttgcggttgagcacgaacacggcacgtccgccggatgcttcgtactgggtgagttccgtctgcaacgcctggcgttccggcgcgtcggtgtattcactttcggagatgatgatgccgcgcggcctggtggatacggacttacgcaccgcctccaactcttcgtgcggggtggctgccacgccgatggtcacggaaatgccgcgttcggccgccgccttgaccacgccttgagatacggatgcgaagtagggatcggagatatcggagaccagcagcacgatgttcggtgcggtgcctttggccactgcctgagcataggcgttgggacgatagttgagcttggtggctgcttccatcaccttgacatacgattggttgcgtaccttgcgggtgctgccgttgagcacgcgggatgcggtggcgatggagacttgggcttctttggcgacatccatcaatgtcgctggcgattgcgccttatcgttctgtacagccacgatcgaatcgatccttttcttccctgaaacggaaaacgtgtctaaacgtttaccgcaacgatatcgcatttttgcttgcaatagtagcattgtggattggaaagcctgaattctgaacaaaaaaataatcacgcgaattacggaaaacgtttaccgtttcgtcgtgtcgtgcggtatgctcgaagcatgacgcgatacttatgcgcccctgactccttcaaagagagcctgaccgccatggaggcggcccgggcgatggctcaggggattgagaatgccgaccacgatgccgaggtccgttgccttcccatggccgacggcggtgaaggcaccgcacgcgcgcttgtcgacgccaccggcggatcgatgcgcgccgtgccggtccacgacccgctcggccggcctgtcgaaggccacttcggtctgctcgccgacggcacgaccgccgtggtcgagacagccgaagccagcggactggcactgcttgaagccaaagaacgcaacccgttgatcgcctcctcctacggcaccggcgaactcatgctcgccgccgtccgttccggagccaagcgcatcatcgtcgggctcggcggcagcgccaccaacgacgccggtgccggacttctgcaggccctcggcgttcgtcttctggacaagaacggtaacgacttggcacacgggggagcggccctcgccaatctgaccaccatcgatatcagcacgatggacccggctctcaagaacgtcgccatcaccgccgcctgcgacgtgaccaacccgctgaccggccccaccggcgccagcgccgtgttcggcccgcagaaaggtgcgtccaaagatgatgtcgccacattggacgccgccctcgcgcattttgcgcaggtaatcgacagccagctcggcgttgccgtgaacgacgtgccgggtgccggcgcggccggtggcatcggtgcagcgctgaagggcttcctaaacgccgaattccgcccgggcatcgccatcgtcatcgaacaatccggactcgatgcggccgcgcaatgggctgacgtggtgttcaccggcgaaggctccatcgacttccagaccaagttcggcaagacgccggccggcgtggccgaaaccgccaagcgccacggcaagccggtcatcgcagtagccgggcatattggcaccggcatcgatgagctgcatgaggtcggcatcgacgcggtattcggcatcgcgcccggagccgccagcctcagcgaactgctggccgacgcggccgccaacgtgacccgcaccaccgaacaaatcgtacgaaccctacaactgtgagcaggctcccgctggcgggggctggcgggcttcgcccgactgggggggcagcgctgagaaccaccctcagtctcgctatgcgagacagctcccgcagcgggagcgagtaccggaaaggaagacgtgcgcgccacactggaaaccgtgagctgcggcgaactgaccgccgtgtatcgcaaagatagcgacaccggcatcgtggaactggtatcatggatcgtcgacgcgagctcggtcttgtgacatgattggtggtgatggaatcaacgatgagtccaacaaaacggcaccgcctcccattgcgcaatatcgcgcgcaatattacgcagcgtattggctctccgaatgcgtgtctgctaaacctcgtgttgctctatcagcgagctttccgactgcgcagctcaggcaacatcacgacgaacaggatgaccgccacaatcgcggtcagcagatcggcgatggcctgcgcggcgattacaccctgatagccggccagccgggagccgacgaacagggtaatcgccagcatcacaccctgcctgctgatcgacagcacaaaggcgccgaccgccttgcctgcggactggaaggtgcaggtcgtgaccatcacgacggctacgcacaccaggctcagcagctgaacccgcagcatgccggcgcccagcgtgatgatggtggcgtcctcgatgaagaatcccatcagtagacggtcggacaggctgagcaccacggtcatcaccagggcgaacagggacaggaacaggtaggaaaaacgcagaatgccgcgcagtcgaggcatattgcgggcgccgtagttgtagccgatcagcggctgcgcgccgaacgcgaatcccacgaaaaccagcaccgcgatcatgatgactttcagcgcgatgcccatcgcggctaccgcgtcggtaccgtaggggagcaggaacaggttgatcatgacgatgccgacgctctgcgtgaggttcgtgatcgccgaggggatgccgatggcgaggatgctcccgacctcccgggccgtgaccgccagacgccggcgcgcgcggtcgatgacggtccgcgggtcgatggacaggttgctgctgtgacgcagcgtgaaccagacgaaataggcgtcggtgcagatgttggcgatcacggtggcaccggccgaacccgcagcaccccagccgaatccgtggatgaacaggggattgagcacgatgttgaccgccgtgccggccaccgaaccgatcatggactgcacggcgtggccttcggtgcgcagcaggttggacggcgtcatcgacacgatgatgaacggcgagccgacgatgatcagcgtgtagaagtcggaggcatactgccaagtgtcgtcagtggcgccgagcagcgcgagcatcgggtcgcggaacgccaggcccagcaccagaatcagcaggccggtggcgatggcggcatagaagcagaacgcgctgagtcgcttgccgtcggcgaaccggtgttggccgaacaagcgcgagatgaccgaactgccgccgaggccgaagatgtcgccgagggcgatcatcacggtgaacactggcgcggtgagggagacgcccgccaccatatcggtgtttcccgtatgcgcgatgaaataggtgtcgaccatgttgtacaccaaggtgaccagcatgctgagcaccacgggcatcgccagcgagaaatacgccttcggaatcggcgccttttcgaagagttcgttatccatttccgtcccttggtgtttcgttcttcagtcactgtgcaggatgccgttcggcgtgcatcacaggcattgtagaggcaacagtgtggacaacggacggggagtatctcatgatgcggtgagggcgttgatgatgacgcatcgtgtattggcggccgtgtgcatcgtatgtgaacctgtgctggcgcggcgtacgcacgatgggaaaagaaagaatatatggaccccgttgtcccggttattgttcagttttactgtgttgaattattgcgttattcaattattgtggtgtgccggccgattgcggcctgcgggggattgccttcgtatgtgtcgtgcaatctcatgaacgggattgttcgctagattcagcgagcgtccttgttggcggcgttgatgatgtcggcgaacatcttggagtcggcgtagccggcgcgggcgatggcatccataccggagagggcgagaccgcgaatcatggaatccttgagagacataatcattacctttcgtttgcgcatcgccgtgagcggctttgcgattgttgtttaagctttgttgttatggggtccgtggctaatctgattggattgccggaccggagccgatggctcagcgagcgttcttgttggcttcgttgatcaggtcgacgagcgtgctgctgttggcgcgaccgcactggctcatggagctcaggccgtacacagccagaccgcgaatcatggaatccttgagagacatcatgtttcctttcgttggtcaaaaccttggggctttgagttttgtttatcggcttctttctgaaaccggtttcagaataacgcagtccgatgacaaacgcaaggggactattccgctctcggcgtttctggcggaatatcgccgttctttagataccattcggtagttaagaggttgtctagtcgaccttctgacggccttgttctgagcgtacggttttcacgaggtatggcctcatgtcgcggaaatcgtacgctgagtcgtcgtaagcgtacggttttcacgaaatggggcctatcttcaccggattttgggcacaccggccttgagcagcttggtctcaagattgatggggcgtagcagatcctcatagaacacatggacgatttcggtgacgccctgttcccggagatgccgatcacgtctgcggtcgtactccattttcgcctggaggcttgcgcgattcttgttgctgatgtcggcgtatttggccatgccgtcgtattctgccacgatgatgcggccgtctgcgagcttccaacagaaatcgacgcgatatgacattgcgggattgtcgggattcatgaactgcacctgcagcagggggatgccgaaagacaattcggtgatctggccacgcatcaatgattcgccgccgttttcgctcaggggatccgcgtacttcagcagcttggtcacggagacctcgtcgcagacgctttgaatcatcagcgactgcacctcttcgatggtcgtcagggactttctcagagccgaatcgtatatgggcagcgcctgtgggaatgggaatgccgcgcagtcgagcagcgttcgcgccggagtcgtcaagagaatgccgttatgcttccgcgtcggaatccgattgatatagatgcggttgagacgcgcctcgtctccgccgccgatgccggacttcgaggcgatgtgcactgtgccgtcgtgcagggaatagttgtgctgcagtccgtatacgcacgccgcactcaaccccgcaaatacccactgagggtggattgcggacaacgcacgtatgacctgcaatgactgttgctctctggtcatggtgttccaaagtgttcggtcggcgtacaggttcttatacggtgacaccagctccccggcatgcaggcgacgtttcagggcgcgccgttgcgcatcactggtgccatagcagcagcgacgctcctgcttcgcctgctgcagcagtgcagaaacttccttgtgttctttcatatctcgacgctaagggtgattttgatcgttgcacaagctcaaccggcaaatgtggatactatgtcacgcgaattgttgctgtggataacttgaatcgacgtcgacggctttgccgacggtcttgtcggaggcgatattagcctaggacaccttgctgcgccgccttccataccgaaaacagtcatcagtgacaccgggggcatcttcagcgtacgttcttcacgaaatcagctgccatttcgtgaaaaccgtacgctcagaatgactcagtgtacgttcttcacgagatgaggccccatttcgtgaaaaccgtacgttgacgacgattcagtgtacgttcttcacgaaattagggatgatttcgcggaaaccgtacactcaccgcaactcagcgtacggttttcacgaagttatcgatttgggtataggttcccccgtcatgaactacaatgaatcgcggcgaaaaacggagaaccgaagtcggagcgcggctgaacggatatgggtgtgactggatggctgtcatagtgatgccggttctctaacatacgcaataacaacaactgacaacaacaggggagacaaggatggcgagaagtgcgggccgcacccggccggtgatcaaggacgtggccaaactggccggagtctcggcaccgaccgtctcccggtatctcaacggcaccgtcaacgtcaccgaagacaagcgtgaacgcatcgccaaggccatcaaggagctgggctacgagccgagcattgtggcgcgcgctctgtcgaaccgggagatggactccgtggtggtgttcgcggccaatccttccgccttctccacgtccgaaacgaaccatggggtggaggccgccgcccgtaaacgtcggttcctgctcaatattgtttctttggacgagtccgacatggactccgtcaaggctcgcgtgcgcatgggtttgtcgatcaggccggcgggcgtgatcgtctacgagtacgaccgggccggcatcgccgcactggaatacattcccaaagatatgccgatggtcgtggtgggtggcagcctcggcgacggtgaataccaggtcatcaacgccgaaagggatggcggccgttggatgaccatgcatctgctggatctcggccatcgcaccgtgttccatgtggggcgtccggaaggtccgaccgataacacccgcaccaatgggtggcgtgacgcgctcaaggagcgcggcgtcacggcacctgacccaatcatcgtgcccgacgatgatttggaggagtcggtcaaggctggacgcaccttgggccgtcgtggtgatgtgactgcgattttcgccggcaacgacgagactgccatcgctgtgatccggggtctaagggaggttggtcgccgcgtgcctgctgacgtgagcgtcgtaggctttgacgaccgcaacttcggtgccatgtggaatccggcgctgaccagttacacccagaacttcctggacatgggggagcggtccttccgaatgctgttcgaacagatccaggccaagcgcgccggcgatgacgcgccgccctcgcaggtcgaggtggtgcaaggcaagccgtgtctgcgagcctccgaacgcgcgtacggcgacggtgaaatcgcgtagtcgatggggcgtgcgtatcaatcatagtgactgtagcgcatccatatcgtggtgaggagtctctcatgccgaactgtaagcgcttaccttaagtagtttgtaatatggtttacgtcatactaatagatattctaaatcatagtgttttgcaagggcttttgcggaaaatggctatttatcaacagttttcgaaaagtccgcatgacgggcgactgtgagcacgctttatggtaaccgctttctgtagcattatcgttagagtatgacttttgaacaatcggcaactctgaagactcagccccagacctcgggcactatctcagcggcagacgccgtgatgcaatcggcccgcgacgaacgcatccccggcaaactcatctgtacgatcatggccgtggtcattgttatcgtgttcgtcgccatgctccacgccctacgtaaccggaagtaggttgtaggcgggattggtctgactggtatccgccacagccgggttcggtagagcggctaccaatcggccagtgtctctatggcatcgaatcctgttctgcgatgttgttcgtcaaggttgttccagtaaggtgattcatcggtgagcatgtcgtacgggagcttgatacgtctgcgatccgtgtggctatgtagtcgccgagtttcggcatcagggtcggtgatgagggatgcgagcattgcggcatcgtacagatgtctatctccatatccggcatggtctgcttggtatgcggcgctcttaagaatcaacgcgccaagcagatccgcgtcggtagcgggacgcacgtcgagaccgcccatgatggcgtgcaactgcaccatgagaccgccggtgagcagtcatgattcggcaatgcgctcggccaccatgtatacgatattccacggatgagcgccgctggggattgcaatgcgggaaatcattgctcatttccttgttgtatgccgtgatgagttctgtaagggtttcgagcccctgcgcgtcgttctctcgggtcgttggattcggccagatcagcggcgcatacgccgatgggcatgggcccctgcccggcgggcagaaaatcagcgagatgccgtgattcggcgggaggacctgtactggcccagcccttctgttcggtagtggtaccgctacaccgactctccccgacactccagtgccgccgatatcagtgaatgcccagcctgatgtcggtagagtaaaggctattggcttggtctcgacggcgagacttctccaatggccaatatgcactgttgcaaaggagcatgcggtatgcaaccaatcaaagccattcaatacggctgcggcaaaatggcgaagtacacgattcgctatatgcacgagaaaggcattcaaatcgtcggtgccatcgacgtgaacccggaagtcgtgggcatggatgccggtgtgtttgcaggcatcggccccatcaatgtgccgattcgcgccgatgccgaggctgtactcaacgagtgcgacgcggatatcgcggtagtcacgctattcagcttcgagaacgaaatcgccaccatgtgcgagcagtgcttggcccgcggcatcagcgtgatcaccacctgcgaggaatgcatctacccgtggaccaccgatccggccaccacgaaccgtctcgacatcatcgccaaggaagccggtgccaccatggtcggctccggcatgcaggacatctactgggtgaacatggtctccaccgtcgccgccggatgccacagcatcaagaagatcaccggtgcggtgagctacaacgtcgaggaatacggcctggctttggccaaagcgcacggttgcggtctgaccgccgaggagttcgaggccgagcttgcgcatcccgaaaccgtggtgccctcgtatgtatggaattccaatgaagcgctggcccagaagcttgggcttaccatcgcatcgcagacccaggccagtgtgccgtatttcagcgatgtcgacgtgtattccgaaacgatgggcgagatgattccggtcggcaaatgcatcggcatgtccgccgtggtaaccaccgaaactaatcagggcatcacgttggaaactgcctgtatcggcaaggtgtacgggccggatgatggcgatatgtgcgattggaagatcgagggtgaaccggacgtggagttccacgtggtcaagccggcgaccgtcgaacatacgtgcgccacaatcgtcaaccgcattccggacgtgctcaacgcgccagccggatatgtgacggtcgatcagctcgatgagatttcgtatcttacgtatcccgccgcgctgtacgtggcatagccttcatattttcaaggatgaaggccggcactcataagggtgccggccggtatcaggcggccagagtcgacgtgcgtggcatcacctggaactggatatggtcatgggtgatgtcatcgggccgttcatgccgtaggttcgactcgttcagcgtcaccatgcgatcgataaccgtacgagccattgcggggacgtccatcgccacagtgctgatgggtgggttggtgcaggcggagaaggggataccgtcgaatcccatgagccgtacgtcgtcgggcgcgtggatgccatgttcggtgagttcgcggagcgcgccgatcgctatggtgtcagacatgcacagttctcatgttcccgctggcgggagctgtcatgcgaagcatgactgagggtggtccacagccgccaatccgtaacatcacccaacgcagcatttcacgatacggacgtttccgtatcgtattttcgtgtggtcaaatagacatttcgagcgaaaaagttcgaaataccccataactggccataaaaaaattgcttgagaatcactattgacttttatggcgactcggtatatggacacatgaaacgtaaatgacatggagcgacggtactgtgtcaacagcaatgaacgaagaggcatgattttcttacgtgcccacaaccaattgaggtgatttcggtgacattcaaagccccgctcgatctcacggtccacgctccggacggtatgtatgatcccgccaacgagcatgacgcctgtggtgtgggtatggtcaccactttgaacaagcgtcctgagcgcaagatcgtcaccgacgccattgaggtgctggtcaaccttgatcaccgtggtgccgtgggtgccgaggagaacacaggtgacggcgccggcattctgatgagcatgccggatgagttcatgcgtgccaccgtgcccgccgaactgccggaagccggtcactatgcggcaggcatcgccttccttgaccgcgacatcgaaacctccggtcagcaggaacaggccattgccaagatcgtgcgcgaggagggactcgaagtcctcgcatggcgcgtggtgcccaccaacccggacggccttggcctgcaggcccttgccgccatgccaggattcaagactctcgtggtcgcctctccggacggtgctctggccggcgtggacttggatcgcaagaccttccgcatccgcaagcgcgtcgagcatgaggtgggcgtctacttcgcatccctgtccgcccgtaccatcacgtacaagggcatgctcaccaccatgcagctcacccacttcttcgaggatctgaacgacgagcgcatgaaggccaccatcgccatcgtccactcccgcttctccaccaacaccttcccgagctggccgctggcccagccgttccgtctgctggcccacaatggcgagatcaacaccatccagggcaaccgcaactggctctccgcccgtgaaggccgcctgagcagcgaactgctcggtgaattcgagccgctgctgccgatcaccaccccgggctactccgattccggcaccttcgacgagtgcctcgaactgctgcacctcgccggccgctccctgccgcacgccatctgcatgatgctgccgccggcttgggagaagaacccggatctcgatccggacgtgcgcgccttctacgagtacaacaacacgcttatcgagccgtgggatggcccggccgacatcgtcttcaccgacggcacccaggtcggcgccctgctcgaccgcaacggcttccgtcccggccgctggcagctcaccgatgacggctacatcgttctggcctccgaggccggcgttctgccggagatcgcgcaggaacacatcgtgtccaagggccgtcttgagcccggcgagatgttcctggtcgacaccgccgaaggccgcatcattcccgatgaagaggtcaagaggaacctcgctgcccagcacccgtaccgcaagtgggtggaaggcaactccgttgaaatgagcgacctgccccgccgcgagcacgtcagccactccggccagtccgtccagcgccgtcagcgcgccttcggctacaccgaagaggatctgaagctcctgctcacgccgatggccaacaccggcaaggaaccgctcggttccatgggtaacgatgcgcctatgcctgcgctttccagccgcagccgcatgctgttcgactacttcacccagaagttcgcgcaggtcaccaacccgccgctggactgggagcgtgaggagatcgtcacctcgctcgaatccgccatcggccccgagccgaacctgctggccgattccgagctgcacgccaagaagatcctcatcccgctgcccgtggtcaactctgatgagatggcccagctcaagcgccttgacaaggcccgcatcctcggcggctactaccgcccgtacgtggtcaagggcctctaccaggtcgccggcggcggcaaggccctcgaagagcgacttgacgagatcttcgccgaaatcgacgaggccatcgccaacggcaagaacttcatcgtgctctccgaccgtgagtccaaccatacgtggggtccgatcccgtccctgctgctgacttccgccgtgcagcaccacctgctgcgccgccacacccgtacacagatttccatggccgtcgaggccggtgacgtgcgcgagattcaccatgtcgcgctcctcatcgcctatggcgccgcctgcgtgaacccgtacttggcattcgaatccgtggaagatctggcccgtaacggctacctcaaggtcgacgcggacaccgctgtgaagaacctcaccaaggccctctccaccggcgtgctcaagatcatgtccaagatgggcgtctccaccatcatgagctaccgtggcgcgcagctgttcgaggctgtgggcctgagccaagaagtcatcgacgaatacttcaccggcaccacctcccgtgtgggcggcgtgggccttgaagaaatcgccgaagaagtggccatccgccaccgcgtggcctacccgaaccagtggagcgcgtccccgcaccgcaacctgcgcaccggcggcgactacaagtggcgtcgcaccggcgaggaccacctcaacgatcccgaggccatcttcctgcttcagcagtccacccagcgtggcgactaccagatgttcaagaagtattcgcaccacatcaacgacacgtcgaaccgactcatgaccctgcgtggcctgatgaagttcaacaccaaccgcaagcccatcgacatcgccgaagtcgagccggcctccgagatcgtcaagcgcttctccaccggtgccatgagctacggctccatctcgcaggaagcacacgagacgctcgccatcgccatgaactcgattggcgcacgctccaactccggtgagggcggcgaatccgacgaccgtatcaatgatccgcagcgctacagccgcatcaagcagatcgcgtccgcccgcttcggcgtgacctccgattacctcgtgcacgccaccgacctgcagatcaagctcgcccagggggccaagcctggtgagggtggccatttgcccggtgccaaggtcccgccgtggatcgccaaggtccgtcacgccaccccgggcgtggagcttatctccccgccgccgcaccacgacatctactccatcgaggatctgaagcagctgatcaacgatgcgaagatggccaacccgaaggcacgtatccacgtcaagctcgtttccgagttcggcgtcggcaccatcgccgcaggtgtggccaagtgccatgccgacgtggtgcttatctccggctatgacggcggtacgggtgcagccccgctcaacgccatcaagcacgccggcaccccgtgggagatcggcctgtccgaaacccagcagacgctgatcctgaacggcctgcgctcccgcatcgtcgtccagtgcgacggcgagctcaagaccggtcgtgacgtggtcatcgccgctctgcttggtgccgaggaattcggcttcgctaccgcagccctgatcgtggaaggctgcgtcatgatgcgcgcctgccagaagaacacctgcccgcagggcattgccacccaggatcctgagctgcgcgcccgctttaagggcaagcccgagtacgtggtcaacttcttcatgttcatcgctgaggaggtgcgcgagatcctcgcccagctcggcttcaggactcttgaggaggccatcggccacgttgagtgcttggatcaggacgaggccatcaagcgctggaagtccagcggcatcgacctgtccaacgtgctcaagcaggccggcccggtacccggcacgatcctgcaccagaccatcgagcagaaccacgagctggagaaggcgctggacaacaagctcatcgaacttgcccagccggccctcgaacacaaggaacccgtgcgcatcgaaatgccgattcgcaacgtcaaccgtacggtcggcaccatggtcggctacgagatcacccgccgttacggcgaggaaggtctgccggacgacaccatcgacatgaccctgcacggttccggaggccagtccatcggtgcgttcatcccgcgcggcgagaccatgcgcatctacggcgaagtcaacgactacgccggcaagggcctgtccggcggtcgcatgatcgtgcgcccggaagatagcgtcaccttcgacaagcacagcaacgtcatcgccggcaacgtcaccggtttcggcgccacttccggccagatgttcgtggccggacgcgccggcgaacgtttcggcgttcgtaacggcggtgctacgtttgtggtcgaaggcgtgggcgaccacggctgcgagtacatgaccggcggcactgttgtggtgctcggccccaccggacgcaatttcggtgcaggcttctccggtggtaacacttatgtgcttgacctcgatatgaagaaggtcaacccgggtgccatcaagtccggtgcactgctcttcaagtcgcttgatgccgaaacctccaagctggtgtacgcactggtcaagcagcatgctgaagagaccggttcgcagttcgctgcggctttgctggaggactggaacgagaccgtcaagcggttcactcacgtggtgccgaagcagttcgtggccatgacgaaggccatggaagaggccaaggccaacaatgtagatttcaatgcgcccggcgcctgggaaaaggtgtacgagcaggttatggaaggagcgcgctgacatgggcgacccgagaggatttctgaaggtccgtacccgccgagagctggctgaacgccccgttgaggaacgtatcaaggactggttcgacgttcacgccgaaaccggcctgcaaccgtggacccaagcgcaggcggcccgctgcatggattgcggcaccccgttctgtatgaccggatgtccgctgggcaacctgattcctgagtggaacgatctggtccgtcagggcaagtgggaggacgcgtacaaccgtctgtccatgaccaacaacttccctgaagtcaccggtcgtatctgcccggctctgtgcgagcaggcctgcgtgctcggcatccaccagccgccgaccatgattcgcaacgacgaatgcacgattatcgatcaggcctgggatcttgacatcgtcaagcctttgccgccgcagcgtctgaccgaccagacggtcgccgtcgtcggctccggccctgccggcctcgccgccgcacagcagctcacccgcgccggccacaccgtcgtcgtctacgagaaggacgacgccatcggtggtctgatgcgttacggcatcccgaacttcaagcttgaaaagggtctgatcgaccgccgtgtcaagcagatggaggccgaaggcacccgcttccgcaccaacgtggaaatcggcaaggacatcacgtgggatgacctgcgtgaccgttacgacgccgtcgtagtggccatcggctcccgcgtgccgcgcgatatgaagattccgggccgcgagctcgacggcatccacttcgccctcgacttcctgcccgacgccacgcgccgtatcttcggcgtcaagccggtgcacgacatcaccgccaaggacaagcacgtcatcgtcatcggcggtggcgacaccggttccgactgcctcggcacctcgatccgtcagggtgcgaaggacgtcaccgtgctacagatcatgccgaaagagccgtcaagccgtccggacaacagcccgtggccgaccttcgcccgcacctaccagaagacctcctccatggaagagggcggcgagtacatctactccaccgactccgtgaacttcgagggcaccgaagaggagaaggccaaggtcaccattgataactcgaccaccgccgaaggcttcgtggccgatgagcgtggtcatgtcaccggcttgaaggtcgtctccgtggctcccggcgaaaatggtccgttcacccgccagcccggcaccgagcgcgtgctgcccgccgatctggtcctcatctccgtgggcttcctgcacccggacaccgagaccatcctcgaccagctgcccgtcgaactcgacaagcgtggcaacatcgctcgcaatgacaagttcgccacctcccaggatggcgtgttcgtgtgcggcgatgccggccgtggccagagcctcgtggtctgggccatcgccgaaggccgctcctgcgccgcagccgtggacgagtacctctccaaggaaaagagcgagctgccggccccgatcaagtccagccagcgtccgatgatgctgcctcgctgaatactttccaaacagaaacatgaaaatcccttcttcatgaggggatttttgcgtttctgggattaattactgccttgagtcttaagtaatgtctatatttcgagaatattgcatacgtggttaacatgaagctcctatggtgtctttcgtcgccaaaaagacgacgccagaatatttgggagagattcatgaacacacgtcatgtcacttcactggtcgcggccggtgcggcaatcgtcatgctgctcagcggctgcggatcgaccggtacctccaattccagcaatgcttcagattccaatatcatttccgtgtacggcagtgagccggcacacccactattccccggcaacaccactgaggccggtggcggcaaggttgtagaccagctgttcgcaggtctggtgacctacgatgcgaagggcggcatccacaacgaggtagcagacagcatcacctccagcgacaacgccacgcattacgtcatcaagctcaagagcggatggaagttcaccgacggcactccggtgaccgcgcactccttcgtaaacgcatggaattacaccgccaacagtgccaacaagcaggccagcgccagcttcttcagcacaatcgaaggctatgatgatctgcaaaagccggacgtggaccccaaggccacgctgagcggcctgaccgtcgttgacgacaacaccatcgatgtcaagctcagccagcccgactcggcattcccggtcaaggccggcagccacgcctacatgccgttgcccgaatccgcgttcaaggacccgaagaagttcggtcagcacccagtgagcaacggcccatacaagttcgtgtcctggcagcacaaccacagcatcgaaatggtgaagaaccctgactacaagggcaatcgtgtcgccaagaacgatggcctgaacttcaagatctatacctcgcctgattcggcatacgccgacctacgcggtggcaacctggacttcacgaacacgattcctgacaccgcacttacctccttccaatccgacaagtcgctgaaggcatacaacgagcccggtggcaatacgctcaccttcaccattcctgaatggctggaacacttcggccagaacgaggaaggcaacctgcgtcgtcaggccatttccatgtccatcgaccgcaagaccgtcgccgagaagatcttccacggcaccgccacgcccgccgtcgacttccttgcagccccaatcagcgcctactccaaggaactcaagggaaatgaagtactgaagtacaacccgtccaaggccaaggaactgtgggccaaggccaacgccatctccccgtggagcggtgagttcggcattgcatacaatgctgatggcactgcgaagaactgggttgaggcaatctgcaactacatcaagaacacgctggatatcgatgccaagagcatcccgatgtccacttccgacgagttcctgtccaatgtggattcaggcaagatgacctccgcataccgtagcggttggggccctgattatccatccgcggacaactatctggtacagctgtacgattccagttcggccgacggcaagggcggcaacagcggcaactacaagaaccccgagttcgatgccatgatggacaaggctctttccgccccgtccaccgaggaagccgacaagtattatcagcaaggtgaggagattctgctgcaggaccttccggctatcccgttgtggaaccagaatgccaccgcagccagcacctccgcaatctccggcgtcgcattcgactacggcggcggcccagtgttcaccgcactgaccaagaagcagtaagcagtaagtaataaacagacagcgctagcccccgctggcgggggctgtcggcaaagccgactgggggtggtctcaaacagcagaccacccctaatcttgttatatgagcgagctcccgtaagcgggagcaatcgagaacatacaggagcacattaactatggaattcaccgtatccggcactaccgtgcgattcgatgaacgaacaatgcagttcgcttttacgcgcgacggtgccgaatggaatacctgcgctgatttcaagccgaccctgcaatgcgcgcaaggcaccttcgcgttcgcggatgccacttccatcacccatgagcagcgtgaaaccggcacgggaaccggcattcgcagcatcttcaccggctttgggcacagcgcatactcctttgaaacctatgtatgggtggagcgtgcctcaggcgatgtgctcttcgaatggattccgctcaatgagcaaggcctgaacatcaccaatgtgacgtggcccgcagccatggacttcgattgcgccgacgaccatgacacgacactcatcacccatgagcaaggtgtgatgatccccaacacatggcctaccgccgtgagcaccaaagacatcgccttcgacggccgcttcgaaacggctggcggttacatgccgtggttcgcgcagctccgcgcagacggacacgggtatatcgccatctgcgaaactccatggaatgccggttacggcatcgaccatcccagcaatggcccgtacacccatatcaatacttggtttgagccaagcctcggcacaatgaattatcgccgcgtggtacgctaccagttcctcgaccacgccgatcacacggcggtgtgcaaggcctatcgttcgtacgtcaacgaacgaggtcgcctgcgtacgctcgccgaaaaggcggcgcgcaatccctccgtgcgtgacctgattggtcgctcgtgggtgcacatcggcatcaaaaccaaagtgcagcccgactcgtactactacgataaggaccaccccgagaaaaacgagtcgctggtcaccttcgcacagcgcgaaaagcaaatgcgaacactgcacggcatgggtgcaggccgactgtacatgcacttggatggttgggcacagcccggatacgacaacgcacaccccgactatctgccggcctgtcaggaggcaggcggctgggaaggcatgaagtcgctggtcgacgcctgccatgagcaaggcgatattttcggcacgcatgaccagtaccgcgattactacttcaccgcgcaaacctttgatgccaacaatgcgattcggctggcagacggtacgatgcccgaacacgcacgctgggcgggcggccgccagacctacctgtgcgccgagctcgcaccggactacgtgcgccgcaatttcacccagattgccgcgcatggcatcaaactcgactgtgcatacttggatgtcttcacctgcaacgaaggcgacgaatgctcgaaccccgaacaccgcatgacccgccgcgaatgctttgaccgccgcgccgaatgcttcgaatatctgctctcgcacggcatcctctcctcgtccgaagaggtatcggactgggcagtgccaagcctgatattctgccattacgcgccatacgacttccagatgcgctcacccaacgagccgcgccaaggtgtaccggtgccgctgtataacctcgtctaccatgattgcgttatcgagccgtggatgatggagcgtgtggtggacggcgacgattacatgctgtacgccttgctcaacggcggagctccatacctgattcgcgatgccgcatacatcggcgttgacggcgacatggacgacgaacagcgcgctcgcacggaaaacgacatcgaacgctgccatacggtcgctgcattccatgagcgggtcggcatgcaggaactggttcgtcacgagttcgtggatgatgatccgctggtgcagcgttcggtattcgcggacggcactgcggtcacttgcgacttccatacgcaaacctatcgcatcaccgactgcccgcatcactgactgaaaatacaatgacacacagtgggttccgatggactggtggcaaattgccgccgataagcgagtaatatagccaacagtgtcaccgtcgaaacaggagtagtgaaatgccgaatcgtgcagaacgccgtgcccaagccaaagcaggccgcaggggagtgccgtcgcagtatgaccagacccgtggccgtggccgttcgggaatgattgacgaataccagctgcagcagaagtcccagcgtctgcaggacggcaccgacggcaccgaatggaagcccagcggcggtacgattgcggacaccgaaaccctgctgaccactaacccgaactacacgaatccgaagatgttcaaggcaccgcattcgctgcgtcagtggttccgtgtgggcagctggacgctgatcgccatcgcgattatcgcgttcttcgtggttatgtggctgccaagccatccgatgtggctgatcatcaccgtttccgcggtgttcattgtgggtgtgctgagcctgttctttacggctggcgattccaagcataatccgaatttggatcagaacggcacggcagtctgatcttttgcccggtaaatccggcttgaaaagcaaaacgcacgacggaagttgtgcgttttcttgtatgcggtgccctaaagtaagaagtgcttgagtttctttctgacgcacgaaggagaggcagtccgatgaaagttgatattctaacccgcgaatacccgccgcatgtctatggtggggccggtgtacacgccgaggaactgtccaaggtgcttgccgagcgcatcgacgtaaccgttcgtgcgtttgatggcaagcgcaccgaggcggacattcctgctatcccgaatgctgccgatgctaagggcagcttgaaggtcgtcggctatgacacgccttctgagctggctgatgccaaccccgcattgaagaccttcggcgttgatttgcagatcgccaatgatgtggacgccgacatcatccacgcgcacacctggtatgcctgcctggcgggctacatggccaagatgctgcacggcactccattggttattaccgcgcactctctggaaccgttccgcccgtggaagcgtgagcagctcggcggcggctacaatctgagctcctgggctgagaaggatgcttacgagcacgccgatcgtgtgatcgccgtgtccggtggcatgcgcaaggatattctgactgcttacccgaacctcgatccgaacaaggtggttgtggtgtacaacggcatcaccatggccgacttcgctaccccggcaccagacgatccgggttggaaggtgttcgagcgttaccacatcgaccgttcgaagcccaccctgctgttcgtgggccgtatcacccgccagaagggcctgccatacctgctcaaggcactgcacctgatttccaaggacattcaggtggtgctgtgcgccggtgctcctgacaccccggaaatcgccgaagaggtcaagatcgcgttcgccaagctggatgaggaacgcggcaacatcgtctggattgaagaaatgctgccgaagcctgagctgaatgctttggaacacggctgtgatgccttcatctgcccgagcatctacgagccgctgggcatcgtgaaccttgaggccatggcctgcggtctgccggtcgtcgcatccgccactggcggcattccggaagtcgtggtcgacggcgaaaccggctatctggtcccgatcgaccagctgcacgacggcaccggcacccccaccgatccggacaagtttgtgcacgacatggccgccgccatcgacaagatcatggctgaccccgaactcgccaagaagatgggccaggccggctacgaacgcgcccgcgacgtgttcagctgggagaccatcgccgacaagaccgtggaagtctaccagtccgtgctcgacgagcagaagaagtaagtagcgctgcaacgagtgctcccctcagtccggctgcgccggccagctcccctcaggtaccggtttcttggctctcctctctgaggggagctgttaccgcaggtgactgaggggagtcgtcagaccgcgaatcataggtagtatttcactcatgacaaacaccgtcctccaactcgacaacgtcgaattccggcgtaaccgtcgcgtcattatcaccgacgtgaacctcaccatcaacgcgggggagcgttgggtgctgttcggtccgaacggcatcggcaaatccaccgcggtcggcatgctggccacccgcaccttcccctcagagggccgcgtattcatcctcggccatcaactcggcaaatacgacgtattcaaactgcgcacccgcatcggtctcgcctctgccgacctgggccggcagttccccgagttcgaggacccgctggacgccgtggtcaccggcctgtccgccgtgaccgggcgctggcgcgacacctacacgcaagaggaatacgcccgcgcccgccagctgctgcgcgattttcgcgtctcctatctggaaggcaaggagatgtggcgactgtccgaaggcgaacgcacccgcgtattgatcgcccgtgcgctgatgggagatcctgagctgctcatcatggatgagccgaccaccggccttgacctgggcggccgcgagcaggtgatgcgcacattgagccgaatcggcgaagagaactccgagcgtgccgtggtgctggtcacccatcgcttggaggagattccggccggtttcgaccacatcgccattatgggacgcaagccgattcccgctgaggacgccaccgaagcgggcgtggactcaatgggtaatcccggtgctggcaccatcgtctacaccggttcgttggagaatggcctgaccgacgaacgcttgtcggaattgttcggtatgcccatcgaagtccagcacacccacggccgctgggccgcctacgccgtgtgatgcttgtaggtttttaggcgggattttcttcgccccctctggagaggggctgtcagcgtaagctgactgggggcaaccagttacgaaggcaaccatgacaaccaatagcaaactcgtattcatcgatatcgacggcaccctagccgacgaaaaccacgtcgtacccgaatctgccaaaatcgcttgcaaacaagcccaggccaacggccacaagctcttcatctgcaccgggcgttccgtgccgaaaatcgagcgcagcatcctcgacctcggtttcgatggcgtggtttccgtggcgggcgctcaggcgaatatcggagacaggctgctgttccagcatctcgtccctcctgaagcggtcgatgcggcgatggcgtattttgccaagcatcatatcgagagctaccaatggcaaggtgcggatggcatgtacatctcggaaggctaccgtcaacatctggaatcgaaaggcaagacctggaatcgtggcgaattcgcgcgattctggcacctgttggatgaggtggaggtgccggctggctcgactttgggacagacgattcgtgtgagcaaggggtcatacttcacctcgccgaatcctgacgtgactttcgaggagactcaacatgatttgagcccatggtttgagctcgtgcatggttcgtatgacaagatttccccgaacaatggcgagttgctgattaatggcatcgacaaaggtaccgctgtgcgcgacgtggcttctttgctgggctactccgttgccgacaccatcgccatcggagactccgacaacgacactgccatgctcaaggccgccggcacatccgtagccatgggcaacgccattcacggcatccaagccttctgtgacttcaccaccaccgacattcacgaggacggcctggccaacgccttcaagacgttgggactggtgtgaggctatgtcgtttgctctcagacggaggatcctttcgtgctgtagtattgcgacgcggcacaacgtatgctgcgccgagcatagagaattatgaattcaaaatggtttgttcatcatgcgaagatagtggtcatctgtccgtcgcggttgcgcaatttacggtggcggaggagccggaacggaatctggagatcatcgacggattcgcgcgtgatgctgcggtgggcgatagggaagccgatctcattactgctgagctgagtcgtgagtgtcttgattccgcgcgtcgaacattgccggtgttgcagaatcgccgttttgccgatccgcagttgtgtgactgacctctaaataactttactagcgctgttgataagggttctatgatgggaatcatgaccactactgttgatagctctgattcaatgccggaacgtctgcaagaggggagcgcggcgcccgatttcactctgccggcggttatacctgggtttacagagagcggatcaatcaacctgtctgacgtgcttgatgccggccgcagggttgtactgtacttctacccggccgcgatgacgcccggttgcaccaccgaggcttgcgatttccgtgacaatctcgcccgattggcgtcgaaaaacgttacggtgcttggcgtctccaaggactcgcttgacaagctgcgcaagtttgcacagcgtgatcatctcacgttcccgctgctgtctgatcccgacctgaccgtgcacaagctgtacggcgcatatggcgaaaagaagctctacggcaagatacacgtaggcgtgatccgttcgacgctcgtcatcaatcccgacggctccgtggttatcgctcgttacaacgtacgtgccaaaggccatgtcgattcgctattaaaggcactggaaaagttggagaagctggagaagtagtgcgttctcgttgttcggacacagtggttcgtgcggtatgcgccgtatgaaccactgccgtatgaaccgccggttgacttctcggactcaccggcaaatagtgagaccgtgggcgcgcagtacgtctatggctggcatgtaatcgagcgatgttgcggtgggattgagcatcagttcgcggatggcggcggatgctgaggactcgcttgtcttcgaggattctgcggccgggaacagagcgtcggcgattagggagatgatacgggaacgtgcatcgccggcattggcattgttgctgctgttgccggcgtcggcagtggcggatttgccaataattgtggagctgtttcgtagaatcgtattcaacgctgcggcaagcggctcgggattgttctttgtcgcttcgacaatgtcatcgagctgatcgaataaggcgaacagccatgcacggcgttgcccctcatcgttgccagccgcaagcctttcattggtgacgcgcacgagttcatcaatcggtactgctggcgtctttgccggatcgcgatgctcgcggttgtcttcgatatctcccatcagatgctggattttgcactcgtcctgcaatacggtggtctcggcaaatgcggtggcgatggcgtccgcatcgatgaacttgccaccctcggactggaagcgcacgcgcttaggctcgctgtaataatgcgacatgccgaatgtgatgtactgcggcatctcgtcctgcaattgcttgaccgcatccgccactttgcgcatgtccgcaagctgctgatgcaccacaataaaggcaagcactgctttggcgtcggcgagagtgagcggctgaccgatgctggctccatgatggtgctcatgatgcgcgaacatgttcttcagcgaatcaaacaatcccataatgtcctccttcgaactgggcgaattagctgcatctgccattcacactagtccggaatgtatgagaatcatcgtggaacgccgagagcgaattattgacgctgcacgcagcaacgtgagaactgaaccgacaccaagaacacggggcatacctgcagcatgtcgagcaatgcgatggcattgtttgttaagagctcgaaaatatcgcacaggacgtagaagtgcttgtccgaatcatgtatggcaagaaggctctacagtttgcttgtgaacgactccactggctaactggtagagaagtagcggtttggtatacgcaaacagtgcgatcggcgatgaagatgactgtgaggttgtcatgtgtattcctcagaacgatgagcaagagccatggacttggtgcgtaatagcaaatgtcgtagatgagcatgaggttggtgttgaccatcatattgagcatggaacgaagatattcagtcctggaacaaaagtgtatgtgtcgactgaatggaggacgagcctaaaggatgacggtggaacattgtttgtgattgggaaagcgcgtaagcaatggcgaatggtaggtatgttcattccacgtaatcgattgacgaactttcgagttggacgagtattcgatccacgtgtactgcggcgtatggctaaggattgcaggcaatcagtgccagatccgtctgaatggggttggcgctggtggggcaatgatgaggatgcccaccaaacagtcattaagagggttgaatacttcagtcaagatggattttcgttgccagaagctggggctgaagatgattagaatcaggtgagtaacacgatgctgaagaattctgatgcgtctagtctttcttcttgagggaccttccaccgccaacaccgcgaccaggacggcttgcattccaatcatctattgttcaggtagctaacctttagtagtgccatatatacgtcaggttccggcagcttatatactgatgcgttcttgacgccgaggcgctcgctaacttctttggtgctgagaaacctaagtgccatttgagttcctctcatcttcgtggagatttcagtacgtcggtatattgagcatacctgcatattagcgaggcaaatcctctagtgaattgagatcttgactcactgataggcggttagtgaagcgattctgcggttaagccgagcttttgcttcgctgagcagtctcagtgagacaaatcctcgggcggaccgaggcattgctctactaaaaggccacttagcgaggtttttcctctactaactctctgagttgcttcgctgacgacgattcagcggggggtggtgacgttttcttggactgtgatccgaggaggagacggccatggcgaagtacacgagggaacagcggcaacgcgcggtcgagttgtatgtgaaatacgagtgctgcgcggcggatgtgatccgcgagctggggtatcccagccgggaggcgttgcgcatgtggcaccgggactggctcgacgaacaggggacgggcgtgtcctcgcagcgtggtgaacggtatgcgcgctacacggaggagcagaagcgtgcggccgtggaccattatctgacgcatggtcggcgtgcgagccgcacgatgcgtcagatggggtatccgagcaaagaggtgcttgcctcgtggatcgacgagctcgcgccgggcgaacgccggattcgccgtggcccggttcccggggaattgaaacgggatgcggtcctgaaggtcgcgtccggcgaattgagttcgcgcgaggccgcggaggcggtgggtgtggattcgtcggtcgtgcgaaactggaagcgtcaactgctcggagacgcgaaaggactcatggtggcgaagagggaaccggaacgcggggattcctcgcagcaggacgatccggacgcgctgcgcggcgagatcgccacgttgcgcgccgacctcgagcgtctgcgcgccgaacagcgggccatggagatccggttggcgatcatgaagggtgcggcggaactggtgggaaaagagccgggcgcagacccggacaacctgacaagccgagagaagacgaccctgatcaaggacatcagtgagacgttgggcgtgaacgcggagagcctgctgaaggaggtcggcatcgcgcgcagcacgtactactaccagttgaaggccatgcgccggccggacaagaacgcgaacctcctgtccctggtgcgcgaggcgttcgggagcagcaggaggcgttacgggtacaagcgcatccacctcgagctcaaaagcgcgggcatcatcgtgtcggccaagcgcatcatgcgcctgatgaccagccacggcatggtccccgtgctcaagagcgcgaagcgctacagttcgtacaagggcgagatcggaggcgcgcccgcgaatctcgtgaaccgcgacttccacgccaccgcgccgaaccggctgtgggtcacggacatcaccgagttctcgatcccggcgggcaaggtgtacctgtcgccggtcatcgactgccacgacggcatgcccgtcgcctggacgatcggcacgagccccaacgccgccctggccaacggcatgcttcgcgacgcgtgcgccacgctcaagcccggcgagacgccgatcatccactcggattaagccgggtttgttgttaagccggggaacggttcggggtcttggtggctggccgtgtcccatgtggtttcccggcttaacgttccgggttatttgagggtgtgtagttgtcggagtcgttgctcgctgagccatgtctccttggaggggtcggggccggggttggccgcatcgacggctttgcgcatcatgtcgagggtcgcgaacgcgtagaacgcgctggttgtgctcatgctttcgtggccgagcagttgcatgatgagcggtagcggcacgccctgttggtagaggtccatggcgcgggtccggcggatcaggtggcagtggacgcgttcgggcatggacgggcacgtcccgcggcgtgctctggccgccgcggttttgaggatctcgtcgatccggtccacggagagcggctggatggcgccgttcctcgtcgagtggaacaacggcccgtcgccgtcgcgcatggacggtccgggatggaattcctcgaggtaggcggccaggtgggttcgtgtcctttctcccaggggcacgacccggctcttgccgcgtttgccggtgagcgtgaccctggccggcttatccatacccacgtccgcgatggtcagtgcggcgagttcgccgatcctggcggcggtgtcgtacatgaggatcaggagcatgcggttcctgcgcgatttggcgtcgccggtgccccatgcggtcagcaacgctttggtgtgctcctccccgaggtggtcgacgggtttgcgcgcgggtggtttgacacgtatgccggccgcgtcgttgcccagcgcggtcaatgccgggtgttcgaggcccgcgtggtcgaggaacacgcgcatcgtcgtcatcctcagcatgatggtgcggtccgagtacccgcgctcggtccgcatccattcgacccaccggcccaggcgcgcccggtcgaaatgcccgaaaccgatgtggctgcgctgcgtgccttccgtggtttcgagccatcggacgtaggattccaggccgatgcggtacgcctcgacggtcttcggcgagctgccccgcaccttgggcagccagtggtgcagccagtcgcgcgcgactcgccagaagtccggttcaccggagctggcggccgttttccttgccttgctcatggttcctccgtttccgggaccacgcgttcggcgtcggcgacgaggtccgcgtatccgtccatgaaatcgaggctggcgtgcacgtagtagagggtgctgtcgatgccggcgtgtcccatgtaggccgccagatagggcagcatcgccatcacgtccacgccgtcgcgagtccaccgctcgatgttcgcgaacgcgaaccggtgccggaaatcatagggcctgggccgtttgccggcttgtggccactcgagcccggcccgcgtccagacgcggcggaacaccacgccgggcatgcccggggagaccggattgccggtggaggtgacgaagaacgcgggacggtcgtctccgaagcgttcgcgggaccgttggtcgcattccagcagttcggcggcgacctcgtcgcccacgggcagcctgcggctgcgaccggccttggaatcgaccacgtcgatggaacgggccttgtggtcgacgtgcccgacggcgagtctcctgacctctcgggtgcgcagcccgcagcaggccatgagcatgaagaacgcgcgagactgccacgcccacggcgacggagactccaacgttcccgcggcccgcaggaacagggcggcctcgcggtccgtcagcaggtacggcgtcggacgcggggatccggccttccactggtcggagagcacgtacgcgtcgggatcgtgggccagtcgcatccacctgccgaagtccctgatgtacgagaaccacgagcggcaacccccgggattcgcgtcgatcctatgggcgatccatcgctccacgacgccccgctccagacgcacggccccgtgttcgaggcaatgccggtcgaacgagcgcaggacctggacgcgggtggcgccatgcctgcccatggacgccttgaaacggatgtactcctccaattcgccggcgagcgggccgacgaatccgtgttccgtgggtctcatgacgatccgccttccggcacgggcagcacgcacgcgagcattcccccgcggtgcgtggccatgtagacgcgtgtggaatcggggtcggcgtggccaagcaccgcgctgatcgtcggcaacggcgtggccgcctccagcatcctcgtcgccgcgttgcgccgcaacagcctggaaccgccccggcgtccgagcccggcgtgccgcatgacacggctgatcgcctcgtacaccgatgaatgaccccgaagcgcgacatggggcgccttgtaccgcacgaacacacggtcgtcgtcggtggcgggcctttcgtccaacagccaggacgccagcctcgcggccagcggtcccgtcatcggcacggtcaacggattgcccgtctttcgctgcaccagacctatgctcatggaatcccaatccacgtcggcgatcctcagaccgatcacatcgcatgccctcagcccgcacgtcagcgacagcagggtgatcgccgcgtccctcgacggcaccgaccgcgaggcgcacgcctccagcaagcggcggtgctcgtcgtcgggcaacgttcccgcgatcgcgtgggtcctgcgtatgccggccaggccgatcgcgtccgccaggtcatcccgcccgagccatctgaacaacgggcgcaggtccgacgcggcgtgccgcatcgacgactccgaccagcgtgaacgcagcccggccaggaaccccagcacatgcgagccatccgaaccgtccaacgacacgaccccatgagattccagccacgtgaggaacaagcccgccatccgacggtaatgccccaccgtcgccgaagccagtcccgaaccggcgagatacgcctcccaacgctccatgaccacggccaaacccggaaccaccggctccgcaagcctgctcctgcgccacttgcccaggtccaccgaaccggaccgcagatacgagtcgcacaaacgcgccagcctgccgtaatcgaaccaccgctgcctgctgaaaccgcccgtccgctcactgaaggtcgacgcggcgaaccccgcgcccaacccacgcgtgtacaccgcatccgggcctccggcgtaccgttccaacgccctgatggacttgcggtactggcctatggtggattccatataaccggccccgtaaagcgcgcggaccacctcgcccgcgacatggccaaccgtcgtctcacccatggcaaactccttcgttcgaatcaaatgggacaagacgaacataacccggaacgttaagccgggaaaccacatgggacacggccagccaccaagaccccgaaccgttccccggcttaacaacaaacccggcttaatcggagttaaaccgacatcggtttaacagtgacaggggttgccattaccggtggccggaatggatccgcatctgcaccgagcacgggctgacccggtcgatgagcgcgaagggctgttcgccggacaatgcggccgcggaggggttcttcggccgtctcaagcaggagttcttccacaagaggagcttccggggcgtgacgatcgacgagttcaccgcgatgctcgacgagtacatggtctggtaccgcgacaagcgcatcaagaccgaatacggcatgagcatcatggacaaacgcatccagctcgggctcgtcgcctgaaaccatccggtacactgaccaacgaccatacagacaacgaagtccaacaaaacgtcaccacccccgggtattcccttgacctatccgtgttttcgctctgcaaagtagttctgagcggcggatcgatactcacacagatgtgtacggtgtgctgtcagcgtctttgtagtttcgccggtcagttgcctggtaatccaggataaatcagtcatggttcctcacttccatgtgaggcagtacacttgggtactgcctctattgagtgcattgataaaggtcagccccgcaagcgctaccaacatttgcggggcatttaagttttgatacaaccgagaggaaaccggggctgaaaccccggcgcgatagcgtgttatccgacgttcagcgtcagcacttccacgccatcaatcaggacaatcaccctagggtaatcgtctatgattagcagagtatggtattcgccgcagcaatcgcagcgccatacggtgccgagaccatatatcatggttaatatcctctcggttgtaggatgacccgcacgtttgtgtgggccaagttccgcaagggaacacgtaagccgcaagcgttcacagcacttgcggctttcgctttatgtcccgaacggaacaaccgaggggtcaaacgacccagtgcctagactatggggtgaacccagtgagtttaggccgactgcatacgatgcctacagtcgggcgaagagttgaattgattagggcacacacctagctttcgctagtgttttctttcggcctctcagcctctaacagtttgcgagggttactgaccttgagcgcgtcacataacttgatagccatgccaagactcatattttcgataggtcttgaaccagtctcagtcgcggcgattcgcgtgtgcggcacacctgacttgtcagctagttgacgctgggttaacccgcgcttctgccttaactccctaagactcattacccacctcgcttatgctcagtgggcccgattatacctatcgttgaaacatctgtagagtgaggggcataaatcgaaaggcgtcaatgatgaacggaacattcgagcagttaagagcagccgtgtatggccaagcagtcggtgatgccttgggcgtaccttatgaattcatgccgagagataccttccgatgcgaaggtatgacgggatacggtacgcataaccagccgattggcacatggtcggacgataccagcatgatgctcgccacattggactcgctgatcgccaatgaatggcaagtcaatactgaagatatgcgagagcgatatctggcatggctgagtaatggcgaatacgcgattgacggacgagtctttgattgcgggcgaacggtctccatcgcgttgcagcagcgtgtgggcttaagcggtgaacgagacaatggcaacggctcactgatgcggatcatgccgttggcgttcgcggatgcttccgcggatgacgtacgtgccgcatctgcaatcacgcacgcccatgcaatctcgatggatgcctgttcgagcatggtggatgtgttgcgcgacggactcatcaaaggcatatggccgcaagagctggatgatgaaccgctacgcggtatgccgcgtgatgaagttggttcgagcggcttcgtcaaagacacgtatgaggcggcgctctggtgcctcgcgaataccgatgattatgcgagttgtgtgctcgccgccgtcaacttgggtgacgatacagacacgaccgccgccgtcgccggatacctggccggcatcaaatatggattcgatgccattcccgctcagtggctggcggtattgcgcggacgtgagtttattgaggatgtgcttggacggacggagtcggcgtggcattaaggcgctcgcggcgagtagcaacctactgtttctgtatgcgatgaagatggccagtacgccaccatcaacagtgaggactccctgcctactgttctccacgatcacgcccaagcactggacactcccatgtctcgttccgctgaacattgccgagaactcccttcttctggatgcgcatcatcgaatcccacttgctcgacgcccagactgctttggacggggatacgccgctagtgggggacagagattgagacgcatccgggttcgaatagtgtgagggatttggctttgccaacggttgttggacacattccatacggtggtgcctgtgttgttcgcaaaagtatgtctatctaatcgttaatcgaggatgacgatatggtgagtttttctgccgctataatgtaggattattaacaggttacggctgaagaactgattacagtattagaacatttttttctgatatatgtggttggcgtagatgtggcatatacgaggggcatcctatggcggatgatgaaactcatatcggtcgaaataacgaggaacgcaaggaagacgaaaaccgtcgcattatgggaaaggcgctggaaggtgctgcggcggaaaccgtgcaacgctttggttctgccgtcaaggaacatttagcggcctatgcgggtgatagagagaatgctgccgatggtaattccaaactgtctaagaccttgaagtccattgctgaaacgccgacaagtaatgaattcaaaaagcagaacatagctcagcaagcgggttttagtgccgaggttgagtcggtagccaggaagaacgccgataacattattgctggcaacgatacgcgattcaaacgatatgatgacgtgaagcattcagatggacggcagacatcgaacgaccccatcgtggatattgtcgaagtggatggattgggcaaaacgatcatcggctccgaggctcaaatgaagttcgtcggcagtagcccgaaagagctgcttaatgcgttgaaaagcaaggaatatgcgaaatatcgtaatgaaggcgtcatcatgaatattccggatgattattacgatgtactgatgggtgatgggcctgacggcatcaacggacagatacgaaaacttcagggcgagctggatggagatcggcttgccggcaagaattctccagagtctattcagcagcaaatcgatgatctgaaacagattaagaaaagcctgcggaaaagtggacttaccaagcgagaagcgttgtatgcgcgagaacatcccagacgcatggtggcgaaagatgtagccaaagttgccaataaagccggtctgcagcaggcaaggaatggtgcgctgattggtggtggtgtttctctgattcgaaatatggttgccatgcattaatggctctattgagccagcggaggcagcgagaaacgtcggcgtcgatgcaggcttggctgcggcgttcggctatgtcaccgctttttccggcgctgccattaagggtgccatgcaaaacgcgtcgagcgagtatctgcgtagtctatcgagaacgaacgttgcagctacgatggtctccactgtaacggatgtttccaaggtggttgcactgtattgccgcggcgagattactggagctgtttgtatagagcgcctcggccagcagggaatggggcagctcggaggagtgatgggcgttgccgtggcgatggccgcaatacctgcagatggtgcttttatggctgcgatggttggtatggctggaagcaccttgggatatgctgcagctgttgccatatatgaggaattatccactgctctgcatgactatgagctggcgaaagaggagcgtattcgtgtggaacgcgaatgtgcggaagcggtggagctcatccgccaatataggcgtgatatgtctagggatgtcgagaattatctggcgactcatgatgaattgtttaatagagcattcgatgcaatggatcaagcgttgatttccaatgatattgatggatatttggccggaaacgccgagattcaagaatccttgggatacttgccaaggtttcggactcagcaggagtttgatgatttgatggcgtcagacgacaatttcgttttataaggaggagccagttaatgaagtacatcaaaacacgtgatgcattacaagcattttattatctgattgctgtcgatggatcagtccgtgacgacgaacgcgcactattcgatcatataggtgacaatttggatgcaaagcacttccatgattatcgcaaagagattatcgattcgtgcgatgagcgtataaaccagtgccacgattccgatgatcgctacgacgtaattgttgagggtgttgatgcagtcttgtcgcatcgaacggataaaagagctgcaggaattgcaccaaggctgcttctgtggaatatgttgtcagttgccttcgccgatggggaatatgatgcagtagaaagcagactcatcagacatattgcccggacgatgattgccgatcgttccatataccccgaaatggaacatcttatgcgcgcggcgtatgacgtgcgaggcgagctcgactggatcagcaattccgaactgccatatagtgaagttcgccccatggtggatcagctggaagagcgcgtgaatgttctccaaaacgctgccgtgttgctgattgaagacgagacagccgcgccagccccggaagtcatggttccagagaaggacgtgtttgatcagaccaaggatgccgttgactcggtggtcgctccggttgtggatcaggttcagcagggtgctcagggagccgcggatgcggtgaagcatacgtttgacaataatgttgctcctgttctcaaccaagttggcgatgcgctgaagccggtgaatgatgcagtgctgaaaccggtaggcaacgcagccaatgaggttgcgaaacgtgcgggtgacgcagccaatgaggctgcaaaacgtgcgggcgatgcggccaatgaggctgcaaaacgtgcgggcgatgcggccaatgctgtacaaggcttcttcggtggcctctttggacgcaaataagagaaacccaggaaggaattcactatgccattttttgttgttccactattcatcggaatggccgctgctgccggtaccgcaggcgtgggtatggctgccaaaggtagtcttgatcagcacacggcgaatcagcttaacgacaattccggagcacgcattcgatgggcagctaataacctcgaaaagcttcgtgggcaatgttcggattccctgaatgccttgggcaaagagaaagtcatcattttggatgggagcgttcagcgcttccttgatgcttttcaacagttgaaaaatgttgatttcaccgcgtccgaagggcttgatgaactcaataaactgcgcatagacaaagcggcttttgatgaacttaaaaccatgggaaacatagcttcgtctttgctggaaggcggtgtggccggggcagccagcggtgcattggctgcgtttggcgcatatagtgccgcgtcggcacttgccacggcttccacaggaactgcgatcagtgcattaagtggtgtggctgcttccaacgccacgttggcgttcttcgggggagggtccttggctgcaggtggcttgggcatggccggtggcgccgctgtacttggaggtttagtcgcaggtcctgcattgctggtcatgggcgttatcatcggtgccaagggtggcaaaaaccttgaggaagcgaagacccagtctgctgaggcaagcaaatattgtgagcagatgatggccggtgcggaccagtgcgttgccattcgtcggcgtagttatatgttccacgctttgcttgcccgtcttgatgctaaattcctgccttcaattcttgaaatggaaaatatcataaagaccgagggaacggattattcgcaattccgtcaggaaagtaagaagactattgccgcagctgcgtccactgcagcatcaatcaaggccgtgctagatactcctctgctggccgaggatgggtcacttactttggagtcggagaagctgatgaagaacagtggcatttgatgggatgaggattccggagctggactgatggttctgtgtcttcttccgttgattttgggatatggcgagaatccgttgcccgagatgacgagtcttgcggaagctcatggcattcgactatttagtctgccgactgtcggacgagaagtggatgctttcagttttatgttcgatggtgtgccgtatatcgcggtagataccagcaagaccgcagaacgtgtccgttttgatatcgcacatggaatgggcatctgatgatgcgtgaaatggtatccgaggatgtagctgccgcagtaacgcgcgatatcgaaggtgaagctcattcgttcgccgcgaatcttttgatgccgaagcgccgtgttctgggcatggtgccgactcacgcttcagtgtcgcagattttggctgcgaaacattatttcaaggtttccgcaatggctatggctcgccgggcctatgagctgggccgattgtctgaatgggaatatcggcaggtttgctcagaactgacggttcaaggatacaagagtggcgagccacgtgatctgcgcccagaacagtcgaaggtattccgattcgtggctgataccaataggcagaagggcatatcggtttctacggtgagtgaggagaccgggcttgtgcccaaagaattgcatggattgtcgtttggaaatatttgggcggttacgggtgggagtagcctgagtcagagagccatcttgggtcgaaatgaatctgtttgagctgacatcgcaatctgggttgtgcaatgactgagtaaccccttgttcttttgagaggtcgcttcgctggtttccgttggtttcgttaatcgcatttttcgttgcaatgacgccgttctggtgacgttcgcgagattcgttgattgctgctgatttcgctgttctctgcggtcattgtgtcccggttgtgtccacagcggcgcgggtgttccccagtcaaatgaactggaatgactgaggaacagcgttggacaccaatcaacttgtccgattctctcctatgaactcttggagctgagcatgttggtttacttaccatccctatggtcactttcgtcgagcgggattagagtaatgtgcgagaaatctattacatcgccgaagaatacttgtgattcgtatttccggaccttggcagtggctgtgacaattttcttagccaccacgccattgactccatccatcggcagcaacctgtattctccggttttctcggaaatcgttttgcatccagagacgtttgcgtaccactgatagtatccaaggaagactttccgccttcccacataggcattcaaacggctgactccatgaatgcaagaagggaaactcaccttgcgtatcgacatgcctggattaagagtgaaggatagtccgtcccacttgtggaagatataagcattcttatgttccagtagagccagagcgataatgtcgttctggatgtcgaagtctctgatttctttgaactccgggaacaagatctctgacgaggaacgccgctgaagatcactgtacagctgggcaatttcttgcagctgcgcaaaatcaggaagattattagtcggcaagttgtcaatagacaggaaggcttcaccgtcaggcgagtgaaggttgaactccgatccctgcgagagctcctgacaaacggttatggcgtctttgaccttatcaaccggcttgcccactatatttttgatggtgaaattcatcttgaccgtcgtggtcgcatcaccatcaaaaataagttggacccgaaggcactcgctttcatcctcaccagtccattgagcaccgccttcaatcccgtgagtgcgctcaacctgtttaagcgacacggaagcagaaggcgaggccaagataagctctaaatcattcccttcattctgcgggagaatgaacgcccggcaggactgtatctgcgcatcgggcagcgtgtccttcagaaacgggatattgccagtatccgcaagacgaacagggaaatcagcaagtgaggtgccatattttttgaacgactcaagctgctcacgttgctcttggttctgtggcacaaactgcacggggaaggttatcttcgcgaatgacgtcgcttccttgtacttggcgatcacatcaacggtgattgacgacccgtccggcctcttttccaaaaaagagaaaacgaggttcggtctcgtaatgaaatatgaatgctcgtcgaacttactggcgatgttcacggtataggcatagttgggatcacgattttccagcatgtcacaaatcgagtgaagtttcgacagcagcgctttatcatcatgcagatcgtccacacgagcggcttcgataaatgtatggaccaatcgctccacttcgcgtataccgttaccgaggaaatagtcatagacctcgggcatatcggtagcccaagcttggatgttgggtagcccgacccaatcacaattatatggcagttccttcgttatttccttgaaccatttcagattctgcggagttggatccaagggcaagaccagataccagttcgccaccttatagccggtttcccggatatagtcgttcagcgacttcagcgacttcttaatctgactcttctggctggttttaagagtatgggcaaacttcttcacctgataaacgtcataggtgccatcaccgttcttcacctgaagatctatcccattgtcaccggatgaagggcgaacacggtttgcctcaggacgctgcttgcaaataaatacggcaagcagcgtctccatatcctcgccggacagattcccccatggaataggatcaaccacgaaaacctcgcttcttgccaagtcggcaactacccattatcatcagctctagcttggttgattcgtctttggcgcgccgcttgtgccgcaagtaacccgctttgtcacgtatctaacgagccggaacccttagaacatatgttctaacatgtggccttgacgcaagcctacggcggcggcaatcgctgacttcggacggttgatgacaaacagacgtacctcgacttggctaaacactagtattagctgagtccagactctagacggattggagattcgcaagtgagcaagagcccggtagctcatcccaccaagtatgacccccggcccacgccccgttgccggagactgaccgagccggatcgtgagtcggctcatgctcccgccagcgagggcgtgaaccgacgaaccattcctctaggcgaatggtcgggacagcatagccgaagtacgctgtcccagctgactccatccctcactcgtagctgatgaccagacggccgaccacgtcgccgcgctccagtcgttcgatcgcctccggcacctcgtcgaacgagacggtcgtggtgaccggcgtgagcttgccggtgcgcatcagctcgtagacgcctcggatgtcgtcgggcgtgccgccgttggatccgcgcagatcgcactggttgacgatgagcgacttggcatcgatggtggtttccaaccggcccatgccgacgagcaccaccacgccgcccagcctgatcacgtccaccgcgtcggcggtggtgtcgccgaatccggcgaagtcgacgatcacatcgaagaatcccttcggatagtccgtgatggactggcgcgcgtccaccgcgcccagttccttggccagcggccagatatcctccttgatctccgccacatgcacctcggcgcccagcagatgggccacgcgggcgccgatctggcccaacccgcccaatccgatgatgccgaccctgtcgccggccttcacgccgccacggcgcaccacggccgcgtacgaggtcatgcccgcatcggtggccgcggcgccgttgacgaaatccacctcgtcgggaatgcgcaccagcgcctgcgtgcccaccacgatcttcgggccgaatccgccgtcgaaggaggacccggggcagccggccggcgtggtcgggcatatcgccacgcggtcgcccacctgaaaatcgtccacgccctcgccgacttggctgatcacgccggcatcctcgtggccgagcgtgaccggcacctgcgccagcatcgtcatccagcccggatcggtgagaatgcccacatcggtgtggcagatgccggccgccttcacgtcgacgacgacctgccccggtccggcggtcggctcgggcagctcggcgagctgcaatggttcattggtgccggtgaatctccatgacttcatcatgactccttaacttcaaggcgcatcgtcgcgccattcggccgagcccctcgtcccgggcacggactgcgccgttgggaatacggcgacaccctctatcgtagggcagccgggcgaacgacccacgcggcccgttgtctacttagaagtgcaacatcctttttaaagggtgttgcacttctaagtagacaacgggatgtttgggtcgcactatctgcccaaaagcatgatgtgttcagctccgctcacgaatgaaatcgaagatcacgtcgaagacctgctggctccagaaatcgtactcatgttcggcgccgtcgactagcaccagctgcgcgtccacgccgtgctcgaccagttggtcgcgcatcttgacggattgatgataggggaccacggtgtcggcggtaccgtgcaacaggagcatcggcggatactgctggtcatcccgcacctgcaggtagggactcatatcagccgcacgctgacggacctcggcattgatgccggtctcatgggtcgcacccaccacggccgcgaacgggccgaaataatacagccggaatggattggtctcatcgtcgaatgcgtcgacagcttcaagcatgtcagtgggcgggaagcagctgaccacgtacttcaccgcatcgctttcatcggcattggtgccatcctcatacctcggatcgtcggcggtcaaccccaccagcagcgacgtgttgccgccggacgacgtgccccagataccgagacggtcggggtccacgtgccattgacgtgcgtttgccctgagatagcggatggctgctttgacgtcctcgagatatgcggggaacatgtcgtgggggtcgctcgaggcatcgcgatgattcaccgtagccaccacaaagccttcgcgggccaaagccgagagctgcgggatctcgtagtcgcgatgcggcgtggtccaggcgctgccttgcacgaataccacggtggggtagcggcggtcatcgtcatcgccggtggattgtggtgagatgatatccatcaccaggttatcggccccggtcttgtacgccacgttgcgggtcagcgtggccaatccggcaagcgtgggattgtgcgggatatggatgacattgtttgcgccggcgttggcatcactgactttggatgaatcggtagtgttcatggaatccccctagctctgttgctatagaggtcatcatacaagaaataggcatgatcacggcacaacgatgtctcgatcacagcgaagacatgaagacgcgaagacgcgcccggcagcgcgcgctgcctgcctgcgagttgccttcaagtgcacttcaagcgataaggtgacataagccgcggcaatggagattgctgcccggcaacgaggcggacagtgcccgttcgccgattcacgataacagaaatgagacactatgaagactcaggaaatcggacaatccggcatgattgcgtcacgagtggcgctgggtgtgatgcgcatggacgcgctggatgccgccgatgcggcacgtaccgtggccgtggcccatgattctggcatcgactatttcgacacggcggacatctatggattccatgatcatgccgcgcacgccagttcgaagcgtttcggccaagcgtggaaggacgcaggactcgaccgcagcaccatcttcatccaaaccaagttcggcatcgactacagtttcggcgaaaacgatggcggcgccaacggatatgacttcagcgccaagcatctgattgacgcactcgatcacgagcttgaggctttgcagacggattacgtcgacgccgtgctgctgcaccgtattgacacgctgtttgagttgaacgaggtcgccgaagcattcgacgcgttggaatcaagcggtaaagtgcgtcatttcggagtcagcaatatgggcccgtggcagatcgaactattgcaaagcggccttcgtcagaaattggaaatcaaccaactgcagttcggcctgatgcatacacagatgctcgacgctgaaatccaattcaatatggcgagcgatcccgcagccgatcgcaccggcggcatcctgccttattcacggctgaagcatatgaccattcaggcatggtgcccattccaatccggcacggaatacggtccgttcgtcggcaacgagcatttccccgagctgaacgccgaattgacccgtcttgccggcaaatacggttccacgcccaacggcattgccgtcgcttggattctgcgtcatcccgccggtatccagccgttgctcggctcaatgacaccggagcgcatccgccagatggcggccggtgccgatatcgaactcgaacgccgtgactggtggtcgctgtatcaggcagccggcaatccgttgatgtgattgcggaaccactcgacaacccgtgtttcactcaccggcatcatatggcacgtaggaaatcccggatatcggcgatttcctcatcacagatggcatgggccatgccggaatactcgcgataggtcagatgtccggcccgttcaaggacctgatgggccgtttgctggtcgggcagcggaatcgtgcggtcctgcgcgccatacgccaggaagaatcgggtaggggagtcaagcgccgcctgttcctcgcccatgaacgaaggactgagcaggatcgcggcatcgaacaacgtcggatgcaccttgaccagacgatacgacagataaccgccttgggagaaaccgatcaatatcttcctgcgatgggcgaatgccgaggcatccagcagtgaagccaccgcatccccgaccgccgcgcattcgcgttggcgctcgtccacgccgcagccgtcgggataccagtaattgccgcccatatagggcctcgcgtaggtggcgcggaacgagatatagctgggtacggcggcaattgcggccggggccgcatcggctcgcgtcggcgcatatacggcgtcgagaatccgcatcatctcgctttcgtcgttgccgtaaccgtggaacatcaggaaaatggggtcattgccgccggcatcgatctggcttgtcatctgcattcgcatcgtcatcacctcaccagcgagcttacatgcattagacttgtagcgattgacccaccgagcacgcaaggagcaagttatggagccgaggcgcgggcctctcaccgcaggcgagaaagtgcagttcaccgaccgcaagggcaagaagatcaccgatcagcttgtggccggcggctccacgcagaccgagcatggcctgattctgcatgacgatgtgattggcaagaccgaaggcaccgtaatcctcaccgtgcatgccaagcgcgaggcacaggtcaatcaggtctaccccgagaaagacaagaacaagccgtggaaatcgtcgcgcgccatcggcggctgggagtatgcggtgatgcgcccgcgactggccgattatgtgctttcgatgccgcgcggcgcgcagatcatgtatccgaaggacatcgcccaagttattcagctcggcgacatccgctccggcatgcgcgtgcttgagtccggtgccggctcgggcgcgatgagcgtgaacctgctggacgccgtgggcgagcgcggccacctgaccacgatcgagctgcgccccgaattcgccaaggtcgcccaagccaatgccacgctgtactatggcgaggcccccagctggtgggatctcaaaaccggcgacttcgattccgttgccgccgaactgcccgaacactggttcgaccgcatcatgctcgacatgctcgacccgtggaacaggctcgagcaggcataccgcgtgattgcccccggcggcgtgttggtcagttacgtaactaccaccacgcagatgagccgcatggccgaagccctgcgcgcggccggctgctggaccgagccgcagatccaggaatcgttcgaacgcacatggaaggcccagggcctcgccgtacgccccgaccaccagatgatcggtcataccggtttccttgttatctcgcgcgccatggcctccgggttcgaggcgctcagaaagcgcgatcgcgtgaccaaggacacacagaccgacatcgactcgctcaccgacgaacagcgtgaagcgcagatcgaggaactggaactgcgcgacatctccgaccacaaactacgtaaggtgttgcgcgacctcgaccgtcaggtgggagaacttggcaatacgcacgaataaccgccaaacgatgagtttgtgaacgctcacacacctctatactggaagcaataccacaccgccacaccgccacaccgggcagacggttcgtgaagggagccacggatgggcatcaagctgagtaaagtcgccaaagcggcgaagaaatacgaccatattctcatcatcatgaggcatgccaaggctgagccgttcggcgacaagggtgactcggagcgcgagctcaccgacaaaggtctgaaacaggcgaaggccgtgggcaagggcatcgagtcgttgggactggtgcccgaccaaatctcctgctcgtccgttacccgcacgcgccagacgttggaccgcatgctcaagacctttggcgacaagccaatcgtcgactaccgcatcagcctgtatgacgggggagtgcaggcggtgttcgacgagctcgcccacgtcaaggccaagaatcgcgtgttcatgatcgtgggccacgagccgactgtgtcgatcagcgcccaatggctcgcctccgccgactccgacggcgaacgactcgacctgctgaatttgggactttcgcccgcatccatcgtgatcatgggatcgaacaaaccgttcgacgaatggcaggtgcacagcggcgaactgctcgcggtcatcaatgtgaaagacttcgactaaagcggatataaattccatctataacgacactctgcggccatttataagggccggaatccggatgttttgctaccctaagtcgggttacgaacgcatacattggaggattcatgtccactctgacttccgtctccggcttcccccgcatcgggcagaaccgcgaactgaagaagatcatcgaaggctactggaagggtgccaacgacctcgccgccgtcaaggccaccgccgccgaactgcgcgccaagcactggaagctgcagcaggccgccggcatcgacctcattcccagcaacgacttcagctactacgatcagatgctggacaccgccatccttctcaacgtgattccgcagcgttacgcacgtctctccttcgacaaccaggaggacacgctcttcgccatggcccgcggctaccagggcgacaagggcgacgtgaccgccctgccgatgaagaagtggttcaccaccaactaccactatctggtgcccgaagtcgagtcggccgcggagatcaagctcaactccaccaagccgttcgacgagttcaacgaggccaaggcgctgggcatcgacaccaagcccgtgttcatcggcccgtacacgttcctgaagctcgcccgtaccccggaagccaccgaactcgagctcgacaagggcctggtcaacgccgtggccgccgtctacgtcgaagtgctcgccaagttcaacgagctcggcgccgcatgggtccagctcgacgagccgtacctcgtgctcgacaaggagccgggcgacgttgaactcttcaagaccctgtacaccaagatcctgtccgccaagggcaatgtcaaggtgctgctcaacacctacttcggccacatcgccgacgtgtacgagaccgtcaacctgctcggcttcgacggcatcggcttggacctcaacgaaggtcgcgaggagaacctcgaagccgtcgccaagtatggcgtggcctccaacaccaccatcttcgccggcgtgatcaacggccgcaacatctggcgcaacaactacgccacctccctcggcctggtcgacgccctgaagcaggtcaccgccaacgtggccgtctccaccgcatcctccctgctgcacgtgccgttcagcaccgaaggcgagaccggcatcccggccgaagacctcaagcacttcgcgttcgccgtccagaagctcgacgagctcaaggaagtcgccgccctggccgacgccaccgaggacgagaagaaggcatccgccgccctcgccgccaaccaggctctgttcgacggcacccgcgtggccgccgacccggccgtcgccgagcgcatcggcaagctgtccgacgccgactacgtgcgtcagcctgcccgcgaggagcgtcaggccctgcagcgcgaggccctcggcctgccgctgctgccgaccaccaccatcggctccttcccccagaccaaggagattcgcgccgagcgtgccaagctgcgcaagggcgaggtcaccaaggaagcctacgacgagttcatcaaagcccagatcgacgccgtcatcaagaagcaggaggagatcggcctcgacgtgctggtccacggcgagttcgagcgtaacgacatggtcgaatatttcggccagaacctcaacggcttcctgttcaccaagaacgcttgggtccagtcctacggcacccgttgcgtcaagcccccgatcgtctggggcgacgtttcccgcgccaacccgattaccgtggaatggtccgcgtacgcccagtccaagaccgaccatgtgatgaagggcatgctcaccggcccggtgaccatcctcaactggtcctggccgcgcgaggacatcacccacgaggagcagaccaagcagctcgccctcgccatccgcgacgaagtgctcgatctcgaggccgccggtatcaaggtcatccagatcgatgaggccgccctgcgtgagaagctgccgctgcgcaagtccgactggcacgtcaagtacctcgactgggccgttccggccttccgtctggtgcactccgccgtcaagccgaccacccagattcacacccacatgtgctactccgagttcaacgacatcatccgcgacatcgacgcgatggatgccgacgtgatctccttcgaagcctcccgtggcgatctggtggtgctcgacgccattcatgacgcgcacttcgagaccgaggccggcccgggcgtctacgacattcactccccgcgtattccttccgagaaggagatcgaggatcgtatctacgagatccttgacaagatggacgtcaagaaggtgtggatcaaccctgactgcggtctgaagacccgtggtaacgccgagacctggccgagcctggagaacctggtcgccgccgccaaggccgtgcgcgccaagctcgacaagtagcggaaatcaccgagctccctctggatgagggagctcgggtttatgtaaggaaatcagcatgcattccccgatgttcacccttgaggtctttcccccgaagcgcaacgcgcctgttggcaccatctacgacaccctcgacggactcgaagggctgaaccccgacttcatctccgtgacctacggtcacggcacccattccgaccgcaccgccaccgcgcgcatcgcccacacgatcagcaaggaatacggcatccccgcagtcgcccacctgaccgcgctctactccgacaaggccaagatcgatgaggctctcgacatgttcgaggaagccggcgtgagcgctgtgctcgcgctgcgcggcgactacatcgacggcgagcagctggtcggcgagttcaaccacgccagcgacctcgtgtcatacatccgctccgtgaagccggacttcaaggtgtttggtgcttgctacccggaaggccactatcaggctgactcgctggaccaggacatcgaaaacctcaaaatcaaggtcgatgccggcgtcactcacctgatttcccagctcttctacgacaatgaggacttctaccgcttcctcgacaaggcgcgcgccgccggcatcaccgtgccgatcgaggcgggcatcatgccggtgcgtggcgccaagtccgtgcatcgcatggccgagcgcaacgcctcgcgcatcccggacaagctcaacaccctgctgaacaagtggggggacgacatccagtccctgcgtgccgccggcatcctctacgcttccgagcagatcgccgacctcgtggcccacgacgtggacggcgtccacctgtattcgatgaaccaccccgccaccacgcgccgtatctggcgcaatgcggaaccgttgttccgcggtacgcaaggttgacgcatatcgcggcgcggcgcatctcaatgcgtcgcgccgcacgttaatctgctggcgaaacccagagttcccccagcggccgatgggtatcatgaacgtgcaatccaaccaaagcgatggaagggagtccgttatgtgcactggtgtccgtttctccgatgatgagggcaacacctatttcggccgtaatctcgactggagtttctcatatggggagaccatcctggtcactccgcgcggctaccactatgacacggtgttcggtgcgggcggcaaggcgaagccgaacgcggtgatcggcgtgggtgtggtcatggccgataggccgatgtatttcgactgcgccaatgaacatggtctggccatcgccggcttgaatttccccggctacgcctcgttcgtccacgaaccggtcgaaggcacggaaaacgtcgccacgttcgaatttccgctgtgggtggcgcgtaatttcgactccgtcgacgaggtcgaggaggcgctcaggaacgtgacgctcgtctcccagatcgtgccgggacagcaggagtctctgctgcactggttcatcggcgacggcaagcgcagcatcgtcgtcgagcagatggccgatggcatgcacgtgcatcatgatgacgtcgatgtgctgaccaatcagccgacgttcgacttccatatggaaaacctgcgcaactacatgtgcgtcagcaacgagatggccgaaccgacttcatggggcaaggcctccttgaccgcctggggtgcgggtgtgggcatgcatggcatcccgggcgacgtgagttccccgtcgcgcttcgttcgtgtggcctacaccaacgcgcattacccgcagcagaacgatgaagccgccaatgtgtcgcgcctgttccacaccctcggctccgtgcagatggtggacggcatggcgaagatgggcgacggccagttcgaacgcacgctgttcaccagcggatattcgtccaagaccaacacctattacatgaacacctatgatgaccccgccatccgttcctacgccatggccgattacgatatggattcctcggagctcatcagcgtcgcccgatgactccttcccggctcatgccccattcggagggcatgagcgtatatagtggaatcttatggaatcgtcgatcttcaaacccagctccatggacctcatcagggcaggtctgcaagacctcgacaaggcccgcgccttgttcgaccagctcaaggcggacgacattcccgatgagcgatgcgccgaactgctgagcgcgctggcccacgcctgcgaccccgatatggcattgagcaatttcgtggatatcgtcaacgcgatgcaatccagccagcgcgatctggaacacgtcatccccgacaacgacgccctgaagcgtctggtcacggtgctcggcgtctccgacgcgatgggcaagttcatgcgcttcaagccgcagcttgtggaggcggcagcagtcgacaactgcaacagccatctgttcaatcacgcgcaacgccgtgcacgtctgctcaaggcggtcggcgcggacccggacgaaccggccatgcccgtcgcctccaaggatctggccgaagcggccacggccctgcgttccagctaccggaaccaactggccgccatcatcgcccaggatgccgtggcggacgacccgacctccatccaaccgaccatcagccgcgaactgtccgacctcgcggacgcggcgctcgaaggcgcgctggccatcgcccgccacgaaaccgagggcagcgagcacgtgcgcttcaccatcatcggcatgggcaaactcggcgcacaggaactgaactacgtctccgacgtggacctcatctacgtggtcgaaccggccgacaaggatgtggaccatcagacgctgattcgcgtgggcaccaagatgggcaccatgttacagcgcgtctgccagtccgccatcatgggcgtggccgagcagccgctgtggcagatcgacggcggcctgcgcccggaaggcaaggacggcgcgctggtgcgcgtgctctcctcgcacaagaactattacgagcagtgggccgagaattgggagttccaagcgctgctcaaggcccgcccggtggccggcgaccccgacctcggtcaggcctacatggacatgacccggccgttcgtgtggagcgcatccaagcgcaagaacttcgtctacgactgccagaaaatgcgcaagcgcgtggaggatttgattcccgcgcccctgaaggaccgcgagattaagctcggccgcggcggtctgcgcgatgtggaattcaccgtgcagatgctccagctcgtacacggccgcaccgacgaatcgctgcgcaccagcaacacgctcgactcgctgcagcgcctgtccgaaggcggctatgtctcgcgcaagcaggccgtgcgcatgtcccaggactaccgcttcgagcgcgtgatggaacatcgccagcagatctggtccctgaagcgcacgcacctgttcccggacctcggccgggcctcggtcggaggcctcgaaaagaagcgcgacatcgacgtggacgagctcaaccagaaccaggagctgcgccgactcgcccgcgcattcggcctgcacccggaagaactcgtcgacaagtacgacgacacccgccgcgaagtacgccacctgcacctcgacatctactatcgcccgatgctgccggtcaacgcccagatggagaacgaccagatcgtcctgagcgtcgaggcagcacaggaacgattcgaatccatcggtttcggcgacccggacgccgccatccgccacgtgcaggcgctcaccgccggcgtggggcgcgcggccaaaatcaaccgcatcattctgcccgccgtcttgcagtggctgggcgagggccagaacccggacatgggcctgctcaactggcgcaaactggaggagaacttcggcaccgaatccggctacctcggcttcctgcgcgactccacctccgccgcccagcgcctgtgccacatcctgtccaactcacgattcctgggcgacgcgctcaacaagtcggtcgaatcgatcagctggcttggcgacgacgacaatctgcaggcccgcacgcgcgaggccttggacgtgcagaccggctcggcgctggaacgtttcggctcgaacatcaacgagttcgccacctccatgcgcgccatgcgccgccacgaaatcgaacgcatcggcctgtcttggatgagcggtgtgatcagcgactccgacagtctcaaggccatgaccgacgtgtatgacgcgatcatcgatgcctccctgacctgggccgtgcgccaccagatcgccgagttcggcgtcgaaaccgcgccggccggcatcaccgtcatcgccatgggccgttacggcgggcgcgaagtgaacttcagctccgatgcggatgccattctcatctaccgtccggccgacgatgccgacgacggccaagccaacgccttcgccaagaaggtcgtggaagacctgcgcaacatcctgcaaggaccgacgacgctggaacccaagatcgaactcgacctggacctgcgcccggaaggcaagaacggcccgctcgtgcgctcctatgcctcctgcgaggaatactacgaatcctgggcttcgacctgggagcgccaggcgctgctgcgcgcccggtacgcggccggcgacgctgaactggcgcgggacttcctgatcaacatcgccgacccgctgcgctacccgaccacggaactgactgaagcagaattgcagaacatccgcaagctcaaggcccgcatggaagccgagcgtctgccgcgcggcgtgcgccgtgaacggcatctgaagctcggcaagggcggcttgtctgacgtggaatggaccgtgcaactcatgcagctccagcacgccggcgatatcaaagatctgcgcgtcaacggcacgctggaggcattggacgtgctggaagccaagaagctcatcagcgctatcgacgcgattcagctgcgcaaggcatggacgttgtgcaccgcggcccgcaacggcagctatctgtggagtgggcgcgccaaccaggccgatattctgcctgatgacatctattcgctgggcggcatcgccgtctacctcggctacggcgcccaccgcggccagcatttcgagaacgacctgctggccgtgatgcgcaaatgccgtgacgtatgccagcgcttgttctatgggaagaccgaaggcgaggcggctgcggcaaccaccgccacggcctccgccgcaacgcagcagccgcaaaccgcccctcgcccgcgtatgcacgtgatcgcaccgcgactggaacgaaatcgacgccgcgcgcagcgataaggcagcatattcgttggattttcaggtggacactcggtgaatgcggctgtccgaaaaatggcgtaagttagattaggtcacgcaagggtggccacctgaaaaccacgagcgaaaaggtgagccttgtctgaagaaacgccaatggtcggcaaaagcgtcgtaacgctggacggcctgtctacaaaccagattctcgacctgctgcataaggccgaatacatcgattcccaccgcaaagagattgcccatacctgcgatgggcgagtgctggccacgctgttctacgagccctccacccgtacgcgcctgagctttgagaccgcaatgctacgtctcggcggcaaggtcatcggattcgccggcgcgcagctggcctccgtgaccaagggcgaatccatcgccgacacgttgaagaccgtgtccaactacgtggacgtggtcgccatccgtcacccgaaggagggtgccgcgctggtggcctcccgcgccgcatccgtgccggtaatcaacgccggcgacggcggccacatgcaccccacgcagacgctggccgacctggccacgctgcagtcgcgcttcggccgcatcaccgacctgaccgtgggactgtgcggcgatttgaccttcggccgcaccgtgcactccctgatcgagaccctgtgccgcttcggcaacgtgcgcttcgtgctcatcagcccggacgagctcaagaccccgcagtacgtgatcgaccgcatcaacgccaccgacagctgctcctacgtggaagtgcgcgacctggcctccgtgatcggcgacctcgacgtgctgtacatgacccgcgtacagaaggaacgcttcttcaacgaagacgactacctgcgcctgcgcgacacctacattctcgacgaagagaagctgcagctcgccaagccgtccatggccgtgcttcacccgctgccgcgcgtcaacgaaatcgccgtggacgtggacgacgacccgcgtgccgcctacttcgaacaggtcaagaacggcatgctcgtgcgcatggccctcgaaagcaccgtggtgggcgacgaactgcccggatacgaaccgctcaaccccaaggaggttcaggcctgatggaagtcaccagcattcagaacggcatcattatcgaccatgtgccggccggaacctcgctgaaggttctcgaatacctgaaaatcgacccggccaaaaccaagcttgcgctcatcatgaacgccgactccaagcgttacggctccaaggacatcatcaaaatcgaagatgacaaggacatcgacctcgacgtgctcggcttcgtggcccgccaagccaccgtggacgtggtgcgcggcggcaagatcgtcgaaaagaagcagccgaacctgcccgagcacatcgtcggcgtgatttcctgcgtgaacccgcgctgcgtgaccaccgccgagcccggcatcaagcagatgttccacctcgtgcactccgagcggctcgaataccgctgcgactactgcgacgaggaagccaaactgtgagcatcaccctacgcaacatcaaggtctggaacaccggcgaggtcatcgacctcgtggtgcccgggaccgctgccgcctacttcgccgacacctccgccgtggctgacggcgccgacatcgacgccaccggcctgaccgtggcccccggtttcgaagacccacacgtccacttccgcgatcccggccagacctacaaggaatcgatggtctccggctgccgtgcgtccgcatccggcggatacacgaacgtgctcatcatgccgaacacgttgccggcactggatgggcagaccgtgtctggcccggaagcgaccggtgcaaaagaggttctggatgccggcttcgacaacgtcatcgacttcctgcagcagtacgatactgcgcatgacgttcaattgccggttcgttacgatctgtgcgtgtgcgcgtccaaggatcgcgccggtcatgaggcaagcgacgttgccgattggctcaagtacgtgcccggattcgaggacgacgccaagacgccggccatgctcacgcaccccatcaccgcaatcagcgacgacggttccgctgtgacgccggagatcctggaccaggtgctggagaacgtcaaggcctccgacctgtacctgatcgagcattgcgagcatcacgatacaggtgccgtgaacgaaggccccgtttcccgcgagcttggcgtgcccggcattccggaagacaccgagctcaagatcgtggcccgcgatatcgaagcggcccgccgcaccggtgtccacgtgcacttccagcatgtgagcactgccatctcgttcgaggcgattcgcagggccaaggccgaaggactgccgattacctgcgagaccgcgccgcactatctggcgttgagcgacgaggcgctgctcaagtacggcacgctcgccaagatgaatccgccactgcgctccgaagcggaccgcaaagccaccatcgcggccatcgccgacggcaccgtggatctgctggccaccgaccatgcgccgcacacgttggcagagaaggaactcggcttccttgaggcgcccaacggcatcatcggactggaatgcgcgtacggcgtgtgccacaaggtgctcgtcgacggcggcttcatttccgatgagcgtctgatcgagctcatgtccgttggacctgccgaactcatggggcatgtgccaaccgacgtagccgcgctggtcgaggactacgccgaacccgcgcccaccggggatgatccggatggcgtgattgcgggggagagcgacgctcagccgcagcgtgaaggcgtcaaccgactgctcgacttgagccgcgtggatgacgccgacaatgtcgacctcgtggtgctcaacgccgccgaggaatggaccgtggaccccgaacagttccactccaaggctcgtaacaccccgttcggcggctggcaggtcaccggacgccccctcgccacaatcatcggctcccagctgatgttcagccgtctgtagataacacaaggagcagcatggatcgcctgatcgaagcgattgacaacactcagaaccccagcgtcgtgggccttgaccccactgaggcgctggtgccgccgcaggtcgtggcgagctttgccgacgaggtgcgtgactcggtcgaatccccggaggaagtcgaatccgcgcagctggccgtcgcctacttcgaatacaaccgcacgatcattgacgccatcgccgacatcgtgcccgccgtcaaaccgcagatcgccatgtacgaggcgctcggccccgccggcgtggacatctacacgatgacctgcgaatacgcggcccagcagggcctctacgtgctcggcgacatcaagcgtggcgacatcggctccaccgcagccgcctacgcccaccacctgaacggcgtgggcgacttcgacccgtggcatgaggatgcggtgaccgtcaacccgtatctcggcaccgacggcatcaccccgttcgtcgaggccgccgccgaagccgacaaggacatcttcgtgctcgtgcgcacctccaacccgtcctccagcgaactgcagatgctcgacctggccgacggcacgaaggtctacgagcacgtggccgatcttgtggaaggatggggcgccgagaccatcggcagccacggctactcccgcgtgggcgcggtggtcggcgccacccaccccgaggaaggcaaggcgttgcgtgaacgtatgccgcacacgttcttcctcgtgccgggctacggtgcgcagggcggcacggccgcggacgtggcaggcatgttcgacaagcagggcagcggcgccatcgtcaactcgtcgcgcggcattatcggcgcatggaagaagagcggcaagtactccgaatccatgaccgccgacgaggcgctggaccttgtggcgagcagcgcgcgccaggcggcgctcgacatgcgcgataatctgcgggttgccgtatataggtaggtagattgtccggctgtgggctatacgtgagtgtgggctggaaaccggagccgagtgtgtttaactacctctcagtcaacctgcggttgaccgctcccctgatagggggagcttgatgtgctgaataggaatgaaatgacaactttcacccccacccatgatgtggttacggaagcgactgcggccggattcttcccgccgcgccacaacgtcgaaatcacgcaggttacggaactgaccgaccgcgtgatgcgactgacgttccgcgacccgttcatcgcctcccatgccaagcccgcccagttcgtcaacctgttcacgcacgacgacttcatgctcatgccgcgtccgttcggcgtcagcgaagtcgacggcgacgaagtcagcgtgatcttcgccgtcgtgggacacggcaccgaacagttggcaggactgcaggccggcgacaccgtcgacgtgctcggcccgctcggccgcggcttcaacctcaaggaagacgccaactacattcttgtcggcggcggactcggcgtgcccccgctaatctacgccgcgcaaaagctcgccgaacacgacgcctcctttgccaccgccatattcggttaccgcaacgaccacttcgccgaggaatacgtctcccggtacgcggactggtcgtggagcatcgacgacgccgaaggcaacgtggtcgacctgctcaacaaactggaacaaggcgacgacctgaaggcctacgatcgcaagccgatcattctgtcctgcggaccgctgcctatgatgaaggccgtggccgactgggccgccgaacgcggcatccccgcgcagctgagcatggaacagcgcatgggctgcggctatggcacctgcgtgctgtgcaccatcgacaccgtggacggccgcctcaaggtctgctccgacggacccgtgttcacccgcgaacagctcggatgggggaagtgacgatgagcgcaaacaaccagtccgcgcagggcggcgacaaccacatcaacctgtacgagccccacgtgtggaagcaccacaccaaggtggccggtctggaatggaagaatccggtcggcaccgcctccggcaccttccagtacgccgccgtccgctggttctacgacgtcagccagctcggcgccgtatgcaccaagggcgcctcgcccgtaccgtgggaaggcaatccctcgccgcgcaccgccgaatcgccggccgcgaacatcaacgccgtgggcctgcagaatcccggcatcgaccattacttggccgaggacctgcccaagctcaaggccgcgggcgcgttcgtcatctccaatgtcgccggacattgcgatgacgattacgcggcggtcgtggaaaagctcgccgactccgacgcggacatgctggaaatcaacgtcagctgcccgaacgtttccgccggcggcatgagcgtgggcaccgacccggtggccctcgccaatcttatggaccggctgcgcccgatgaccgacaagccgatgatcgtcaaactcacgccgaacgtcaccgacatcaccgtgccggcgcgcgcggccgtggaacatggcgccgacgcgttgagcatgatcaacacgctcaaaggcatgcgcattaacattcgcaccggcaagccgatcatcgccaacgtcaccggcggcgtatccggcccggccgtgctgccggtcggcctggcagccgtctatcgggtgcgcaccgcactgccggagattccgatcatcggcctcggcggcatcgacagcggcgagaaggcgctcgaatacctgtacgccggcgcgaacgccgtcgaagtgggtgcggccgcgctcttcgacccggtggccccgctgcgcgtcgcccgcgaactcgacgacctgttggacagccgtcccgaactcgctgctaaactggccgcaggacagacttggaggtaaggaacatcatggcagaaacactcgcacatcgcttcactgaattcctgttggaatccaacgcgctgaagttcggcgacttcacgctgaagtccggccgcaagagcccgtacttcatcaacgccggcgccttcgacgacggcaagaagatcgccgcgctcggcgcgttctacgccgaaaagattagccaggccatcgtgcacaacacgattccccgcaacatcgacaccgtgttcggtcccgcctacaagggcattccgctggccgtgtccaccgcgatcgcgctgaccgccggccacaacatgaccgtcggatacaccttcgaccgcaaggagaagaaggaccacggcgacggcggctggatggttggcaccccgctgaccgacggcatgaaggtgctgctcgtggacgacgtgatgaccgccggcaccgccgtgcgcgaagtcatccccaaactcaaggccgaggcgaacgtcgaggtcgtgggtctcgtgctctccgtggaccgcatggagaagaccaaggactccgacatgtccgccgtgaaggccgtggaagccgaattcggcttcccggtgctctccatcgccaacgtgcgcgagatcttcgacgccgccgccaagatgaagaaccccgacggcaccccgctgctcagccacgacatccagcagcgcgccgccgcctaccttgaggaatacggcgcctgatcgtcttcaatctaaaaaccaaaagcgggcttgcgagcccgctttttttattacgttccatgaacagcagcaccatattaaggcaaaagctttggtaaggagcgtgctatgaactggttagttgatatagggctgtttgcgctcgtggggatatgcagttacttcggcatcgagcatcatctggacagcaaagcgaacaagttgtcgcaaggtaatgaagaagaccgccgagatgctgatgcccaagtagaagcagcatgaaaatggcggaatgacgttggggtgacgccgctcatactcgggatatgacggatgaacagcctcttgaaacggagataaatgtctccagaaggccaaatcagctcccttgaaagcgagatagggttctaaactctgggaccgactcgcctgtgatgaaaacccgctcggcgtagaattaccgtaggttcgttgcattcgaacaaggaaggccgctatggggaacatcaccgacgatattcggcaacatttcgacactttcgccgaactgccgttcaccgaggcggatagcctcgctttgtcccagttggcctatgctcgcatgccggataacgtgccgcgctatcacgagaatgcagagaccgccgacggcatgatcgccacggttccgattcacgatttgctgcgtgccgaatgctatgacgacatgttcggcaaggtgtggtcgccttcgatgaatgtcgatctgttacgtgcgatgagcgagagcccacgttggaggaacctacgcgtgggcgcatacgtggacgaattcgatgccgaaaccaccaagcagttctcggcctgcgtgttcgaactgggtaacggcacgctctatgtggcttttcgcggtaccgacagctcaatcgtcgggtggaaagaggacttcatgatggcgttccgccgcccggtcgcctcgcaggaggccgccgcgcgttatctgaccgagctggctggccattgggccgggccgattatggtcggcggccattccaaaggcggcaatctggcggtgtatgcggcggccaatgtgcctagcgagattcaggaacgtatcacggtcgtatattcgcacgatgggcctggattcgatgaggcgttcttcgatgaggacgggtacgtacgcattgcgtcgaagattcataaatcggtaccgggctcgtcgatcatcggcatgctgtttgagactcgtgagcatgtggaagacggctatacggtggtcagcagcgacggtgccagcatcatgcagcatttcgcattgcactggcaagtcgatcatggccaattcgtacaggctgatggactgacaagtagcgcgcaatacctggcacgcacgatcaacggatggatggcaaaatacgacgacgagcatcgccgcaagttcatcgaaaacctgtttgccatcttcgaggctggcggatacgacacattcggcgacctcacttcgcatttgacacagtcactgccgattatgctcgccgcggcccgcaacattgatgtcgaagatcgcgacgtgatgattgaagtgctcaaaggcttcgccgcgacagccgccgcgtcggtaatcttggccaagtagtcggaggccatcaaactggttttgccagtcagtctcaatagcgcaaaagccggcccctgagatactcaggagccggcccttacttccatttccccagcggggttggcttaatcgcagtatatctcactgctgaccatgcctgttttacttactcctaatcaatgagcttgtagccgtggtcggagactacggacttgagcttgtcgagataggtttcggcggccttggagagcttggaacgctcgttcgtgatccagccgaccaacatcgtttcgtcggtgtcgagcggcacggtgacgatcttctcgttgttgaggtcgccgttgtcgatgccggtgcacaccgtgtagccgttgaggccgatgatgaagttcaggatcgtggcgcggtcggtcacgttgatctgcttgggggagtactccggccagaccgcttcctcatagaagtagaacgagccttcctcgccctgctcgtactggatgaacggataaggtttcaggtcctccatggtgatgaccttcttggcggccagcgggttgttgcgcgagatgaacacgtgcagcggcgcgcggaagagcgggtggaattcgaggtgcttctcgcgcaggagcttgccgatcacgtccttgttaaaatcggacaggtagatgatgccgatttcggactgcatgttggcgacctggttgatgatgtcgcgcgtgcgggtctcgcggatggtgaactcgtattcgtcggacttgatggagttgatcatctccacgaacgcctcgacggcgaacatgtagtgctgggtggagacctggcacagctgcttgcgcggtttggcatgcttatagcgctcttcgagcaggtcggcctggtcgagcacttggcgggcgtaggtcaggaattccgcgccgtccacggtcagggcgatgccctgcgaggagcgggtgaagatctcgatgcccagctcgttctccaattccttgaccgacgagctcagggccggctgggagacgtacagggcatgggaggcctcgttcatcgagccgcactcgacgattttgacgatgtatttcagctgcagcagtgtcataaagtctatttatatcgctagggatagtcgccacacggccggtcaccgtcgtcaaggacgggtccatagacttcaactgccgcgatgcaacgtttggcgacttacagacgtacgccgagttctgcgagcgattcgcgtgcctgcaacgcgttctcgaagaggatgccgtggatgccgacctcgttggcgccgacgatgttcttggcggtgtcgtcgaagaacacgcagcgctcggccgtgaggccgaaacgggtcagggccagctcgtagatgtcggcgttcggcttatgcatcttctccacgccggagaccacggtgccctgcaacagctgttcaaggcgcgggtacttctcgaaggccaggtggaaggtctcatgcgaccagttggtcagaccccatacgccgtagccgtgggccttcaaatccgccagcagctcgaccatgcccggaagcgtgcggggcagcgcgtccgcgtagtggccgatgtagaacttgaagatgtcggcgagttcctggccttgttcgcgtaccacatccgggtagatgtccgcgaaatcctcgccggtgtccatgcggtcctcgtagcggaagaagccgcaggggtcgtcgtcggcgcagatgcgttccacgatctcatcggggaatcggccttccaggcatgcgcgggtgttccagtccagcagcacgccgcagaagtcgaaaatcacgtcggtgatgggggagttggccatgatgctccttgtgttgttggggccgttgagtggggtctgcgatttagtatagggggtttcatacgttggctcccctctctgaggggagccaacgtacggaatcatgcgatgacgtcggcgatggcttcggggatggcgtgggccacgtcgccggccacaatcgggtggccgagcgtcatgaagcgctggcgatgctcgcggccgatcagttccggctcctgccagccttgttgctcggattcggaggcgatcgccgccgccaggccatgcaggtaggcggccgaggccacggtctcgcccgtggtggccacgtcatcctgctgggcgagcagggcgccggtcagaccggccagcacgtcgcccgcgccggcggtgcccagccaggccggtgcgctacccgacgcatagacgtggtcctcatccaccacgatggtcaccgcgcccttcaacaatacggtggcgccggtgagctcgtgggcacgcttcgcgctggccaacgggttcaaccgcacgtcgtcggcggtgtacggctcgtgcgaatcggcatgctccgcggtgctggcggcggtttcgaaccggttgagcagtttcgccatctcgccggcatgcggcgtgatcaccacctggccgggcacacgctccggcagcaggtcgagtgcgccggcatccaccacgattggcggcatgtcgtaggcgtccttgttctcatcctcgctgccgagcgcgtaatgcttgagcaatgcggcgatggtgtcccgctgcatatcgccgtcggtgccctcgacgctagcctcgggcacgccggaccccacgacccaggactgcacatgtcccttgccgatcacggcttccggcagtgcggcgagcaccatgttctgcgcgcgctccgggcccagataccggaccatgccggtgttcgcgcgggcggcggcgctggcggtgagcacggcggcaccggggtagcgctgcgagccggtcaccagaccaaccacgccccgggagtatttggaatcctcgaacctggggagacggaccgcgtcggacgcgaacgaattatccaccacctcgacgtccggatccttgtcgtcgatatcgaatccgaaatcgagcaactcgatacggccgcaggcgaacgtggcgggcggcagcaccgcgcacggcttcatcgcgccgaacgtgaccgtgaccgtggccggaatgtacgggccgggcagagaaccatcgttcacaccgacgccggatggcgtatccacggcaagtaccagcggaaaatcgcctgacgactcacggtttggcagggcgggctcatcgggagcctcgccgtcgagaccaagggcggaggcgagtgcggcggggatgccgcgtagcgagccttggatgccgatgccggtcatcgcgtcgatgatcagatgcgatttcctggccacggcgatggcggtctgcaatcgctcgccggcctcaccggcggaaaacccggacgcgcaaccgggaatatcagccgcgggatcaagcaccagcaccttgcctccggcgcgcacgaatgaggcgaatccggcctcatgcaacgaccggcccacggcgatggcggtgacgttcgcgccctcctgggccagcgcggcggccgcgaacagaccatcgccaccattgtctccggccccggccagcagcacgatcgacgtgtcctccagcgccagatcctcgtcgtccagcataccggccgccatgtgggccgcggcctgggcggccatgcgcatcagcggcacgcctttgtccagcaggggtcgctccatggcccggaccgtatcggagtcataggcgctgtgcagcagcagttcgcgacgatcggcgtcttcggtgtattccatggcaacccctttcttgtgtttgttacttgcggtccgtgtttacaggccgtacacctcgtgggcgaacttttcgaacacggggatcgagcgcttgaccttctccgtgtcgatgcagtaggccatgcggaagtatccgggcacgccgaagctgtcggacggcacaagaatcaggtcgtattccttggccttcatgcagaacgccacggcgtcgtcctccagcgccttggggaagatgtagaacgtgccgccggggcgtaccacgtcgaagccgatgccggtcagcgcatcgtagagcaggttcatgttcgtctcgtagacgttgagatcggcggtctggtcgatgaccttggccacgcccagctgaatcgagctcggcgggcagttgtggccggtgccgcgcgagatctggcccatcatgggcacgagcaggtcggcgtcggtggctgtgggattcaccgcgacatagccgatgcgttcgccaggcaggctcagcgacttcgaccacgagtagcaggtcagcgagttcgcgtagaagctggccgggtagggctgggtggcgccgtcgaacacgatttcgcggtacggttcgtcgctgatcaggaagatatcgtggccgtattcgacctgcttggcggtcaggatcgcggccagacgcttgagcgtgtccgctgaatacaccgcgccggacgggttgttcggggtgttgataagcacgacctgcacgttcgggttaagtgcagcctcgaatgcgtcgaagttgatttggaagttctcggtgtcggccggcacgatggtcagcttggcgccggcgcccttgacgtacggctggtattcggggaagtagggggcgaaggtgatgatctcatcgcccggcttggtcaccgcacgcatcgcgtgggacagcgcgcccgccgcgcccgtggtcgggaagatgtggttgccggtgtatgccatgccgaaacgttcgttgaggttttcggcgatcgcgtccttgacggatgggataccgagcgagggagagtagccgtggatggccaccggatcgccgttttcgtagaggtcgaccatggcgtcggtgaaggatttcggagccggcaccgagggattgccaaggctgtaatcgaacacgttctggtagccgatttcggcaccgcggctcgtggcgtactcgctcagctcgcgaatcacggacttgccgccaagcatggccttgtattcctcattgatcatggctgttctcctcgcatggttgtactggtatgcaccacgctactactatcgcggccggtttgcgccatttgccgcgccgtgcctaagctggctgttctatttgttctatttgttctattaactgtcgaaaccgcggaataacgccgatttccgctacagctccatgattatccacaaccgttcatagcgagcgctgtgggacggcgggcggaaaacggccgaatccgcgtgccgtcccacacctcgtgcaatccacgtttcgggaaagcaccaccgtaagaccggcgcgcatccgcatccacgacaggagccttaccggccgtaatcccgcactcgattattttttctgacagggaatcgaacccgaaacactaacccatgcacgccccaccgcaaacagcgaataaccaaatgtatgcattttcggcaccatgagcgaaggagttcgcaaacacaacagtgattggcatatacggcatcgaccggatgaacagcatcgcgtcctcataggtcaagacccactgggactcgtcgcccttgggtatagggacattgcctgtgtcatagtcgttaagcagcacaagactcggcaaatatcgttccaagatctcggcggtgccagcaatttccggttcggtggacctcgatagcaccttgacgacggcgtgaagtgcgtcaagccgcttgcgattgatggtataaccatcaacgagatgctgcttcagaactgagttggcccatcgccggaaatagatgccttccttggatttgacgcggtatccgaccgacaggatcatatccaggttgtaatgctcgacttggtatgtcttaccgtcagatgcagttgtcgcaaattttgcgacaactgaaaatccattgagctcttcccttaatgcattgccgacatgcttgccgattgttttgatatcgcggccaaacagcaaggccaattgctgtctgttaagccacaccgtgtcctcgtctaccttcacatcgaggtgcacggtgtggtccgcgctctcatacaaagcaatctgctgcttcagttcctcgccagtcatgagatcgcctttcttttttcgggcgtctgtaaatcatgtcgttgtcgtcgctaaattatgcatccagtttatcagggcagtcgaacgtttgttcgattactgtatctctcatatttgtatgactttcccgacgacgtattggctatgacggaggtaatgggcacggggataatgctgatgatgggcatttccatcatgcaaaaacctatgccccgtattgaaaaaagctattggaccaagccgttgggcttaggccatgataattgggccattgcgcggcttatccgttcgacggatgttccggatttgcgatggcgttgaattgcaattatcaaatgaaagagcaaattgtatgagcgaaaacaatgatgccaaacacgtgctgttggtgttgatcagtcactccgatttgggaggtgtgagacctactggcttttatgttgatgaggccgcacatccttggcaggtgttcagacgaatgggcttcactgtgggccttgcatccatcgctggtggcgtaccgccgcaggctggccgtcatcccggtgaccctgtgcaagagcaatttctgcatgatgcggatatatcacgccagctagtgaatacgcgcgccttggctcaagtaaacgcgaaccgatatgatagcggtgctattcgttggcggtcacggtgtgatgtgggatttccccaacaattctgtggtgaacgccgtcggccggaacatctgggagcgcggcggcattgtgccatgggcctgcggcattggtggatatgacgttgtcggatggcagttatctgattgccggcaagcaggtcaccggattcaccaacggcgaagagcaaaatctcgggtgttatccgtggctgcggcgggcgaatagaagggagattgagatagaggcaggggagatgccgggtgcatcgccggcatcacgcctccgtgaaatactcgttttcgtccgcaagccggccgcctttgatgaacaggaatcgctcgcacaactcctgcagctggagatgagcatggcgatgctgcggtcgcaagcccactgtctgagcacggcgatgagctggagcacgccgtccgggtcgaggtccacgaacggttcgtcgagaatcaggaactccggatcattgaccagcgcgatgaccaacgcaagacgctgtttcatgctgaacgagaaaccggcgggcctgcggtcacggtacggccaaagtcccacaagttcaagcaccgggcggattgggaggcgcgagcggtgggtcggacgattacagtgtgagccgaatacgttcatgaatcatcgaatcacaaggcgaggcggaccgcaagtattcgagagtcgccagttcggtcgatttcaatgacaatggtgtggacgattacgcggatatcgtggcgggtgcgcgcaaggacgccgaaaaccatccggcttacgattccggctactatcagggcggctatccgccggccgatcgcggggcgtgcaccgtacgtgattcacaacatggcgcagcggcagcgcgaaaacgactacttcgccttcaagaagcacatgacggtcaccgggcactaccgtttcgacgcttcgaaagtgctgtagagcgtactcagggcttggcggtgacggtcggagcggcgtcggcattgccggctttggctccgactgcatcagctgaatcggtgccggccgcactggcgttagcactatcgtcagcgttggcaccgccggctttggccttggcatcagccgcgctcccgccatcgatcaccagtcgcagataatcgcggtcggcggacttgcggcgcggcacgaaccgactgatgatggagtttttcttgccgcggttcttcacgtacaggaagccggacacggagaacacgaccgcgccgatgaagttgacgataagatcctccatcgtgtcgatcagaccgatgtcgaggtagccgccgaggcccaagtcttggccattgaccgtgacctgggtgatgtcgttgatgcgaatcgcatggttggtgtgcgtggggtcgagcatcaccgagctgatggaatgcacgatggcgtctttctgcatgtcgaatccgaacaactggtccatgccgaattcgaagaactcccagatcacgccgatggtcatggagaagcagaaggagacgatcgccagatacaggggcgaaagctcgaacttcacccggtcggaccggttgagcaggtcgaccagcgagaagccgatcgccgcggcgaggaagccgttcatcgtgtgcaacaccgtgtcccagaacgggaagatctcatagaacgaactgatctcgccaagaatctcggacgagaacacgaacaccagcacgatgacttccagcaccgaaggcagctcgatgcggaactgcacctggatgaacgccggcgccaacagcaacagcaacgtcaggatgcacaggaacacattttcgtagtcgccgttaaagaactggagtattgccatggcgagcaccagcatgcgcagcaccacatagaccgcgaatgagcttttgtgttcgcggatttccatgcctacggctcggctcatggtcttccagcgtacgcgccaggacggtttgcgttgtgcgtcgtgctgttgtgaccgtttccgggtcattcttgcctctttctcgcattgttctcgcgccagtctatccgaacctgcttacaggcaatcggcaagaacgggcgatagtctggccgcatgaaccgaatggaaaccgatgctgcctcgattgtggaccgcacgaatcatgcggcgatgctcgatagggccattgtgccggcggcacgccaccgcgtgtgctgattgcagtgctcgccgtgctgctgtaccgccgtatgggcatgattacaccgccgatcgtggctcatggcatgtatgacgtctccgccgccatgaccaatctgaccggaatcgccggctcctcatggtcactggtcgtagggctggcaatcatggccatgccggtggtttgggctatcgtgaggtgtgcgagataggctttgtaccggttggcagcaaatcaaaccagcgagacaacggaatgaacgaagcgaaaggaacggtatctgatgactccgattgaattgtcaacccgacgccgggttacgggactgacttcggatgagttcgccaggctgttcgtctctttgcaacgcgatgtggacggcgaagccgcgcattggagcgccacggacgtcgaatcctgggagctggtcggcccgccggtgaccgccgaacagcatcttatcgacacgttcgccgcggccaacgaattcgtggccacgcttgcggaccgtctgtaccacacgatcatgccagtcacggaagaatcggtcatcaccgcatacgctgatgacctcacattctgggcatcgcatccagaccttggcggagtgccgtgcgcattatggaacatcgccgcactgcaggcggccgaatgggcccgcaaggaaaccggcatcgcctgtgaactagacgtgcgcgaaccgctggtgtgacagctgagctcaaacatgggcgtaggtaacggcatggtttgaggactatggtgttgcgttaccggtcggaaaggatatgatggtggggcgtcatagcaaaaaagcgcgtggacagtcgaggagacatgcgcgaaagtcctccgtttggagtgaaattcgcggctatctgctgacggtgatcgcggtgatgctggtcgtgttgctgggacgcaccttcgtgttcaacgtctatgtgattccatcccgtagcatggaagacacgttgcaaatcggcgaccgcgtatttgcctcgcgattgactccgagactctttgcactgcaccgtggcgacatcatcgtgttcaaagatcccgcagactggatggagggggagcagcttcccaccaatctgatgtcgataatcgacagcaatcgttacctaatcaaacgtgtcatcggtctgcccggcgataccgtcacctgcaagggatccggggagcccatcacggtcaacggcaaacccattgatgaaagcgcttatcttaagtccggcgtgaatccaagcgacagtcctttttccgtaaccgttactgacggcaacgtgttcgtgcttggtgataatcgctccaattccagagattctcgataccatcttgacgacggcaacaatgggctagtgccatacgacgatatccaaggtgtggcgttgttccgcttctggccatttacgagaatcggcttgctcaattgagtttggcgtgaatacgcaagttgacatgtgtcgcacggcccggtgcatcctgcagtcggaccgtttccggaaccctcccccgaaatctgacgaccccctgtctcacagctatcgcacagctccgatacgggaaacgtgcgggtgattccataacgactacgtacttcaggaagtgacgtgtatcgcattatggtcatgtgttcagtgccgcagataggcgaagtttattcatgagccgaatagggccggtgaagcgggctctcactgcgttcataatacggcatatcgtgaacggcgttatcatcacagtcaggccgaattaaaggaggctcggtcatggtcgccgcatccacggcattcagcccgtcaagcacgatgacggccagtttggtggaatcgactggcctgcccagtgccgctattcctgtgcacgaggatggtaacaacggcaacggcgacagtagtgccgatggcagcggcgacgacggcggcatggtcagatcgctgagcctgtggaactacttcaccatgggattcggcgcaatcatcggcaccgtatgggtgctgctggtcggtgactggatgatcgtcggcggtggcccggtcgaggcgatgatcgccttcgtgctgggcgccgtgtttctgctgccgatcggctcgacgtccggcgcggttaccatggtcgggtcgtttctgcccggagtgctggtgatgacgccgctcttctacaccggtttcgacacgattccgcagagtgccgaagaggcaagcgaaggccttgactggaagaagttcggtatggtcatctcagcttcgctgctggccgccggcctaatcatcattggcctgcaggtgctgccgttctccccggccgcgctcaaacccacatcatgggcaatcgtggcggtgtggatttgctgggtctggcattgcgttggatcagtgcacgttcacggcgcgaatagcggtgcgccggtaggtcgcgagccgttcagtcgcgcgcgacccaaagcgtatcgaggtcgtcggcctcggtcgcctttttgcgcttgcgtacccactgttgcaggaaatacgccccatagcaggccacgatgaacacgagctcggccacgagcgcgaaccgttgctccacgtcgaaaatcaccaatacgaacgatgcggtgcacaggatgaacgccgcccaagacacgtacggatagccgggcgtgcggtatttgagttcgctggtggaatggccggactccagccaacggcgacggaacacgatctggcagtaggcgatggcgatccacaccaccacggcggacaggccggaaagcgccaccagcaccaggtacacagtcgaggcggcgatcacggaagacaggagcgccagcaggccaccggccatcgcggcgcacaaggcgagcatcggcacgccgcgacggttcgttttggcgaaccagcgcggaatcatgccttcgttgcccatcgaccacaccatgcgcgtggaggcgtacaggccggaattcgaggcggagagcacggccgtgagcaccacgaagttcatgatgtctcccgcataggggatgcctatgccgttgaacacgagcacgaacgggctttcgcccacgccggccttgcgccacgggatcagcgcgcacatcacggtgattgagccgatgaagaagagcaccagacgccacagggtggtgtggatggctttcggcacggcggtttgcgggtccctcgtctcaccggcggtcacgccgatgagttcggtgccggagaacgcgaagttgacggtcagaatcgtggcgaacaccggcatgaagccgttggggaagacgccgtccttgatgagattgccgaacatcggggcatgttggtagccggcgaccgggatgacgccgaagatggcgagcgatccgatgacgatgaacgcgcagatggcgaacaccttgatcgaggcgaaccagaattccgcttcggcgaagagccgcaccgacaaggcgttcagggtgaagatgagaatgatgcacgccgcgctccacacccatgtggggctgtccgggaaccagcgttgcatgagcaggccggcggcggtgaattcggagccgagcgccaccgtccaggtgagccaatactggattgcgatcacgaagccggtgccagggccgatgaacttctcggcatacacatggaaggagccggtcaccggcatggccacggacagttcgccgagcgtgagcatgaccaggtagacgatcagcgcgccgatgctgtatgccaggatcgtgccgatggggcccgcctgctggatggtgtatccggagctcaggaacaggccggtgccgatcacgccgcctaatgagatcatctgcaggtggcgggattccatgccgcgcttcaggttggtatgtagggcgtgctcgtctttgccatcatgtgacgactcggactggctggtttgcgctggttgattcatctgttccgaatggcttcgacggccatccgtctgaatctgcggttcctgttgcgaggacggcgactgtgccgccgtgtcggtgtcgggctgactcatgtttctctctttgccatgcgtgcgttccataggcgtcgtcgtgacggcccggaatagtatacccgcaccgaggatatagctgcgctgcatgatgctgagtcaaaatcagcttcaaggggctgatttggcgtttgccggaggtctacttccgtttcaaggggctggtcaactggcggaacgcagatagaaatggcattgttctatcgctattccgccgtttttaaccagtggctactttggcatcagccccttgaaacggaagtagatgttccgcaaagtcaaaatcagccccttgaaacggagataggcactcgcagcggctacttcaccttctggatacgcagcacgaacacggcagcgcacacggccatgacgatggagatggcgaacgccggcgtgtaggtgccggtcgtggtcttgaccacggaggtgatggtgggaccgactgcttggccgagcgtggtggccaggttgaggatgccgaggcccttaccggcctcttccttgttcggcagcacgtcgacgttgagcgcttggtcgatggctgagtacacgccgtagccgaagccggcgatgcccgcatacaggtacatgcccgtgacgctcggcatgatccacggcatcgcggtgccaatcgcgaacagcagcgaggcgatgatgactggtaccttgtgcgtgtgcatcttgtcggagatcgggccggagatcagcgaagcggtcagggaaacgaccatggtgatgatggacatggtggcgatggtgccggcagcctcggtcttggtctggtgcacgtaatcctcgacgatgtagagttggtacacggagatcatctggtagctgagcaacatgcacactcggcagccgaacgccttgtagaagtcacgcgaggtggagaacttcgggaagtggaaggagacagcgagatccttgagcgtcatcttggtgcgttccatgtcctttgaggattcctcgcgaggtcagatgtcaagcgccacgaatccggaagcccatgatcacggcgccgatgatgaagccggcttgcgcattgttgatcatgcgagagccgatcatggtgccgatgggctggccggtgaccatgccgccgccgtagaaggagtcggtgccgcacagcttaggcatcgcgattatgtgcctcgtgctcatcatccgtatctgtctattgcctctcttcttctcccaaatgcgcgcgacgcagcgtatgcaggtgctccaaccgcaaatccaacgtatccaacgcaagtacgccgcgcgtaaggatccgcgttccaaagaagccatgcaacgtgaaattatggctttgcagcagcggcataacgccaatccgctcggttcatacctgcttcgctgattcaggcgccgattctgtgctcgctgttctacacgctgcaatccctgcccgcaagcgccgccgggaatgcggaaccgttgagcggcatcgaccgcgtcatggcgggcgacatcgaatcatcgtccatattcggcgtgcgcatcgccgactcgttcggcacggtcgtctcgccgcagtcgcacgtcgtcatcggcgtggccgtggcgttgatgtgtctgatgttgttcgcgatgcagtggctgctcatccatcgcaatacgccgaaggacgccatggattcaccgcagttccgcacgcagaagctgaccgcgtttgtgttcccggccatctacgtggtgtcgggcggcaccttgccgttcggcgtgctgctgtactggctgaccaataacctgtggaacttcggccagacgctctgccaactgcgatggtttccggcgcccggatccgaggcggggagcgcaaggccgaacgcgaccatgagcgggagaaccggcatcgcgccgcctccggattgccgtctttggaagaagagcgcgcggcggccgcgcgtgaggaggcccacgtgcgccgcgagcgtgaaaagtcggtcgccagccgcaatcgcagacagcgcaagaacgtgcagctcgccaagcgttgatggcacatgggagaggttacgggggatgcgctgagaccctcgtccccggaacggttcgaagtgctaaactgcttgcactacgctgcgatgcctgagcgcaaacggatccaagaccttacgatgacaggatgaacgatgatggccacgaaccgcacgttactggaacaggcccgagaattgcaggcgctggcccagaccggactgatgtactgcaaggaccccttcgaccgggagcgctacgagcgtatccgcgcgatggcggtcgacatgctctccacgcaggttgatgcgccggccggacaggtgagtcgactgctcagcgccggatatccgacgccgaaactcgacactcgtgcggccatcttcgatgaagaaggcaggatcctcatgacgcatgagaacagcggggaatggtcactgcccggaggctgggtcgacgagaaccagtccattcggtccaacgccgtcaaggaggtcaaggaggagactgagctcgatgtgaggggcgagcgactcatcgcggtgcaggactgcgccaatcacaacgcgctgacctatccgtacggggtgctcaagttcttcgtattgtgcagccgcgccggcggttggttctcggccaacatcgaaacgacggaaatccgctacttcgaggaagaccggttgccgcggctttcggaaacaagaaacaccgcggaacaaatcgctatgtgttttgcggcccaccgcgatcccgactggatgacgctatttgagtgaaccccgtgaaggcatccgcacatgcgcgttgcgcggtgccgcctggtcatcgtgccgacggcgagcatcggttccgaacactgacgccgaaccgtcgaagccgttcctgtggaaaatccgtgtccaggccatgcagaaccaggtggccatcgtcatgtgcaaccgggtcggcaaggaaggcgatgtgacgttcgccggccaatcggtggtggtggacccgtacggcaacgtcgtcagcaaggccgacgaccaagaacagttgattatcgccgacatcgatctcacacagaccgcagcagcgcgcaaacagcggccattcctggaactgcgacgacccgaatggtacgactgaaggggcgaatgggcaataagcaatgtcacgattcgccgcacccatcagccgcattcgtgccggcctacagatacatgaccatacgcagattgcagccagctggtgcaaggcgggaatgtgaagtcattgtgcgtttgcttcgcgaagccgcgcaatgccggattcaaagcagctgctcatcattgctatggatgcgggactgaatggtcacttctcttggaccgccggtctcactgggagctagcgcgtcaccgtcgttgttccagaagcgcaatgcgccttgtcgggtctcatcgttgacggatagcaagagatctccctcaaatagtgtgcgtgctgtgcgatgctccgaacgagcatcttgatgttctgcacgaagcatgaggttcctgccccaacgatccggcatgcagtcttgaaagatgcgatgcatcgcattatgctcggccgggaacgttccgggggagaggggcatctctggacagagggatactgcgtttgaagagcgcatataggccgtatcgtatgtgaaatgtgccgattcgatgccgcgcctgatactggtgaataatttcccgacggtgacgtctgtgccgttgaactgcagggtgacgattgcttccatgatgtgttgcgcctcctgctgtactatcgaatacgttttggagtgtcttcgtcggcgcgtaatttgccgatatctgtgttaagagggtccgtcgcttgctgtacgccgtccagcagtccaagcagacgagcaatgcggaggaagttctcaaagctgccattacccgtacgcagcattttggtgaccgttggcatggataatccagcccgctcggccagcaaggctacgggaatgcgctgttgtctgcgcgccaaatcgaggttggcggatatctgacgcatcgcccgactgaccgggattggtgtgcgtgtcggcatattggcacctcctatcccaaatttaaacataaatttgtatggactagccttatgcggaggttacgccaatatacgacaagaacgaaccaacgtcagcccggaatcttttcgacgatggtgttcaaggtgtcgaaagtctcatcgatttggtccactacctgcttgccctggttgaccatttcggtgatctgttccgtgcggggttgcggcagcgcatgaatcgacgtcttgacgcgcttcaagaccgcaccggcgtcggacaggtcctgcttgatggaagcgattttgggaatggaaagcgtgccgtcggagaagttcatgccggacagcagctcttcgatattgaagtccaccaacgtgccctgcgcggcactgtcgattttgggcagggcgttggtcgcggcgtcggcggccgcatccagcatgccgcgcaccgccttcacgtccgaaccgtaatacagcacgtattcggcggcctgccatagcatgccctgggtttcgtctcgcgccgcgacgatgtgactgccagcgctgtccatctgctcaagcgcctgcttgaagtcgccctgcccgacggattgctgtgcttcagccgcatattcgcccgcctgctgcgcctcgccgatcacccgttgtaccgactgccagaacagccagccggaaacgcccgacgccagcagagccgcgaccagtatcgtgagaattacggtgccgatatgtttgcgcttagccataggaccaatgtaccttttgtcccatctagcgccattgtgttctggcctttagtccatcaaagtgtccaacagacttgtcttctctgaagaagcgcatggaaatcagttatagtcgattctctcctgtagctggcgaaaaacagatatagttgaattggactaacgggttttatgtagggatgccgaggaggacaaccatgaatcaggggagggctcgactggaacgaattcggtgatggagggctttgcgaaatccccggtcaatcgatttgctgactggttgggatggggattcgtcttcctcggagcgggtataggagcgtttctgggtgtcgtcgcgtacgttcaacactggattagctgacggcttcgaatagttctccgaccgcttctcggatttgccgggtggcatgaggttttcgaccgctcacgtagtggcggcgacctcacgctaatcagtaatacacactttgatctagcagaccctacggctaaggctaggaggccgacgatgggaaaccgcgtatggaaaggtgaaccttccgccggtggccgggccggaacggtcatcgctttgggcatcgcggcgttggtagtggcgggagtatggttcggatggactcgatactagggctatagtccggtttcgaatctgtcgcagacgttctcgatctcattttccgaggatgcgcgggcaatcgtcagcaaggacgaggaaagctttcatggggacggataccggtacgtgaaggtcgccgctgacccagaacaagtcgacggcaccattctggacggcagggattactccagtggccaactgccccaggagaacatccgcataatcaaggaagcggatgcgaccctgcgattgaacctgggaacacagctcgatgcgctctacgaccggcctcataaggagataaccaacgagggcggcacgctgatcatcatccatgatgccgattcctcggaatggcatttcttcgaatgcctcgtctgaaagctgagcactcccgaaacatatgcgattgtcctgaagaagagcccagaccaaccaagccccgattatccagataaaaagaaacccccagtgcatcacggctgagtcgaagaccgtccggagaggccctttgggggaattcttgatatatcataatgagccatgagccgacagtcaaattcaacaactgatttcctctcacggactccaaggaaaggaagtccgcgggagaaggcgctgcgcgcgtgcattaccgatgaacggcttgccacctacaattatgaggctcaaagacgttcatgcccagcgctagagctgtacctgtgggatcacgacatggccagcgcctgtatgggcgacatcgccatcctcgaggtcgctctgcgcaaccgcatggaccggcaactctccctcctcgctctggagcagaatggcactgaagactggtatatggcagggctacaattcgatgaccgaacccagtaccagattcgtgaagcgtggaaccatctcaccccgcaccagcgaaaaaatcatacgcatggccatctcatagcgtcattgacattcggattttggcgcaatctcttggaagacggcggaacaatccacacgaagtggccagaccagcgccgtgcagattatgagaacgatttatggcgcaaaggactcgataagacattctccaatgggcgccagtatgcccgtgcagtggaagaacgctggacgagaaagtacgcgctggatatcgtaaaaacagtgcatgccctgcgtaatcgggtcgctcaccatgagccgcttgtcaacggcatacctctgccgggtgagaatcgacggattgcattggagaatgcgacgcaggcgtgcttcgctctggcgatgatcctggaccgagacctacacgcatggttgatggataacagcaagatgaaacttgtgctcgaacacgagctgaagcctaatgaataggtagtgagtatcgttttcgccaatcatctcttcagtgggaatggcaatgagctgcagcgacaccaacagattccttaggatccgacaccggcacgtccggcctggtatgcgggttatggcaatgctcgatcgccaccgcgggcgaacccgtgccccacatgacatggaagtccttggatacggccgagatcatcacatcgcatccagggcgaacggatcattgtccaatacgggcgatacggatcgaccgcgccgcagccccggtcatgtcatcatgtcccatgccgctcatcgtggccacggtcgcagccggacaaaacctgctatcatgcgattacttgacacgatgttgcgcttttggccatgcgcaggttgaatgggattgcgccacgaaaggatatgccatgaacgatctgctgattatcgacatgctgcccacgtacgggctgctgttctacctgctgatctcggtattcgtcttcgtgggatgccgtggtctgcgccggaggacctcggatcgtggcctgctgcgttttgccgtaggcgcgttcttggttgtttccgcgctcggcgccgtgttcgctgcgctggtgtatatcatggcagcgcctttggcgcagccggatatggtcgacttctaccgcatgtaccggccaggagctctgatcttcctgctgggattgttcatcatacaatttgtcttcggcgtcgctgccgtgtatcggggaaagtaacctggtatatcctgcgataaacgcattggcagacacttgctgcctatctgtaaacacaccctagataaggcttgcggccgttggccgagcacagtagtagtgtggtctgctgtgtcaacaggaggagtgtgaccaatgcggctgattgagacatggctggcggaccaggaacgcgcgtttgacttgttcgcgaaattcccggcggaggagacgggattcgagaacccagcggccggcatgaatcgtgaacggttcgccgcatatgtgcgagggttgcgtgatgagtcgcttggcgtcggcctgccggacggctgggtgccagccaccaaatacattctcgtcaacgatgagggcgactatgtgggcatcttcaacctgcgtcaccggctcaccgacttcctgcgcaacggtccgggccacatcggctacggtgtcgcccgcgaataccgcggtcacggctacgcgaccgccgggctcaagctcacgcttgccaaggcccgcgagctcggcatcaaggaggcttacctgagtgtccacaaaaccaatccggcaagtcttgcggtgcagcagcattgcggcgcacgtatcgaccatgaggacaagacggaatactacacacgcatcgccacctgcacggagagcgatggcctctatgcgcgaggcgattgacggcgcctcttgcgtgtaaatggccgattatcaatcggttttaatcgatttcgcctcggtcgataaagtcgccgtcgaggaaccaataatcgtgcggatttccgcgtaacgccatgaacggcgtgagttccacgccctgtgtctcagctctgctcagcagataggctcggataatccacggatactccagcacgcccgacttgagggtgatgatttgctccactctgctgccgctgacgccaaaatccctgccgccgttcggcggtcagacccagccggctcatgttctcctgaaattcgcggatagtcgccgcgcgttgctcactgttcaaagacatggcttcatggtagcgccggacgcgtgtgggaggtcgggctgctcactggaatacgccgtcagagtagttgatcatttcgagttccgggcccatgtcttcggtttgagtcaggccggtctcatggaagccgatgtgacggtagaaaccttgggcgttggtgttgaatccggcgacccacaaggcgagccgatcgttgccgatggcgcgttggcccgcctcaaccaaagcacggccaacaccatgacgatggcaagattccaacacatatagcgaagccagttccgcagcctcggaccgtttgattggcgaacgcggcgtttgcagaagctcagcaaaaccaatcacgtggttgttctccaaagcgaccaatacgacctgattggggtctttggcgtggctgcgcgtcagtttgagcgcgaattcgggagtgatcgcatccacgatttcctgcggaatatgcccctgattgagttcgcgccacgtgcacgactgaacttgggccttttcctcaaaccatggcggctcaatcgaaacaatacgaatcgtcatgccgcccatagtaggccggttcgtgagtacagtgtcacttgttgtcatgtgattgcttggcatcaggttgtattgaccgtaatggaggccactggatcagcgccggaaactcatggaattcgggctattatgatgggagtaagaaaagcacagcacaattgaacataaagacgatctggagcattgcatgagcgtcaatacggcatttgaaaccagtgatttgcccaaagcggagtttatgtttcctgggcctgaacgcgatcgcttggtgaagctcattctggacggcgtaaaaaccgccaccgctgcgctgatgattgaatatgaggaagaggtcgaaccgctgccgtgcgttggcgcgcattcggtgttggtggattccgatgaacgacccgtagccgtactcgtcaccactgcggttgacgtgattccgctcggaaaagtcactgaccggtacgccatcgatgagggtgaaggcgacgtcacggcggcccaatggcggagcgcacacgaatctttctggaattcggcggaataccgcgatgaattcgccaacccaaactttccgttgaacgacaactcgctcatagtattcgagcatttcgaagtcgagcaacggttggagtcgaataacgcattaggttaggcgatagcaaaacttttcttcaggcaactctccgagctccgcaacatctgaaggagtgcccatgtccactagagcgacagaagcggaaagcgtattgaaggagcatatgggatatcttccggtatcggaaatggagcgtcgaggagtttcccgcacggagatttcgcgattcgtgcgtgaagccaagcttgagaaagcggcaaagggcttatatgtttcaccgaatgcggagtccgatccgctgttcgaattgcagtatcgatatccgaaagccattttttcgcatgaaactgcgttgttcttgcttggagagggggagcgagccccctgacaccgacgattaccttaccgcaatcatcaggtacggctcgtctcaagaatgaagacataacagtgagaaaggtggccgacaatcgctttgcaattggcctggcgtcggctatcaccatgttcgggcatacggttcgcgtttatgatttggaacgaaccatttgcgatttgttccgctcccgcagcacagtggatccgcaagatttgcaatccgccttccagaattacatgagatccgcgcacattgacttggtcaaactcatgaactacgctcacgaatttcggctcgtgaacgtgatgcgtccttacctcgaagcggtgatgccagcatgaatgagagtgaaatcagacccgtgggacgcttatagaaagcggtacggctatgccgcgtgactattcttttagcgatgcaatacgggcgttgtcggctttatgcgaggcgatggccacggcataatcggcagcgaagcatacgcgtattcatgcaacggcaagtcgtacatcatatgtgcatcataaggaagaagtatttacccacgcagccattcgacgattgtcaggatgcattgctcagcgaaacaatccacggcatcgacggtgatgccggcatggttcaccggcgaattcatcttgtaggcagattcagcatcttgtaggtagctggccttggcgcgaggtcattgcaatggcggtattccgatcatcgccattggaatcatctgcctacaagagcacgaaacaccctacaagatgagacgggccagttgggtcagtcccattcatcctgccggttcgcaggccgcaattgtcagtcacaactggtgtacctccctcatccatgcgaatgatacgaatcgcctttcatcccaatgatttcgctctcgtggccgatacccgcgtgccgtcatgttccgtaccttggaatcagaagtcgagagatatggtccgaaaccgaatggagcggaccgaagcagggagcattgaagatgggatttctcaagaacttttccgaaccgtttgcgttcgcgctggcattgtggccgtttgtgtccatgctgctgacggtgccggtgctggcgttgctgtatcatcgcgacaatcgcatccgactgtcgtcggccatagtggcgtatggcacggtgctgtacctgctcggcctgctgtgcttcacactgtatccgatgccggccgatgcggcagcctattgcgccgcgcaccatctgacgccacagctcaatccattgcagttcatcggtgacatccgtaccgatggtctcaccgccgtactgcaaatcgcgtttaatatcgtgttcttcctgccgttgggcttcatcatgggccgtatctggcgttggccgctgccggttaccgcagtactgtcattcgccacgtcgctgtttctggagacgatgcagctgaccggcctcatgggcgtgttcccgtgcgcctaccgtctgttcgacgtggacgatctcctgtggaacacgaccggcgcgctgatcggattcgcgctggccatgctttcgctgcgcctgattccggcgcgggtcgccgatatgacgccgaccaccacacctggcttcatgaggcggctgatcacgttcatcatcgacatgacgctgatcgggttcgccgtgatgccgacgcatctgttcgtcatgatcgtccgctcaaacctgccctcgggctccaacggctcatggcagtcgatggaaccgttcgactggaccggctcgatcctcttcctggcggcgctcatcctcttcgagggcgtggtgccatggttgcgcggcggctgcacgctcggcggcagcttcacgcacatgacgatagagacccggccgcgcgaagggtggcttcgcgtggcgttctatgtggcgcgcatggcgacgctgatcgccgtggtgtggtggcatagtggcggattcaatctgctggtgttcatcggcctcggcatcttctggctggtcaagcgtcagatgccgtacgacctgatataaaccggcgctccgctgcttggcgttacaggaaaacctccgaccactggtcgggattcggaatgctgcgcagcgggccggccaacgatacggccaatcccgctacggaacagaccacggctacggccatcaccgccgtgaaaccgagatctggctgttgcaacagccagccgaccatcgccgggcatgctgcgcccagtatgccgaccgtggtttcaaatacggcagaagcccgcccctgcatgttgtcgggtgtcttgccgtagagaaagcccagcaggccagcgttcaacgcggggaacggcaggccggccagaatctggcagatcagaatggccgcgtagctgtgcaggaatagcagtggcatctggctgaccacgaacaacgtcagcgcgcccgcaatcagtttccctgtgggaaccatatcgactagcttgttggccaacagcgagccgaccaaagtactcacgcccattgccgtgccgagcagtccgatcatgaccgcgttggcgccacgggcggccaacatgatctgcgcgccggtgatactggctacgcaggcgatgttcacaattgcaccgagtatgatcgcggataggaaattccttttggtcagggcccatcgccagccttcgaccaagtgcgtgggaaatggcacaacagaagtgccgtgggcccaaacggcgaccacggcttagcgcgacgagtcaacgcgcattagctgtctgcgaacgacaccaacaccttgtgcataacaatgcccctttgcaaaaaaacaaactccaattattgtaccagttcgagcatagaaccaggcgcgtcactgggcacaacataatcggccatcaatggtttctcggcttcgaggggctgatttcgtccggtggggacatctacttggctttcgaggggctgctcaaacgccaaaccgcgagtataaacggctttgcggcaacgccattacgccattgtggagccttgtctactcgggcatcagccccttgaaacggagatagatctccggcaagtgccaaatcagcccctcgaaatcgagttaggcgttgttttcgcgtttgcgctgccgttcgagtgcgtaataagccgcgtagcagcaggcgacgaacgggatcatgcaatacagggtcgaacgctgcgtatcatcgagcaccacgagcaccagcgcgccgatgcacatcacgatggccagccacggcagcaccgggaaaccgggcgcacgatagccgagctcatcggcgctgtgcccatcccgcgcccattcgcgccggaaacggatatggcacacgcatacggagaaccacaccaccagcgtcgccaaacctgacacggcgaccaacaccagatacacggtcgaggcggcgatcacggaagacagcaacgccagcagtgagcccgccatgctgaacagcacggcccacaccggcacaccacggaaattcgtcctagcaaaacgttcgggaatcagccgctccttggccagcgaccacaccatgcgcgaacacacgtacaggccggagttcgcggcggaaagcacggccgtcaacaccacgaagttcatgatgtcgccggcgaacggcataccgattgactggaacaccagcacgaacgggctcgtatccacgccggcctgatgccaggggatcaaggccgccatcaccagaatcgagccgatgaagaaaatcgccaggcgcagcaccgtggtgtgcacggccttgggaatcgcacgcgagggatccttggtttcgccggccgccacgcccaccacttcggtgccggagaacgcgaacaccacggtcagcaaagtcgagaaaatcggcgcgatgccgctcgggaaccagccgccggccacgaagttgcccagcaacggcgcggaatcatgaccggcaatcggtatggcgccgaagatcgccagcaggccgatcacaatgaacgcgatgatggcgaacaccttgattgacgcgaaccagaattccgcctcgccgtacagccgcacggacatgatgttgagcgcgaacaccaccacaatgaacacggccgaccacacccaggacggcgaatgcgggaaccatcgctgcatcaacagccctgcggccgtgaattcggaggcgagcgccaccacccagttcagccaatacaggatggcgatggtgaacgcggtgccggggccgatgaaccgcttcgcatacatgtggaagctgccggcgtacggcatggccacggacagctcgcccaacgacaccatcacgcagtagacgagcagggagccggccgcgtaagcgaggatcgcgcccaacggtcccgcctgatgaatcgcgtagccggagctgacgaacaggccggtgccgatcacgccgcccagggagatcatcgtcaggtgacgcgactccatcttccgttcaaggccggtatcgtccttgggtgtgccggctgccgccatgctcgggtctcctttggtcgggtgaacagttgtgtctcgtgtcggttgtgcgggcggcgctcgatgccgcctaccatatgatagcggtaacacgaacagcgagtggaacacgaggagtttggaatgatggaactgtatatcggatcgcatctgtcgacggccggcggatggaatgcgctgctggaacgttcccatgaggagggcggtaccgcgttcgcgttcttcccgcgttccccgtacggcaagcgttcgaaggcgctcgacccggccggcgcggcggcgttcggtgcgcgtctgaaggctgagggctatgggccgttggtcgtccatgcgccgtacgtctacaatctagccggcaaggatgaggccaagcgcacattcgcgatcgaggcgttggccgaggacatcgagctgctgaccgccatccgcgaggccggccaggaggtgtatatcaatattcatcccggcgcgcatgtgggccaaggcaccgagaccggctgccggctgatcagcgagggactgaatcaggtgttcgagcgtacgaccggcgtcatggtgcttctggagaccatggccggcaaaggcacggaatgcgggcgcaacttcgaggagctcgccacgatcatgaacggcgtggagaacaaggcgaacgtcggcgtcacgttcgacacctgccatgtgttggatgccggctacgatttggtgcacgactacgacggtgtgatgcgccagttggatgaggcgatcggcttggccgaggtcaaggcgattcacgtgaacgattcgcagtttggcctcggctcgcataaggatcgtcacgccaacatcgggcagggtcagctcggcatcccgttcttcacgcgactggtcaacgacccgatcatggccaagctcccgatgatcctcgaaaccaaggagcagacgcccgccacgcatcgcgacgagatcgagttgttgcgcggattggtgcaaaagtagtcgtagtcgaccaatgtcgagcagaagagacctgtttttggctgagggccatacgaggttagctatcagcggggcgttgattgatccgtcttcatatacagctgcatagccggttccagctgcaagagctcaaaacagacgcatgggttcggtggaatccaatggctgaataagacgtttgccgtcgctgttcagtggcgcgacttcgtgaaattgcagacgccgggaaagcatggtacccgcttcccgcatggaatctaacagtgcggctccgtcaacggagcggtccagccatgaggcaaccatgttccgaggagccagcaggggcatgcgatcatgcaccttgacgaactcgtccgcggcagggcaggtgatgatggttgcggtcagctgccatggcgatgcgggagacggcctccaccatgagtacaggccggccaaagacaatagttcatcatgtggcgcgtgaaaatagaacggcctgcgacctttccattcgtagtagccggaagcggggatgatggctcgcatggattttgtggattcggtgaacgccggcttgacatgcgcagactccacacgcgcattatatgtggggtagctcagcactttgctggcgctccatcgcggcaccagcgaccaataggcaccggtcagatgacggcggccatccttgccctgtgccaccacgccaatgttctgcgtgggtgcgatgttgcaggaaggctgtggcagagtgtcaacgcgcacgtcatcctcgtctaccgcgaactgtgaggccacggcatcccaatccaagtcgagcgcgaatctcctgcacatgcgctcagtttatgccatcaatggaatcaatcccaggccgtatgaccgatattcatggcgattttcctttttgttggccgctctggttccgtagcgatacgaaccaacgaggaatagcccagaatgtaggacgggttcggcaatcgggacaggacgtgacctagagtggcgcatgaccgaacaccaacaaagggaggaccatgtcggttttggacgaactggtggcgggagcgctggaggatcagcgcgcccgtgagctcaccgtatcgcttgaggacgtgaagaaggccgcgctggcggccccggctccgattgacgcgacacgatggcttaagcgcgccgacggcatccccgtgatcgccgagatcaagcgcgcgtccccgtccaagggccacctgtccgacatcccggacccggccgcgctggcccgcgagtacgagaggggcggcgcaagcgccatctccgtgctcaccgaaggccgcagattcctcggcggccttgacgatttcgacaaggtccgcgccgccgtgcacattccggtgctgcgcaaggacttcatcgtcaccgactaccagatcttcgaggcccgcgcccacggcgccgatctggtgctgctcatcgtcgccgcattggacgacgcccagctcaagcatctgctcgacctggcgcacgagctcggcatgaccgtgctggtggagacgcacactcgcgaggagatcgaacgcgcacgccaggccggagccaaggtgatcggcatcaacgcgcgtaacctgaagaacctcaaggtggacgtgaacaaatacaacgaactcgcggccgatctgcccgataacgtcatcaaggtggcggaatccggcgtattcggcgcggtcgaggtcgaagactacgcccgtgcgggagcggacgcggtactggtcggcgagggcgtggccaccgccgatgatcatgaacttgcagtggaacgactagtaaaggcaggagcacaagtgaaagcatccgaaacgaccccgctcagcgaacatcagggaccgtattggggccagttcggtggccgctatgtgcccgaggccctgatcaccgccctcgacgagcttgagcgcgtctacaatgaggccaaggccgaccccgaattccacaaggaattcatgacgctccagcagcgttacgtgggccgcccgagcccgctgaccgaagccccgcgcttcgccgcactggtcaaggagaagaccggtctcgacgcccgtatcttcctcaagcgcgaggacttgaaccacaccggtgcgcacaagatcaacaacgcgctcggacaggccctgctcgtcaagcgcatgggcaagacccgcgtgatcgccgagaccggcgccggccagcacggcgtggccaccgccaccgtgtgcgccatgctcggcctcaagtgccgcatctacatgggccagatcgacgcccgccgtcaggccctcaacgtggcccgcatgcgtatgctcggcgccgaagtggtcgaggtgacccttggcgacaagatcctgaaggacgccatcaacgaagccctgcgcgactgggtcaccaacgtcaaggacacgcactacctgctcggcaccgtcgcgggcccgcacccgttcccggccatggtgcgcgacttccagaagatcatcggcgaggaggccaagcagcagctccaggactggtacggcatcgaccatccggacgcgatctgcgcctgcgtgggcggcggctccaacgccatcggcgtgatgaacgccttcctggacgacgagcgcgtgaacctctacggctacgaagccggcggcaacggccccgaatccggcaagcacgccatccgcttcgcccccggcaccggccagctcggcatgttccagggcgccaagagctacctgctggaaaccgacgaaggccagacgctcgacacctactcgatttccgcaggcctcgactacgcttccgtgggccccgagcacgcatggctcaaggacattggccgcgtgaactacagctgggccaccgacgaggaggccatgaacgccttccgcgacctgagccagaccgagggcatcatccccgccatcgaaagctcgcacgccgtggccggcgcgtacaaggccgccgccgatctgaaggccaagggctatgacaaggccgtgatgatcgtgaacatctccggccgaggcgacaaggacatggccaccgccggcaagtggttcggttatctgaccgacgaccaggccgccgcgctcgatgtggccggcgcccacggcaatactgtcgcctgaacaagaagaggagatttttgattatgaccaatgaagcaaccacgccgtccggccagccgctgggcatcagccacaagcccagcaagtcgggcgctatgttcaccaagttcaaggccgagaacaagcccgccttcatcggctacctgccctacggcttccctaacccggacgtctcgcttgacgccttcaggacgatggtcgagcacggcgtcgacgccgtggaaatcggcctgccgtactccgacccggtcatggacggcccggtcatccaggctgccgcctccatcgccctgaacaacggcgagaccatcaagcgcgtgttcgaggccgtcgaaaccgtggccaacgccggcggcgtgccgctcatcatgagctactggaacctcgtgtaccactacggcgtcgagcgcttcgcccacgacttcgagaacgccggtggcgccggtctcatcaccccggaccttatcccggacgaggcgggggagtggatcgaagcctccgaccgccacggactcgaccgcatcttcctggtctccccggactcgtccaccgagcgcctcgaaaccgtggcccgcaacgcacgtggcttcgtgtacgcggccgcccgcatgggcgtcaccggcgaacgcgccaccatcgacgcctcgcccgaactcctcgtggaacgtacccgtcaggccggtgccgagaacgtgtgcgtgggcatcggcgtgtccaccgccgaacagggcgccaaggtcggctcctacgcggacggcgtcatcgtcggctccgcgctcgtgcacaccctgctcgcggacgacaacaagaccgcacgcgacccgaaggaaggcttgaagctgctcgccgccaagagcgaggaactggccgaaggcatccacaacgcccggtaaacacccggtgcgcctcacgcgggttgtgccgtgacacggtagggtagtcacagagcgtcaagcacaacccgcgcgtggacacacaccatgagcaccagcaagtagaggcacgatgaatctggcttatattccctcgccgaccttctccaagttcgagatcggcccgttcactatccacatgtacgcgatctgcatcctgatcggcatctgcgtggccgtatggatcctcgccacacgttggaagcggtacggcggcaccttcgaccagattctcgataccacgctcgtcaccgtgccctgcgcactggtgggcgcgcgcctttaccactgcatcaccacgccggccgactacttcccgcccaccggcaacttggtcaacatcctcaaggtgtgggaaggcggcatggccatcttcggcggcatctccgtcggcaccttggtggcgttcctgtggtgccgtcacaagcactatccgttcgcgatcttcgccgatgccatcgcccccgcgctgcccgtggcccaggccatcggccgactcggcaactggttcaaccaagagctctacggctggcccaccacgttgccgtggggcctgaagctcaacgacgcggacgccatcggcaaatccgaaatctgctattctggcgcgcaatgcccggactacaggaccacgctgttccacccgacgttcctgtacgagatgatctggaacctcattggcgccgcgctcatcatctacctcggccacaagcttgccgaccggctcaaggccggccagcagttcgccatgtacctgatgtggtacggcctgggccgcacctggatcgagaacgtgcgcatcaactattccacggtgatcctgggcctgaggaccaacgtgtggaccgcgatcatcgtcttcgtgctcggctgcatcctgttcgtcgtgctctaccagtacgggccggaccccaaggcgcaggcgcgcgggcttgcggcggtcaccgccgacgagctcgaacgccagagcatcgaagaggaacaacttcgccagaaaaagcaaaccaatcgcactaagtgacaccacgataaacagcgccgaaacagcgcgaaacacggggctccaagtcccattgcacagataaggtaggaaaccatgagcaatatcgcaatcgcacccagcatcctgtccgctgacttctgcaacctcgaacgtgatctcaaggccatcgccaacgccgacttggtccacgtcgatgtcatggatcatcatttcgtgccgaacctgaccctgggcgagccgatcgtcggccgcatctgtcaggtcaccgatctgccggtcgacgtgcacctcatgatcgaggacccggatcgttgggctcccgaatacgccaagctcggcgccgcctccgtctccttccacatgggtgccacccacgcccctgtgcgtctggcccgccagctgcgcgagatgggctgcaaggcctgcttcgccgtgcgtccggccgaaccggtcgagccgatcttcgatatcctcgacgagttcgacatggtcctcatcatgaccgttgagcccggcttcggcggccagaagttcctcgacaaccagatgtccaaagtccgccgcctgcgcgatgagatcacccgccgtggcttgaagacccgcatccaggtcgatggcggtgtgagccccaagaccgcgcacatcgtggccgaggccggtgccgacgtgctcgttgccggttccgccgtgtacggcgccgagaatcctgcccaagccatcgacgacatccgcaccaaggccgaggccgcgttcaaggcctgagctccaagcctgaaccgcaatccacctttcattcataaccacaagaaaagaatctgaatcacatgaagacgtttgaatccctgttcgccgaactgtccgaaaaggcccagacccgccccgaaggctccctgaccgtcgacgagctcgacaagggcacccacttcatcggcaagaagatcatcgaagaggccggcgagacctggatggccgccgaatacgagggtgcggaccgcaccgccgaggaaatgagccagctgctctaccacgtccaggtcatgatgatcaagcacggcctgacgcttgaggacgtctacaagcacctgtgagaggaacgcaaatgctgagaatcgcagtgcccaacaagggcatgctatccgaacccgcgtggaacatgctggccgaggccggctaccgtctgcgcaccaaccctcgccagctggtcgtgcaagatcccgacaatggcatcgagctgttctacctgcgtccgctcgatatcgccgtatacgtgggccgcggcgccatcgacgtcggcatcaccggccaggatctgctcaagaactccggtaccgccgcgctcgagcacatgccgctcggctttggtacttcgaccttccgtttcgccgcaccgaacgaatccccgatcaccaccctggaggatattcagggcaagcgcgtggccaccacattcgataagcttgtacacgactatctggtcgagcacggcatccaggccgagaccatccatctggacggtgcggtcgaatcctccgtgcagctgggcgtggccgacctcatcgcagacgtggtctccaccggtaccaccctgcgcaacgccggcctgcgcgtgtttgccgaaccgctcatgcactccgaagcttgcctgattcgttcgccgcgtctgaacgagcaggacccacgtctggccgtgctgacccgccgtctgcaaggcgtgctcactgcgcatcagtatgtgctgatggactatgacattccgatcagcaaggtcgccgccgccgtggccgtgacccctggctttgaaagcccgacgatctccccgctgcacgacaaacagtggaacgccgtgcgagtcatggttcccaaggccaaggtcaaccagctgatggatgatttgtacgaagtcggcgcacgcggcatcatcgttaccgctctgcaagcctcccgcatgtagactgttagtcgatatgaccaaccagaaagtcaacgccagatacagtccggaagcacgtgacatctatttcactgtgcccaatttgatcagcgcgctgcgaatcatctcgattcctttcatcagcgtgctgatctccaagcacgagatgattgcggcgctagccctgatcgccatttcctcggcttcagacggacttgacggcatcatcgcgcgcagattcaaccaagtgagcaagatcggtcagattcttgatccgatcgccgaccgactgctcattttctgctcgattctggctctcagcgtcgccggcatcatcccatggtggatgctgattatcgtgggactgagggatctgtggatggcgattcaggtgctatggcttgcccagtacggttatggtccgctgcccgtgcatttcgtgggcaaggccggtaccgcgctgctgatgatttccatcgtcggtctgattttcgccgatttgtgcaccagtacgtttttccacttgctctacatcgccgcgctggccgccggcatctggggcatcgccatgtattggctcgccggatatatctataccaagcagggcgtcggattgctacgcaaggaactggggagaagtatggcgcttgaggccacggccccggtctcattccccgtacccaaggagaatgagccggtacgacgccgcgccgtgttctcccactcagtccgaggcgcggaatcacatcatgcgctttccccggatgacgccgccgccatccgcaccagacgtcgccgtaaaaccaacgacgattcgcttcagctcatcgatgatcttgtcaatcgtccgatggatccgatgttctccgactcacgactggtccatgagcatcgttcgaccttctccatctggtttaatcgcatcgtcgtattcatcatctgcgtcggcgttggctttgcctgcagcctattcgtgcaacagttgcaatccgatccgcgtaagcaggtacggcagactttggccacgcaattggagaatcgcaactcgcaaatagacgaactcaccacggacgtcaataatttgcgctcccaagttgacgaacagtccaagaaaatatccggcagcgtgaaaagcgatacgcttatccaagacgaaatggtcaatggtgccacggtggtcgaaggcgaaggaatcaccatgacgctggccgatccaatcgcggcaagccagtcggatcaatcctcctcgacgagagtcggcacctccacgaacatccgagtcatcaccgatctggatctgcagcaactggtctccctgatgttccaaaacggagccgaagccattgccatcaacggtaataggctcggcgcgcaaacctcgatacgcaaggccggcgggcatattctcatcggcatgaccgcgatacaaagcccctataccattgaagccataggcgataagagcgccttggccgaagcgatggggaagaagaaacttgcaagtctttacgattccttcaaggaagccggtatctacccgcaggtaagcaaatccaattcgattacacttgaggcagcagtcactggcgaagtgaagtacgcggaaaggaatgaataatggcagccgttctgggactgatcatcggcgtcgtcatcggcgtgttcgtcaagccggacattccgatcatcgtgcagccttatctgccgattatggtggtcgctgctcttgacgccctgctgggtgccgcgcgagcctatttcgagcgcagcttctccgaccgcgtgttcgtgatctccttcctcgccaacgtggtgacggcaacactgctcgtgttcctcggcaaccagctcggcgtcggttcgcagctgcagacagccgtcatcgtcgtactcggcatccgcatcttctccaacgtgtccgcgatcagacgcttcatcttccgaggctgacaagggtactgacgtatggcacgtaaagcacaatcagacaacatgctggagaaaatgcgcgaccagcatgtacaagacaaggtcaacgaccggatggaaaccgggtcgtttcccacggtgcgtaagaagccccggaaggatctcaaccgtgccagcaacaaatcacggttactatcctcgattctcatcgctctgatgtgcgcgttgttgggtttcgcctacatgagccagatcaataacactaaatccacgtacgaaacgatggacgagagtgaactggtaaggctgctgaacgagtcgaatacgcaaatctccaatctcgagcagcgtaaaacccagttgaacagccagctcaactcgctgaaatcggcggctaacgagcaggagcaggcgcgtaagatcgccaagcaaaacgaggagaccagcggcttgatctccggcagactcccggcaaagggtcaaggcgtgaccatccgaatcggacgaggcttgacgactaaagtggacgcctcaatcatgttcaaccttatcgaggaacttcgcaatgccggtgccgaggtaatcgccatcaataacgtgcgcgtcatcacctccacctacattcaggacgccgaggaaggtttgattgtggatggcaccaccatcaagcccacatacacggtgaaggccattggcaatccgcaggaactgtccaacgcagtcgatatcgccggcggtgtgggcgctcagctccaggtgaaatacgggtccaacgtcaatgtacagccttctgacagcatcattatcgacgaagtacgcgaagctacgcaaaaccagtatgcaaagacggtagaataggggattatgaccaacccgattcctagcgcaggcgaaaccaccattatcggcctgcccgcgattaatgtactgcccattaccaccaccggcgatcgaccgctgactcaagaggatctggacaccatcaccagattgtccgagggaacggcattgctgatttccgccaggggagcggtctcaggttctcgttacttgcttgacgaggatgaaatcaccgtcggccgtgatccgcgagctgatattctgctcgacgactccaccgtatcccgtcagcatgccgtgttccgcagggtcaacggtcagttctttgtggttgacgcaggaagtctgaacggcacctacgtgaaccgtcagcgtgttgatcaggcgccgctgaagaacggcgacgaaatcatgatcggtaaattccgtctcgtgttcttcacgaaatccgccattatttcccaatagtccacacccagcacggggttagactgattgcagaaattgcaatcatgtgattacaccagtgtgagtcacatgcgagacacgcatgagttaggggagtgccatgggacagaccgggctgcatcttcatgtttcgcttgaggaccgtcagaatctgaacgctgacgcgattcaggggagttgttctccaacgtcgatactgaggagatcaagcgcggctaccgtggcactgtggcctccaaggtggccggcatcacgtaccgacagctcgattattgggcacgcaagcagattgttgagccgtccatcacgccgtctcatggctccggttcacgacgactatactcgtttaaggatgtggtgattctcgctgtatccaagaagttgcttgatgccggtgtgaatctgcagaacgtgacggcggccatcggattcttgactcaacgcagcaccgatcagctggccaatgtgaccatcatgtgcgatggtcaaaacgtacatgaatgcacaaccagcgaacagatgctcgaactgttgcaaagcggtaaggcagtgttcgccgtgtcggtgggttcgttgtggcaccagattgagacggccttggaacaggaagaatatgttgatcttgaggccaagccgctgacgattgccacgggccgtccgattgatgaactgaccgccatgaggatgcgcaagaagctcgaggcacagcgcttgcgacgcgcaaccgcctgatacatgtatggttgttggcgacttgccggctttggtcggcaggtcgctttgttgtatgtgttgcttttattgcctgccatcttatgttttttatatgttgcggtgattattatgactgattggaggatcgggtgaacgggattgttgtcggattgttgccgggcgttctgtggatggtcgccgtcatctttgctgtgtccatcatcactataacggtcagccgaggccatctgttcacgccgagacgccggcgaccgccggtcgatccggtcgactggtcgatggtgaaaacgcatttcatgtcgtttgcggcggcgctgattccgtttcccgtgttgacgttcaccgcagatctgatggatgctcgcatgctcgcgttctacgaccacgcgcaattgcccggagcaatcatcatattcgtgctggtgctgctggaactcatcgccatgtatctgcaggcacgcaacgcctcagaaaccgaaatggataggcgtttaggtgttgcttctcaccggaataaagatgatattgaataaccgataatgtacgttatgtcagattaggttttcggaagaaaccgggaagtggccaaaatcagcggaaaacggcgggataacgccgttcttcgtgcgcgcgtcatggaaggacggcactcccgtttacggctatatccggctattttcggctggaataggcacacgataggcacacgttcggtacacgcaccacgccgaccggaccgggccgatacgcataccgggggttgtcatcacacgacgaacccggaaggcgacgacatggcggacacaggcggacacgcgacaagacgagacaagggagccggcgcgatcacgaaactcggcaacggcagataccgggcgttcgtcgaactctcccccaacccggccgacggctccagacgacgcaccagcgccaccggccacacccggaccgaagccctgaacaacgcccgcgccaaagcccgccgcatcgaggaggacatcaccctggtggacgaaccgcccaccgtgaacgaatggatgcgacgctggatcgacgagatcgtgacccccagacgcgcacccaacacgacccggtcataccggttccgcatcgaacacgacattacccccgtcatcggcgccgtacgcatggacaggctcaaacccgcccacatacgcctcgtcgaacgccactgcctcgaaggaaaccccgcgaaaggcatccagggcaaatcccccgccacggccgccctgacccacaccgtcctgtccgaggcatgcaaggccgccgtcgccgaaggcatcatccgcagcaaccccgtggacgcggtcgagaagaaccgggtgccgcccgccccaatcgccaccctcacccccggacaggccgccatgctcatccacgccgaaaccgacccgcgatggagcatcatctggcggctcctgttcatcaccgcactgcgcgaaggcgaagccctgggcgtcacgcgcaacgagatcgtccgctccgacggactaccctgcctgctcgtcgaatggcagctcaaggaattcgacggcatcacggacatgcccgccggcttcgaggcccgccggctcgacggccgcacatggctcaccagacccaagaccagatccggacgccggctcatccccctgcccgccgacctcgccgccgacctcgccgcctatacggccgaccatcccgacatcgacccggacaccccattgttccgctccggccgaggcaaccccatccgcaaggaaacactccagaacgcatggcgaaaagcgttggaacgggtgggactgccccgcgtgcgcgtccactccgcacgccacacggcggccaccgccatggcgcgcatcggcgtctccgacctcgcccgccgtgccatcatcggccacgccgacatcggcaccacggacgccatctacacgcacgtggacgccgacatgctcgccggcgccatcgacggcgtggaacgcctcatcgaaggatagtcagtcgatcaccgcgagatcgacgagcccgtcgcccgtggacacggccgcgcccccagtggtcgattacgacaatcactccgcgtaatacgcggccggattgttctgcaggtcaatacgccgccatgctttgaccagttcgacggtaggcgcgtaccgttcgatggccgaccggctaccgtcgtaccgtccggccatatcattgtcaaaagagataacagtgtctgccatgatatgacgcgcttcctttgccgtaatggcctcgcgatgccaattaccgtcaaaaacgtcgtcggcaacccaagcgtcacgttccgccatcgagtcaaacacgtagagattgcccggccatgacccgtcattccatgtcgtgccgataccgtaggtccaagaaaaagtgtaataatagcgagttttaaacatgatgcacactcctcgtatcgtcccgatatcatcgacacgggcatgcatgcgtccccggcgatgtcagaacagcaccggggacgtcggcctcgccatccggcgggcgatgagccgcacgtaatccgaatccatctccgccgccacgcaacgcatgttttcgacccggcacgcctccaacgtggcgccgctgccggcgaacggctccaacacgagcccgtccggcggcgtgaccagacgcaccagccagcgcatcagctccaacggtttcaccgtcggatggcggatcccgtccaccgtcggcctctcccccggtcccgccttcggacaataccggaacacgggatagaagcgggatgcgccgcccatatcgtcatattcggcacccgtatgggtcatgccccagccgtcaccgggtttcgtgcttgcgcgtgatttgccttttcgactgacggtgacgccggactgccggtcaagctctccggccatggtccggtcgaacagcatgttcggcgcgaaccgggcgtccgccttatagtcggtgcgattcgcattatccgcgccgtatacatggttgtcccgcggtccggaaccgaaccgtccatgccggttcttgttcttcgcctcggtctcatccgccgggttgcggaatgggacgcggcatgcgtcgatatgcaacgcgcccgtcccgtgtccgagcagattgtgggcgagtgtcccgtccaacggcttgcgtgcgaggcagatgggttcgtgcgcgggcttcagctggctgtaccagccggaccattgttcgccctgttcggtggcgggcgcatcccattcggatttcgccttgccgccgttcgcggtgctggaacctccgaagccgttggtgtccgaatatcctgcgccagcatgacctttaccggccacatgggtgcgttccgcacccaattccctgtccacgagcagtctcgcatccgaaccgtgtggcatgccgcttgcgtacacccagtcgatctggtcgcggatttcgaagcccgcgtcctcgatcgcgcaggcgagccgatgatatgtgcggctcgcgccgaacgcggccacatgcccgcccggcttcaggacgcgcagaatgtccttccacaggatcacgtcgaatgcgatgcccgtcgaatcgaagcccaggttcatgaaaccgatctcgtacggcgggtcggtgacgacggaagccacgctgttgtccggcagcatggcgatgaggtcgcggcaatcccccggcatcagacggatgcggccgtcatcccatcgcataagactcatggcttcacgtatgcgttcccgccatgcaggcgcgcgccgggcatgagcgcgcggggacgcgcatccacgtaggcgagccgacggctgtcgcccggataggtgcgcacgttgccgcccccatcccgggtctcataatagacgaccgtcaccggccggccgttcaggctcgcatcatcccagccgaccaccctgaccggcatgctccccggcccgtagccgcccgacaggagaagcctggcgagcagcctctcctccatatcgcgtctcgaaacaaccatgggaaccggtatgcgtcacccgacaccatgcaaatccggagggcccatgcaattcttgttccatatgcaattccgaacccgtttcttaatgtccggatcacgtcgcaagccgttgttccggcatgggaacagggcgcgggcttcgatggtcgtatgtcatggcctgccgctgatgtcgagcgtcgccatcgtatcggcgtcctcgccgtccgtgatatatactccgatgatgtattttcttccggccatcacgtcccccagccgaccgggatgtccgcgcttttcgccgtctccaacaggagccggaacagctggatggtatcttccttgccttccatggggtcgaaccggatgccgtcattctccgccatggcggtctccaacatggaagccacctgactgtccgcgccgacgaacgcgaacccggaaccggcttccacccactcccggcggcccacgtcccaccgcaggttcagataccggccgaatccacgatgcatgtccgcgccgatccacacggaacggcagcagtccaggaactcggatgacgtgacatccacgctcaaccccgattcgaccgaaccggacacgaacgggatgcgagccgccagcatggcggccaacggtcttaaccatttcgcatcaccgccggacgcgatacgctccccatccacgatggattcggcgatatgtccgaacgcctccacgatggccgtggaatcgtcggcgccggagggaatgtccccttcgccggtcatgcgggacacgccgtccgggtcgaactcccaatcgtattcgactggattgttacaggtctttgttacaggtttcgtcattggtttccacgatgatgcggtgaacctccccgaccttacggtcggggcttccgtgccttccgcagagttcaatcgggcaatggtgaattcgtaggctgtggtgaggccgtcgtagaaagtgtatttttccaacagttccttgtccggggtttcggagtctttgacggccttgtcccattgttgttccaaccatgctatgaggtcggatttaagttctgactgattcatgtgggggttccttgttgtggatgcttttatgtgtggacgcaaccaatgtccatgagttctgtgaggttcaaatggttcaatccttgtttcctttctgccttactgcggaacgttttctaacggcacgagttcggcgccggcctgtttggcgtgccgctggcagacgccgccgaagctttccccgtcgccctccggccatcgacggattgccacaatgggtttgccgcacgggtacatccaaccgtccgaatcggtcacggtatgggcgcagccaatgtccatgagttctgtgaggttcaacatgattcatcctttccaaagttgaatgctctgccatagtttgaatcgctcggctattgccttcggagattgcccaaacgcattctcatcgtcctctctacctttccccgcaatcccaacggtcgtagcatgcggggcattcgtattgcgcgtattcgggattccacttggcgtgctcacggcataccagacgccagcaggcctcacatatctcgccgcagtccgtgcagttgacgcgcccgcaacaggggcatttcctcgcatgctcctcacataacggtatgccgcaaccgccgcagtggtcagccacgtcatccgactcgtacgggccgtggattgaatcttcgcaggtttcgttcgcgttcatgatggttccttttcattccttgcctaacaggtcaagtccggcgcacaccgtctcccatacggtcttgccgtcgaatgcgatgagcatgccggatatgcagtattcgctggcgtgcggcgcgggctgtccgcagtccacgccttccttgcccagcctgtccaataggtcgcggacggattgcagcgtcttctcgatgttcaacatggttcactccttgtccagtcggcgcacgctggccagcatgcgcgacgcggcctgacggcgcgtctcatacggggtgccgagttcctcgcccagcagccacccctcgaacacggacaccgggtcatgtcggccggagtatttgttgttgcaggattcgcacacatgcatgtagtgttcggccatgtcttccacatccttcgcctcctgttcgtcgccaagcgtgttccggcaccattcggcggtcctgtcgaacttgtctttcaaccgcatgagacggtcggtgcgcggcatgggcgaagccagcaggcgtgccagttcgtccaatgcccgttcctcgcccatgtcggctgtatcgaggacggtgttatcctcgacaagctcgtactgcgtgcggacgatgctgatggtgtcgctgtcgggaaggttgacggtgacctcgtatcccgcttgagggtcgaatgcggtgatgcgtccgaactggtggtcgttgtacacatgccagtccggcagtatgcgggtgacgatgctgaggatgtcgcgtgttttcattccgtcagttccagttcttcggcgcgacgacgatccagccgcgatgcctgtcggcctcacgcctctcctattcgtccgttagccattgctcatgcgtttccgcttcctgcctgtcatcgaactgcttgccatccgaagtggtgtatgcgatgcttgtttcgacactcatgattcctccaactggtatccgatgtggcgcagcgcgtccgtgatggtttcgcccggttcgccttcaagcggtcgcccgccatacttgtcgtatatccgccattcgccgggttcggactggtaggcgtatacggtgcccgccggcttcccgtccggcgccgtcagttcgatcggcttcgattcgccccgctccgaccgccatcgtgcgatgccgtgcttgcgttccatgagcgttaggctcgcgccgtccagtccggcttccagcaggctcatatattggctgtcatcgttttcgcggatatgccagtcatcgccgtagtcgtcctccatgccgatcaggagcaggggcaggccggtgcgaccgcgcccctcgtcgcgcacgatttcgaacggacggtccaactcgttgaacgcggtctgccagacgatccaacccttgtcgctgacgcgcggcgaatccgggccatacccgtcgtcctgccggtcaccataatggaatctgtcgagcaattggtgttcgattttttcgccaagcggcttcatggtcaggttcctttctttcgaaaagcgtggttgtcgcatcctcaagaaatgcggtgaacagatcgtagggttcggcctgattgggattcagataccagtccataggtttatagcccagtttcatgcacgggagtttcgtgccgatataccgggtgacccggatatgccggaatacccatcgtatgatgtcgattccgagcccatattgttccgcatattccttatacgacttcacaatcgaccctttcctccgcttcactggtgcgccttcacgtattcgggtccgtggtagtgcgatcggcatgcgtatcgttcggtgaccggggtttcgagaatccggtccacatccaacgtcacggtctcccgatccgttcgggcgaggtattcacgcagccagtcgccagcgttgaaactgtccgcacaccatgccggatcgtccgtcagctcttggatgcgccggacgccgttcgggtcgtcgaggagcccggggttccagcctgcatgctcgcagaccacgtcgatcagcgggtcaagccggctgatggcgcgtgttctgccgggcgtgacgatcaccgtgctcctcatcgttcagtccttcttctcttcgagatccttgaacatgtcccatccaccgcgtccgatatcggcgtctttgctgccgattacgacgatgccgccgcctttcttgagccgccgcgtgcagactgggtccgtgttctccttgccgtaaatgtcgaagctcttgagcgggatcgcccgcaaaccgtattcgtaatcgtcgttgatgcggtacacgggcaggtcgccgtaccggtcgcggatggcttcgagcttctcgatgagttcggtgatggtcaacgtgtccatggtcggatgcctttcttacgtccgcatcccacgcatgcgtccccggctcacaggcccttcgccttgaggatcccgtccgcctctctggtgaagtcatgccggcggcgcagccgtcccgcctcgtagcgcgcatcacgcgccgtcgggtcgatgtcgcgcgcgaatccggccatcacatccgggtcgatgcggtgcgcgtatcggagcgcgatatacgggtcggccgtccggacgagagcgtgttcgccgcccggatgcttctcgcacgcgatcagccatgtgcccggatcgtcgcaccagccgatgaggcgttccaactggccgggcgtgcactcctggctggcgatcagctggtaggcgacgtccggcgaccatgacgggttcgactcctccatgagccggacgagcatgccgatctgttcgggacgcagtctcgcgctcgcggccagatccgtcatgacgccgtccccgtgctcgaacagggcgagcagctggggtccgtccagggtggctatgaaatcgtcgaatcgtttcatgccctgggtatgcgtccccctaatcagggaaacggggtcagcggctacgccagtatccactgaccggatatccgcttcggatatgagggctcacccagacgccgcccccgccgaaggatgccgtattcgcctttggcttcggcatccttccgtgcagtggctggatgttctcgtttgccttcgaaaccgccttacgcatggattccctcagcgaatcgggcaaaccggccgatgcctcatccagatggtcgagaacggctcccgccatggtccgggcgatatgcgccacacgctccccgtccaaaccggcctcctccgcgaaggcctcccagtcggatggggtgagcagttccgcgaattcgactccgttgatgggcatcgccatctcctgatccacatgaggccatattctggtgaccgtcatgtcgtacatcggcgcgaaacggaacccgttttcggcaagaacaatcgaatagttcttgccatgggagtccgaatcgcccgatgagacgttgaaggcaagccggcgaacccactcgtatccggtttcatcgcttgcatcgaaatgatgcaggaaacggacgcagcttgcggcgtcgatttcatacttggattcgggatccatgcccatggcctgcgctagatcctcgcaatggattcgtctcacgttgtttccatccacgatgcggtcgaaacgtcgggtgatgaaggcctccgtcccattcgcggtgagaacgccatgctcggataccggcaatccgcaaagagtcccgagcgtcagggtggcatcctccaccctgtgactgccggggcaatccctcatttcaggtttgatgatatgggtggaggggatggacgcgttgggccagagccagacaccggcacgtcgggcgagcgtgaacttgggctggcctccggcgatggagaaacggcatttcggcgtatcccgctcatagaactcatcctcatcatcccgtgcgaaccagttgtatccgttcgcacgcacatatcctatctgattgccgatttcctcctcgtcgaggggtttcgcctcgatgggatgatgcgggagttcgggcttgtccgagaatacgagtccgcctactgtatccgcatccgcaagaagtttgaacatgtccgtcgaatccagatggagtcgcagcgccatcctacgacgggcgttctcatcgtcgggaagcaggttttcgagaaaggccgacgccgtttttccggaagctttcccggttctgggcagactgaggcttatcggcgcgccttccttggaatcatagtggaatgaaacacgtccgccggaggttcgtatgaattcccccacatggtttccgtcggcccagacatgcagtcgttctcctcgcatcatgcctccagatattcgggcggaaccctatagggtttgacgccgagtgtggcgaacacacgcagggccgcttccaacggtacgatcccgcgttccgccatatcggtcacgatgctttcggagacgccgcttctgtccgcgatttctgacggggttcggccgatttccgtgattcgtgcggaaataatctcgcccgccttttccaatgagggcatgtcgcgaatgccgtcatgcgatggttcttcgctgatggagatctcatcggttttcgacggcaaggcgtcgaattcgctgtaatccatttctcttccgctcctttccggaaaaagcatgcgtcccgaaaaccagaggattgcgaatcaggctgctcgaaccatcataacgtcgaatgccttattccggcacgcgccagatgacggcggcgtgaagaccggctgcctggccgggttcccgtcgaaaggcatcaggacgcctcccccgtgagccgcgcgtacccgtcgaacaggaccttcaggcgcgtatcgtcatcgtccttcagccatttccccgcgccgaacgccacgtccgcgatcttgtccaattcccggtgggcggcgcgtaggtcggtcggcatgtagtcgggatcgtacaggtctgccagggactggccgggatggttggctcgagccaccagcacgttcctgccggcctcgatcaatgcggcgcgggtttcatcgtcgagggcgggcaggggcaggttgttccaaaccaccgtgttgctgaaacggcagcgtgattccagtcgccctccaatcgtctgctgccatgtcatgaacatgcgtgattcgatgacggcgaatgcgaggccatcccggtcgggactggtgtacaccatgtcgccggcgatgatgtccggcgtgtaccagtcgcaggtcatgtattcccgatcctcgctgaacaccttcgggatcgcaagatagttcatggacggctgatggtcgtcacggaacagccaaggtgtcgcacgatgcctgtaggcatcgcccttcattggagcattgcgacggtattcggcgcatgcgtcgacacgcttcttcaggaacgaggatttcctcagttcccccggctccgcgtccctgagccataggcaccagcggtccgtgccgttgatgagctcgcgtcccatgcgaaacggccggacgaagcgtgcggcgatgggatcggccatggccttggcatattcctcacggtcggcgagcagcaggttgcctccatccaggggcatggaaccggaatcggtgacatcgagaagaggcgagaccggtcccgtcttctggcttcgtttgcctacgtacaggtcggggccgtctatgagatacccgttgatgttgtccacggtgcgggcggtcggttccccattgatgtccgcgtattcgaacagtacgggcgcgggcttcgctttcctgtccaggccgatgatgacgacgtggacgtgcgcgttgtccgtggactgcgcgtcccatgcgaacgtgcggtgcgcgaaacggatatgccagccgtccgcatgcaacggtttgaacaggggttccacgggctgcccctgggtgatcgaattggtggtgacgaatgcgaacgccgcatccggtttagacaggtaggaggcggccttccggtaccatccggtcgcgtagtcgagatatccgtcatactggcggccccacacggtcttcagatcatcggtctgaccggcggtcttggtgacgtgtccgatgaacggcgggttgcccatcacatagtcgcagtggtcgccgggtaatagttcgttccagtcgaggcgcagggcgttgccttgttgaatatgggccgtatcggtgaacgggagccggggcaggccgctgatggtcgactcggtgtcgtccaatgcttgctgttccgcgatccagagcgcggtgcgggcgaccgcgcaggcgaacccgttgatttcaatgccgtggaagtggctgatgctgactttgacggggttgatgtcgtcgccgaggtcgagggcgagttgtccgtccttgtccaaatcggcgaggatccggttctcgatgcgacgcagttccagataggtttcggtcaggaagttgccggaaccgcaggcggggtcgaggaaccggaggccggctatcttgtcgtggagtttgttgagcgcgttggtgcgggaaccgcctgcgaccggcctggcctccgccccctcgagttcggctttcaaaccgtcgaggaacaacgggtcgatgagcctgtggatgttcttgacggacgtgtagtgcatgcctcccttgcgccgttcgtcatggctgagggtttcctccatgagggaaccgaagatgacggggctgatgccgctccagtcgaagccttcgctgatttccagcagggcatcacgcagctccccggtcaacgggggcacgtcgatccggtcggcgaacaggccgccgtccacgtaggggaacgctttcaacggttccggcaggtaacgacgccgcttctcgattggtgtgtccaacgcttcgaacaggtcgtacaggtcttcgcccagacgttcgggcgtggatgccgccacatagtcgcggagcgcgtccggccgaaacaggttcgcgtcctccgcatacaggcagaacacgaggcgtacggtcagcatcgccagcgcatcatgctccgccggatcatcgggatgttcgaagcattccgccaaagagtcatggagtctggcgacccgtcggccggctttgacggacagtttctcctgttggacgacacgggagtgctcgtgggcgaacaggcggccgatttcgttgatgtgctccggcaggccggcaagcgtgaactccgattgcggggtgcgggccaacgggtcggcttccagatcgtagaggcggaatgttccgaaattgcaggtgatgagcacggacgggtgttccgatggcggcaggctgtcggaataccgtttcgcctgttccaccggggtgaccatggttccctgacgtggttccggcctgtccaaatccacgccgaggctcttctgttcgacgagcacacgggcttggatcatgagcgcgtcgatgaacccgtccaatgcggtgcgccgttcgaaccagagcgtctgcctgtcgctcgtgttcgggatgagcagcaccttgtccaacaggtcacgccagtactgttgggtctcggatttctcgtcgcctcgtcccgcccatgattcggcgaacttggccgccctgctcttcagatcatccatgattcccaatggtatccggttttccgcatgccggtcggatatcgaccacatcatgcggcgtgatcgtccataggcaggcttggatccaccggtccggcagccgtttcggatccgcgatcgcgttcgccctgtactggagccgtttcttttcggccggatcgtcccaatgctcgtccagccaccggtcgtattcggcgggagtccacctgtcggcatccagcggggcgcacggccaccggttgatgacgcaatggtattggtcgaaatccgtgcaaagcacccggttctcatcgacccgcagatgcaggagctccaacccgtcgtactggtggcggaagcccggataccgtcggtcgggacgcgtatgcgccctgcctttcgaatcgacccagcgcgcccacgcccacaagggggccgcgtccgggtccggacgcggcatgccggcatgctccatttcgcccatcatccactcataggcggggctgatgccgtcccaccagtccgcgtcgccgtcggcaatcgaccgttcgcgggccgccttccatgagggcgtgtacgagccggaacggtcgaacgcggccctgacatccggccaccgttggaacgaatacagatcgatcagaaaaaacctcctttagtcagcattcccatttgacgcggcgacggtacaggcggggatcgtcccaatcgtcgtccatgaggccggtatccgcctcgcgcacggcgagacggcaacgatcgcgaaccgtatggcggcccacgtaatccggataccggtcatcctcgtagtcatgccagctgtgccagcgccggccggatgggatgtgcgccttccggctctgcgaatacgcatatgcggtcacgtcgccttcaagggtcggcggttcggtcgggtgcatccagttgtgtcgcaggtacgcgtacccgtgctccagcgcctcgcgttcgagcacacggtacggcttgtccttgaacgttcgggacattcgttttttccttccattaggtttgttcgcctagtggaagtcgtgagagagcagcatcgcttttcctttccgatggccaactatacaaagaacaaacgaatagtctttgctgttattgcgtatccaatgtattgatattgtacgtcaagttgacgtacaatacacggtatgacaagcactattacggaaccggcacgcagctcacgcctcaacatgcgcctcacgccagaacagcgccaaaccatagatatagcggcctctctcaaaggctcctccataacacaatgggccatcgaccatctcgtcaccgacgcgcgccgggatatcgaagaggagaccgtcacccgtctgccctccaaggcattcgacgaatttctcaaggcgcttgacagacccatgccgaaggccgcgaaggatctcatcgaaatggaacccgactggatatgagattcaccacaccacggcgcatagagtcctccgacatgctcgatggctttgactgcggcattacgcccattgatgaatggctgtccacgagatcccgttctgccgaaaaacagggaacggccgtcgcgtacgtcacctacgccgaatcaggggaactcgccggattctactctctcagcgcacacgcgatggaacgctccaatatcgccggcggatggctacagaggaacgttcccgagcgagtgcccatgatactgctcggcatgctcggcgtggacagacgtttccaaggcgaaggcctcggcaggaaactgttgcacgatgcggtcatacgttccttgaacatcagctccgaactcggggcgagggccctcatagtggatcccgtggattcagccgcagctagattctacgagaacaacggcttccagcacattccggaatcagaacgaatgttcctcaaactcgcgggcaagcatctcgtctagcattcttggcttcctccatccagcagatcgcacagcacccacagggcgaatcgggcgccgttcagcgcatcctcgggaaggccgcacggatatgaggcctcgacccccgcatgcacgttcccgtccgcatccacgccatccagcacggtgacggccagggtcaggcatcgcaatccgcgttcgggcgtcgcgtccccgcggacgagcagccagactggcggcatcgccatcggcttgccgggatcgaacgaacgcgcctcgtcggcgacgatgcccggtccgaacggttcccgcagttccagcccgtacgtgatgttcccggcacgatattcgagcttgatgcgggccgtcgtgccggacggttcggatgtttcggattcgacggcgtacagccggtagcggatggaatcaagcattatccccatggtagtccgggtgcgcggttcctgttctcgtgggggccgccgcgtgccgtccgcgttgaactgggcgagctgcccgatcgcattgcccgtgttctgcaacgcgccattgagtagacgcacacgctcccccatatcgttggtctccaacgcgagacgcagctggccgatggccgcgttcacctgattgcggtacgtgtagttattgttctcggatggcgccgtcatgccatccgccttcctttcgtccttagaactgatatgcgtttcagcgaatcagctccagaagccctcggttctcgttcctgccgaaccggtgcagtcttgaatattccttgagcgcgtgttcgagccggccgggctcggcccagtatcgttccagccatgcgcggcttttcacctgcttcatgcccagttctcttttgcaatagtcggagggcttcagccgtgtggagccgttcgtgtatttgccgtacatgccctcgttgatgatgaccagcatttcgatttcgggatgggttcgcaggttcacgacctcggccgcatgttcgtaccctcgaggtatgcgcagtacatccgagtccgaatcaactattcggacgatgagcaatggatgttcgccgtatgacatgttgaggaaccggtcgagcatctgttttgattccttgcgcgtgaagtaccatgttccgcgcagctggttgggcacgataaaatcggccggtattgtcagttcccctcgttcgaggagggtcgtgagtatgtactgttcggccacgccctcgcagacgaacagcacatactggccttccgcgttaagcatgcacgtacctttccgcataatcctggagggcgcggacggccgcgtatgagggcgcggtaccgggcacccggttggcgaagaaggagacgctcttcttcaaatcggtgcggcccaggtatgcgcccagattccggagggcgaagccttttccatcgcggacggcgaaccatatcgaatccttgcgggtgaaatggtccagcagctccggatagtgggtggagaacaggagggtggccccgtgcgggttcgtgaccggggaggcgaacaggtccatgatggtgaatacgagctgcttgttgatgctgttctccagttcgtccacaatcagatagccgcccgcgcgcagtgtctccaatgctcggccgaccagtgcgccgcctctcagggtgccggatgagaccatgttgaccagcgagttcggggtgacctcccgctccttgccctcattgcggaatttcagatggattccgtccttgtcgtagtcgaggcgttcgatgctggcatcgaacagcgtcacgacggggcgggccgggctgacggtgagcgtcggggacaccggcagcagttcggtcgcgatgtcggtgtccttgacgaaggccccgcaaatactccggtcgggcggcagataccgtttcgcgtcggcggacagttcgccccggacgccgggcctgcccacgttgcgggatgagagcacggtccaccgttccggatccaacgtgccgttcatggcggaggcaagcattttcttgctgagcttgccatggtggatgctcagggtctcacggatgaacctcaacggcgtgcgaccctcgcctgtccgctcgagcaggctgtcgatgagatggaagcgaccgtcctgttcgaacagcgcgcgcaccccgatccggtcgtccatggtgtcgtacaaagggaacaggtcggggttcaacgatcccagcgacatgccgccggcgacggcgagggcgagttcggtgaccctcaacgcggtggtcttgccggaggcgttgatgccggcgacgccgatggccgtgttgatgctgatgttgcgtgcggcgccgtcgagcatgtgcgtgtatccgggttcccttacggcgtcgatggcgtacaggtccatcctgcattcatggttttcgtataggcgcaggccgctgatggcgtagctcaacaacctcatgctttctcccttgtaaacgttttttctgtatacataggctatcactgaatggagaccgtcgatacccggaaaccgtcagaacgcctcccccccctgactcccaggcagccgggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgccccgggcatgccgccccgcgacgggtcgggcatgaactgctccggattatccccgaccgccgtcagcagagcaggcggatgccggtcgcatccaggagaacatcgcctgtcagggcgttcagcgtgttcgcgagacgtttcgccgtgttctcgcccggcgtcggctccgacgggatgatgaggcccccatccggggtctccgcgatgaagcaggcgcatcctttggccatctccatgggtttcatgccgtcggcgatcgggttcggctcccacttgtcgccatccgtgagatgacgtgcgcaggattccagatccgagaggagcgcgtccgcgttcatgtacgtgtcgtacaggcgtcgccaatgggcgcgaacctgttccatgatctgcgggtcgtcgcaggacagatggcctatcccgttctccgcgtcgttgatggcggcggcgagcccgcggcgggcgaccgccagcatcatcctcgcctcggtgttctgttcgagcgtgaaatcatggttcggcatcattcgccccagctttccctgttcgtccggatttcgctacgtctgacggcggcgcgcgtgcgcagccggttggggcgcggatcgtgagcgccggccttgttggagcggcggatgagctgcatcgcctcgatgtacatgggattcgccgtcctattcggccgtgccatgatcggcctccaatgcgatgtcgtgcaggatgcgggagaggcgcagcgcggtctcccggtcgaggatgaggcttgccgaccggtaggtggtcccatggtccgggtcggtgtcctgccgggctatcgcgatgccgaccgtatccggccaacgcccgtccgtccaccggcggcgggtgacctccgcccggtcgacgaccgtcgtatccgagccgcacgggatggtcagcatgaccccgtgtgttcgagcccgccggccgcgatctccaccttcgattccctgacgttcgcatccgtcatcatccgttcctttcctcgttggccttcgaccccgcgggcatgcgtcccggtatgccgagccgacggcattcaaggcattgcccgtccgtccagcccgtcgggtcgagcatgatgttcgcgcaggatacgcattcgggaagccggtgcgccgggcagtagtgcaggtcgcggtcgagtccgggatggtcgtcggcgtacaggatctgccagccggcgtccatgcgcgcatcgttcagcagctcatcctcgtccgcccgccattcgctgtcgtcataccggttttcgcagccgggcgcgtcacaggcgagcatgagcaggggcgtcgcgtacccgtcgaaccgttgggcgagcatggtcatcttggcgtcacccgtttcgggcgacggttcacgtccggcaacgggtcgatgccggccgcctggcgcagcaggttcccgatccggcggcatggcttctggtagagatgccgccggtcgccgcaggggccccacatgcggcgcaacggcccgccggcggggaacacgaggttcccggcaagacggtcgccgtagaacactgggaccgtgggctcgccgtaaagcccggcgaacgcgggcccatacgaccatccgtcgcccagttccccggccagcgcgttcaatcggagccgcatgcagcccgtgacgtccgtggcatcgttttttccggctcgccgtccggagtcggcgacgccttccgcctgcgcccgttccagttgggcgaccgtgcagtgcacgcattccgggtgcatgcccgcccagacgccgaccatgaacgccatatgcccggtctcgccggtcaggcttcccatgaggggacgcgcctcccatgaggggagcggccgccagccgtcgcgccaacagtccgactcgaagccgatgtcatgggtcctggcggccttcgacggccatacgtggatgaggtcggtctcgacgtgcagcgcgtatctgaagcgtatcgccatcagtcccgcctctccttttcgtgttcgagttcgttgacgcagcaggcacacggtccgtccatcagattggggacgtcgtcgccgcagcggcggcaacagccggcctccggcacgcgggccatgcggtcgaacaggtagtcgcccatgtcgttgatgtcgatgcggccggccttgccgtgcaggtatccggccagcatgcccttcagttcgcggcgggccacctgcctcgtttcgagatctttcaacgccatgtcacccctctttcaaccggatttcgtattccggggtttcggccatcctgtcgtcgaacaggaagtcgcccatatgctccacgtcgatcgggcagccgccgccgtacgggtattcggctatcgcgttcttgatctcgcgcctgttgatgacgcgctcgtcgctgtcatgccttgccaagggtgtttcctttcccgtattcgccgatgcgggccagcagtccgccgaacatgcgtgatatgtcgcgcgccgccataccgttgtcccaggtcgtgaaccggtgcagctcccactggtcggccgcggctttcgcgctttcgtcaagaggattcgtcatcgaccggcttccttcagtagtttgattgtgtgcgcggcttcgctgagcttgtatcggatcgtgctggtcggtagagtgcatgctccaaccagctcctcggcatgcccgtcgaacccctgcttgaattccaacaccccacggccctcgtcatccgggtcgttgaatacgccggtgatgccgtacatgttgaagcgtggcatccggctacggttgacgcacaggcggagcattccctcatggaccaacaaggcgggagcctgatacgaacggtattcggggagcgcgccggctgtcagatacacgatttcacgccggtgttccacgaacagggcgcatgccgcaggaatgacgctgccgcgggaagccagtgcgcgcgcctcgttgaggcggtgttccatggcggtcaggttgcgggtgatgtcgtcctcctgccgtttgattcgagatgtgggatgattctcgtattgggttcgcagcaggtccagccgttcggcgagtttgtcgtattcggcggtcagtctggtcagaagttccccggcgtggatctcggcgagcatgaaacgggctcggcttccgaatgtctccttgaaccggcggtaatagtcttcgtcgcgggccgtgaagccgcgtcgtcctgcggtcttccgttcgatgtccacgaacgtgccgagctcatccgcaccgagttcgcgtactcgcacgcctgacgttctcgcccggttcacgctccaccgggtgcgcggcttataggaggcgagcagcgtcttctcatccttgatcccgtcgaaggttctgatccaattccaacggttgacgacttttccgtatccggtgtcgaatccctgatgcctccagccgcatgaccggtaggcgtcgaggatcatcgtgtcgggggccccgatcgggttcccggccgcgtcatgcctttggtattcgatgttcggccagcatgtgacggacacggcatggcggcggcgtgcggcgagccggattccacgggtcatgtgttcgaggagtttcggatcatcgagcgcgcataacggtccgagccagatgctgccttccgggccaagccggcctcgtgtccacgcgatcaggcagccggccgatagaacgccgttgcgggtcacgccgatcagatccgtggcgtccacgtccggttcggcgagatgagccatgtgcccggtctgctggaatccgccctgcggatgtccggcagacagcagatccagttggttgaaggtgatgggtgtgatgtcgtagatcaattcagtccttccattatgagaccggttccggcatgaagagcgtatgtgaagcggatcatcatcgatatccccctaccctcccgtgtttgggttcgtctaggatcaggggcacggcgctctcatccaacgggttcgtcatcgcggcctccctcgttcgcgatcgtctggagaatgcccgccaggcagccgatttcgccggggctcaaccggattcggcggatcgtgccgccgctgtcggtggacagcacccacgtgcggacgccgtgtcggccgtcgcccggcagccagatgaggctcacatgcccgcaggaggcgcccgtgatcatgccggcgcggcgttcgacttcgatttccggcttcatcgcacgcctcccaggatcaggggcaccgcggcccaccggcggaacatgcggcccggcgcggccgtgcagtacgcatgatcgggatgcagtacggtcacgcccttcgcggccatcgcctccaatgtgacgggcctgtcgtcgatgagcacgtccggtgtgagcagcgtcttgtcgccgttatagtagccgtcgaactggaagccgttgcggtgcagccagcgttggctttcgccgcgccggtcgtccgcgcggctggtcgccatgatgacgttccagcccgcatcgtgcagctggttcaaggcttcggcggctccctcatagggttcttcgcgtgagtagagaccgtcggcgacggcgcgcgtatgccaccagcggaacgatttcgcgtcgccgctgaacggccatccgccggtcagcgtgaaatcgtaggccgtcggctccgggcacgggcattcgtcctcgccatgtccgcattcgcggatgtagtcgcgcagaccgttcgtatagtcggcgatcgtgttgtcgatgtccaccatgattgtcctggtcaaggctgtcacctcttttcaagctgttccgccagttcgtcaagccaggcatcgacggcttcgctctcatacccgtaggagccgcagggcaggttcagatgcctgatctcgtcggcggcaaggcctcccggctccccggggtgggccagggtgaacgaggcgaggcgctgcaccaggtcgacgggtaccggcatgtaggatgcgggagccgatacgagcgggaacatcgggtatgccatgctcatagtccgttcttcgtcaggtatttgttgttgatgattttgaagcaccgattggctcccagttcgttcgccaatccttcggacaactgctggtcttcgcgcagatgccagacgatgccctcgtccagacggtctttggtgacgttgccacgcaacccgtctactttggcgatcatgtcgtccacgctccccgtcaatgcccactcgttttcgtcgagttcgggaacggcaagattcggcattcccgtcggccactggtcgcggtcgatcttgtgatggtctttccagacggcgaagacgaacggacgttgggccggcagtttcaaacggtttgattggataccggggccacatagctcgaactggacggccatgccgggccatagcatcttgtccaactggaatcttttggcgagccgcatgttcgaggacatggagtcaagctcccagttgcgtgagtacacgtggacttgtcctcgttcgtccatgctgagcgtggtgctggcgccatcgaccttcacggtcggcacggctttcaacgtcttgatttcatcccagtggtcggtgagcgtctgcaaacgtggcgcgtccgacttggagcagggcgcgtcgaaccggccaatctgagcaccgcccatcggcaggggctcctcgtatttgagcacattcgccttatcggtgatgtccgtgccgacagggggcgtataccggaatccgagttcatccaaacgcatgatgagaccctgcgaatacactccgcgcagtttcacggtgcgcagcacatggccggtgatttccatggaaccgacgatcatggtcttctgaccgcgagcctggaacgccttgtaacgcgggtcataggcgggcagaagactgtccgtctcgaaataggcgaccctgtcccccggcttcagatgcatgtccttgccgacgaccacacgccaccccaatatgcgggcgacttcgatgcgatcggccccctcgatgggctcgatgttggtgatttcctgtacgctgacgagtttcctgctgctcatgccgcgactcccatgctgtatcgttcgggcgagatggtgatgatcatctcgttttcgtcgtaggctccgtctttcatgcctgtgacctttgtcatattcaaaccgtgtccatgtcccgctccccgccggttcgcgtggtcagacggggcatggggcgcgcccctcggacacggtgtccgattcgatggtcaggaccggttcgccctcgtcgtcgacgagcgtggcgggccgtcccgtcgcgtccgccgcggcgcgcgtggcggcgagcatgccggcgaacgtgagcccgccgggcagtggggtcgtgtagtcgacgggcccgtaggcgccgtcccgggtcgcgtggatctcgtattccatgcccccgggtatgcgtccccatacacgcggtccgggtgtatgcattccggtccgcgtgtatgcatccgtatgcatccggggatgcatacatcttttctttccgtttcggcttggttccgacgttccggggatggtccggaggcgtgtatgcattgtatgcatcattcccttataggggattcgggaaaaaggaaggaaaccccatatattgatgcatacaatgcatacaagataaaggaattatattttttcctttatttataagggttttcgggctttttccgggctttttctgtatgcatccccggatgcatacagatgcatacacgcatacaaaacgggccggaaaactatacaatattgtaaaggtcggaggtgagactttacaatattgtaaagcctcacctccgggatgcggtcgccccgccggcacatcgggatgcctttttttcagttcgcgaccagatccgacgccatatccatcggctcgccgccttggccccgccgttccggcggggcgcgcgccgaacctcacggacaacggttccttgcccaaatcgggctggaaaacggctgatccggttctgaagagccgggcttgcgccgcaaaaaccggtcagggttttctcctgtccaggtcgagttcgagaagcgtgcgcacccggtcgagttcgccggcgacgtccgtcatccacgcggcggcccgtctgagaccgtccggcgtgaccgtcccgcccggcgtcggaccgcgccgggcccggagccggatgccgccggcgggcgtggggcaggcgtccacgcggggcggctcctccgggtcgccgtcaagccggaatcccgtgacccggtagcggacggtcccgtcgtcccggcggatccagtcgatccggtaacggcccgtatggcccaatgtcaggacgtcgttcatggccgccccgtccggggcgtgcggcgcacgacccattcgaccggccgtccgccgggcagcccctcggggcggatggtctcagtcgacataatcgtatcccgtccagtcgcgcagcagctcgcatacggtgacgtctttgacgagcagcacgtgatgatggtcctccgcgtcctcgagcgtgacgagcgcgcacccggtgcggtccggcttcgggtccatggggtcggcgacgtcctcccatgcgacgggcgtgctcccgtccgccatgttttcgtcgtacggggcgggagcccacgtgccgtccggcagacgttcgaacgtgtccgtggaatcccgccaggcgtccatgagccgtgttttgagatgaccggtgatgatggccctgaactgatgatcgttgtcgttcatgccccgtggcatgcgtccccggacgggcatgggacgcgtccgcggcgaagcgcctcaccgggcgtacgggatcgcgtgcaggccggccccgtccgccagcagcatgccccggtcgccgatcggcgtgccgtccggcatggtgctgaacgtgtcgcacagccacacgccctccacgttaccggccgacgggacgggcgtatggccggacacctgggtcaggcggccgtcgtagtccccgtggccgggacgcgcccacaacggtccgtcgtcgtccatgtacagggcggccaggcttccgggacggtccggcaggcggttcagacgggccgcgatccggtcggcggtcatgcccgtccaggcgtgcccgaaccggcggatcccccaccggcgggtgagtcccgcgtgcgtggcgacgatcgtgccgtccgtccatgcgatccgcgtcgggatgtccttcatgagctcttgacgtcctcccctcggctgaagccgggggattcctcccgtcctgacgatgggagaggttctggtctctaagagaccgccacggattcgcgtgtagcgtttccgttggtcttacgtccctgttcgaccggggtgccgtccgcgccccacaggttttccgacgtgacggcgagcgtgtccaatccccgttcgaggatgttccgggcggcgttcacgtcggcgttcgccgtgtacgagcatttcttgcagacgaagaccgcttggctctcgcggttcttcttgtccacatgcccgcatcggctgcatgtctggctcgtgtaggcggggttgacgagtatcatgcccacgccttcggccagtcgggtcttgtaggcgagcatggaggacagtcgtcccatgctcgcctgtctcaggctccggttgagtccgtgtttcgcggcctgcccgttgggcaggtatccgccctcatgcaacgggtcgggaacaggcttgttgcggcggctcatgttcgccaaccgtaggttctccaacacaatcaggtcgttctcgcgcacgagccgggtcgtgtacttctggtacacgtcgtccagtatgcgcttggatttcgcgtgcagtctcccgatttccagccgtgttctccgatacgcgcggctggtcttgccgctcttcgcgtactcccgttcactggagtatcccgcgttcccagccctgcgggcttgggccttctgccgtttcctgatttcacggtcgatggccttcaacctgtctttcggcaggtccatgaaccgtccgtcggagtcggcggcggcgtgcacgcatccacggtcgatgccgaccgccctgccggtcggctcatgcttgacgggcgttggggtgttgttgaacacgacggtgcggttcgtccaatccacttggatggccgtgtattcgcgtatcggctggctgactcgcacgtgcaggaggatgcggtagcgtaacggttcacccggcaatgacatgcctttgggattctgtccggtgatggttatgatgccgtggttgcggttgacctgccggtatacggcgttgcgtcccccgttgtgccagcagacgaaacgctgcccgtcacgcttgtatgatttgaaccggggcattcgtcccggcttcaaccgtttgcctagcagggtcttgcgtcgttgcacggcggtgaaccattcgacccgttcgattcgtgtcggtgactccaatatgagggacggcaccgccgccagccaagaacattcgcttcgggaccggctgacgctgcgagtgtcgggttcgcctccgatggggacgagggttttgtccttgccgtatttgcaacggttggaacgcaattggttgaaccggtatcgccaagcgtcgcacagccagtccatcgcctgaccgcccgaacgcgcgtacagtctttcggattcggggtcgtgccggtcggcgtagccggtgaacggcttggctccgtccaacgtcacgcgttccaacacgactttctgactcataaggctgattctaccacattcgcgtataatatgggaatagtaatgccgtgattcctccccacgcctaaaggcgggggcaccctcacggcaaaacggtggacgcggcgctgcgcgcctggtttgaagcccggcgcctgggcgcgtacgcgcgcgaacgaggcggatccgcgtcgcatgtaatacgggacgtcatggttgccgagcagcgggacgatctcccgtcgcccggattcggcccggtaccatgaggcgaaccgttccatgaaccgtatcatgcccgtgttcgacacatgccagtcgtcgcatatgtcgccgagcagcacgatccggtcggcatgctcccggtctgccatgttcgagatgaaaggcagcaggtcgcctttcgcatgcaggtcgccggcgaacagggtgcggttcacgccccgccccttccggcaggaccgccgtgctgtccgacgtggcgacggacacgaggccgggacgggtcaggagcacgccggtcctgaccatggcgtccgcgtccagccaccagatcgcgtaccggcggttcgcgtgtacgacccggacgggcgtctccggatcgtcggggtcgaggacgcgcaggacgcggaccggccgggtcgcgtccacgcagcgcatcacggtgtccgcgggcgtccagtcccaggtggcggcgcgccagccggccaatgcggccagggcgagcaggaggatgacgcccagcgcgttctggccggccatgaacgagacgacggcgagcaggagcacgcccagcatttgcaggatcatgggcgtcagggcgcgacgccattccgtgcgggtcggccggggcacggggctccacgggtcgcgcggccgcgtcttcgttttcgcgggtctcggtccgcccgtgggccggaccgagggcggacggtccggtttcacctcgtggaatgtttcggttcgttcgtcggggccggcgtgcggacggtcggcggccaggcgtcgttcgagctcgttgaccgcgctcaccgcgctcacctggccttcttgccgcgacggcggaggatgacgcccggttcgacgatgtggtagccgccgcattccgggcatttgcggatcgtcttgccttccggcaggcggccgagcgcgatccgggcgtccacgggggtcgcgtagcgggtgcgggagcatttgcggctgaacatggcgtcggccttcaacgggcggggctggtttttctcaaggttcctgcgtggcatggaatggttttcctttcgtttgccgggttgctgtgcgccggttcagacggcggcttcgatggcgaggcgcgacagttccgccgagtcgaacgcatgttcggcgatccccttgccgagggtgacggtcacgccgccggaccggcccggctggtatttcactccgtccggtatttctcccccgtgttcgcggatgagacgttcgaggaaacgttcgcccatggcgttcggggtcgggtagttgacggtgatgacggccggctgcccctcgcagtccagtccgtagtggctgaggaagtccgcgtaggcgagcggatcgtccaccttgtagtagccttccccgtcccttttcacgagcacggtggccgcgtcgaggccggcgaacaccgcgttctccttcggactgtccgcgtcatgcgtgcgaagatactggcgtttcgccccgtccagcgccttcgtgatcttcttctggaggatggccagtccggccatgtgggcgagcagcatgtcgggcgtcatctccgaccagtcgcatggttcggtttccgtcatgattcttcctttcctcccccgtccggcacgggggtcttgtccgtatccgcgtatgcgtccccgtccgtgacgcatacgcgcccgtatggccggaaatcggtggaattccggccatcgtgcgatgccagggctaacgccgacgaagcgcgaaccaggcggcggcgaaaaccgcgcaagacctggagcggacggccgcgggaccgtcctgcaaactagggcaaaccagcctgcaacggcgctcccaccggccgtccgcgcctctttcccgcttcccgcgtgtatcggatgatggggggcggggcgagcaggcccgccgccaggacgatgagcccgatcccgatccccatgggccggggtatgggcgtgatcgcgaggaacacgccccacatgatccaccacatgggcgtgatcgcgagcatgagggtcctgcatcgtctcaggacgcgcacgtccgggtcggcgcgccgcatgcgccgccggcgtcgcgtgccgccgctcacccgcaccggcctcaaggtcctcgtcctgtcgtccatgcgcgccgcctatgcgcccgtcaaggacgggccggtggagaacagggggatcgtcgcgtcgagccaggggctgagccacgcccattcggcgaacaggatcatggtccagaacaggatgaagaggatgatccgcaatgggacgggtcccgtctggagacgccaggcgagggtcagcggattccatgtcggttcgcgccggggcctgcccccatgccatatgagccatgcgaggccggcgagcaggagccaggcgccgcccgcggcggcggcgaggacgcggctgacgggcatgcgcacgcttatgcggcgtatgacgcgactggccgccatgcgcgccctgacggcgggtctcgaggtcccgtcggcgagttcggcggggatcccgtcccccacgtccgaccatgattcgaggcggcctcgtatgatgaggcgcgcggacaggctgtcggcctcgtcgagcgaccatttgcaggtggtgagcgtgatcgagcgggtgtccccctgaccgggctggtcggcgacgaccgcgacgtcgtcgggcgtggtcatccaggatgactgcaccttgtacacgtaccagtgccgggcggtctggatgacgatcgggtcgccgggccgcaacgtgtcggcggcccccaggtcgccgggcgtgcggtgtcccgcgtacgcgctgttgcctttcccgccgggcatgggcgtgtgcccgtagtggcctatcccctggttggcgagcacgtccgtgccggtgccttcctggatggcgcgtttccagtcgtggccgaaccggggtatccacatccagccgatgacggcgccgtggccgggttcggtttcggccggcgggtcgccgccccggggttcggcgatccgggtcgcgtcgcccgcatccacgtccttgacgccgtggcggacggcgagggtctgctgcgtgtggatgccgtcgaacgcgtccccccaccacacccagccgacgtggaacacgcacaggatggcgagcgtgaggctcagcccggacacgaattggaggatgcgccgtcccgtgcgggcgcgtgggcgcgtgtgccggccggtcaacgcccttccccgtccccatggcgtccgagggttcgtgtgaccgcgtcgaggatgacgaggtccgcatatccgggcgtgtcggggaaggggaacatggccttgtagacgaggtcgggccggacgacgaggttcctggcggcgagcccgtcgaggacgagtctgacgatctcgcggaacgcgggcatcgtgtcctcggggtcgagggggatcatgatcccgttcgccgcgtcgtattcgcgtgccagctgttcgcgcaatcgtaggatctgcgggtcgtggctgacgtagtcccagttcacggcgtgcgtgtatttgtccctgaccggatcgtcgcccatgggcggcctcccttcccttgtcccgtgtccggcgcggcccggcgggcgcgtcggatgctttcgcgtgagggtatgcgttccggtgcgtggggtctggccggggtgtcgtgtggcgtttttcgaccgggttgacgaggctgatgtccccgcgacgcgggtggacgatgatcttcgtgaactcgcgtaccgacttcggcgtgatgccggtgaaaatgatgaagcccaccttggccgaggttttcgattagccgtgttccggaccgtccggttctcccccgatgcgattcgtgcggcggttcactgcttgtgcgtcttccggcacagatcgagcatggggcgcaggtccgggctgccgccctcgcgttcgatccgcaccgtatgcgcggccaatggcagcagccgttccaggttcgaatccatggtcttacgattcaggacactgtcccaatcggtggtgatgcggcggaacgcattttggaattgctccaccacgacgaacctgtcgacatcggaaccatacacgatctccggtgtttccggcatgcgccccgaagcgagctcatagtcccccgcctgtccgtcaagcagtcgggcgaggacgatggcgttgtcttcgaacctgtccgccggcaggccgagcgcccgcatcccgttcgtcgcccactcatggtcgacggaggggaggcgccatgggcagccgcctccgttcagatggaactcgtacccgtatacgtccttcaggaccttcgcggcggtctcccgaggatggtccttttgcatccgatgccatgcgcgtaaggcttcgcacagcatcgcgtaacagccgttcagctcctcgtcacggacgcccatcgacggtccccctcccgtcggatccggcattcccgccggcaaccaacctgattatcgtatcggccgtttgcgcggattcgagcagcgtctcctcgcaatccgcgaactcctccagccgctcccagaacatgtccagttccggatccggggcgggttccggatcgtattcgagatcgatgccctgttcgtcggccgcccgcctcttgcatccctcgaaccattccgtctccgaggcccacaattcgtaggcgagccgtcgagcatccctggccgccttcgcgtaggcggccagggccttcgccagttcggcgcgcttgcgcctgcttggtttgaacagccggtcgaccctgtccgcgaaccggcgccacttcagctggtcttcgagggaatcgtcgtcgggaatgccggacatatccagggcgctcactttttctccgatcgtccggccgcgtcgatactccgtccgagacggcggatgtcatcccggatgtcgaccgacgccagcgagaaagcggcgaccggtccgccggatacggagaccacgtgcaacccggacgggagccacgggacgccgaactccagccgggcgcagacgaacgccgacaatgccgcggtcagggtaatgatgaacgcgatcgcgccgacagtcagcagacggctcgatttgatgaaacgtatgaaaccatgcatgattccttccttcccctcttaccagctgccggatgccccgccgccgccggatgagccgccgccgaacgaggaaccaccgtctgaagagcttcctccggaccagccgccagaagaggagccgagcgaagaccacccgtcatcggaggatgaaagcgacgatggatggccgcccgatctgatgaaatcacggcacacgagaatgcagcttccgagaaagaacacgatgagcatgacggcgatcgtgatgccaccggcctgttccttcttccgttgcgccgtcaggtatttcgtgggggaaccgtcctcgatactggtttcgatgccgtccaccaccttgttgacccccttgctccagtcgccgtccttgtaatcggagtgggccgtatcgatgatgtcggccgcatccgcatccggaatcacggattcgagcccgtatccgacctcgagacgatccttgcgatcttcgacggacagcaggtagaggagtcccgtgtccttgcccttctctcccggcttgtatttgtcgaacagttcggtcgccttgttctcgatgctgtccccgtccaatgatttcagggtgacgaccagcagctggggtttgtccttgcgtgactcccatgatttgttcaggccgtagatccgttgttccgtggccttgtcgagcacgtcgccgatgtccttgacgaagatgttgccggccggatcatccggcggcacatacgtgcccgacctgtcggaggccgcgacggaaccgcagcccgccaacaggagcagtccggcgatgatgccggtcatcgcatggcgtatcgtgcccctattcaagattcacctccggaacctcatcggagccggccggagcctcatactgctgcagcttctggaaaccgaacatgccggccaccagattcgcggggaacgacgtgacctggcggttgtacgcgttcacctggtcgatgtaccgtttgcgttccacgctgatacggttctccgaaccctccagctgggtcatcagtgtcttcacgttcttgttggattccagctgtggatagttctcgtggatcgcgttcaccaggatcgaggtctgttcgcccagcttccggtcggcggcgagcttgtcgttcgggtcggtcgcggcggcgtatgccttgcgtgcgtcggcgatggcgccgaacaccttctgctcctgtttcatgctgcctttgaccgcgttggtcaggttggggatgaggtcgtgccggcgttgcatcacgttctccacctgcgcccatttcgcgtcaacgtcgagtttggcggtgttcagcccgttgtatgtgccgccgagaatcatcgcgatgatgagcacgatggcgacgatgatgcccgccggcatccacttcttcagagtcttgttatccattttttcttcttcgtgtctgtttagaggtattcgtatctgatcggcgccagtactccgttgcgcgccaatgcctcgcacagcatgtcgtatgtgaggaaccgttcccgctcatggagaatgctcggcggctcgtcgtactggacgtgcgagcatccgctccagcagccgtgcagatgccagtccaacgcggtgaaccagcggccgcacgagcattgggctttgaacggacgctccggatccgtggcgcccgtatcccggtgcaggatgaacgtggagagctccctggacggaacggattcgcgtcggacatgcgcacttgacgtcttcgtcaccgttcgttccaactggtcttcctccatcaccagaatcgcgccgccgaacagttggcttccgataaacgagcagatcacgaacgcggcaaccagaacggcaaaaggggttcccgtcagggggacacaggcgccgaacgccagtgtccccactgcaatcagcatcagaaccgccccggcctgcgcgaaccgtatggcatgggctgtgttccgttcgatgagtccgatgacggaatccgggaaaaagatgttcctcatgatttcctccttcacgcgttcgtatggtcgaggatccaccgggcgacgcttcgggcggtctcctcgggcacgtccacctgcatggaaccgttgccggcctccatatagaagcggatgagcccgttgcccgtgagccggtcgacttccagcagattgtcggcatcctcggcacggcagtattcgcttgtatcgttcttcgcccgttcgcgcagatgttcgggcagatattggttggcgagaatatcgcggcgtagttcgtcgctgtcggtgaattccatcggctaccctttcgaatgtttcgcgcccggcttccataccggtgtccctggattcaccggggaaacaatcatcccttggttatcgcgcagttcgacgtttgccccgtcgatgtccagcgtgccttcgacgcgccgcccgttccgcttccatgaaacccggtaggatcctttgattcgggggaaaccggacaacgggtccatatatccgggttcggcgatcgcgagaccatcgagattccacacgtcgcccacatactcgtccatggtcttcggcttcgggcctcgggggctccagttctcggccggggacatgagcgcgagggcggcgaacggcagcagcaccgatgcgccgacgagcctgacctcgtccatcgtgagattaggaaagccgttccgtgccatcaccaggcaataggcatacgccatgagcggaatgtccgcgagaaaggcataccaaccgagagcattcaggaccctcaacagcaatggcatccgcgaatggtccaccgcctgagcgtattcgacaagctccatcagctgaacctccaatgcagttcgtgctggtttcgctggccgatgagccgtaccttgacttcgattatcctagtttccatgtcttgggttttcttctctacgagattgctaatgccggattttcttgtcaccagctgccggttgctccgctgccagtggatgtgcctccgccgaatgatgaagagctgtcgaaggatggtgatgggcccgtataaggctaggggtcatcgttgatggaatcattttcggaggaacgatcgtgctcctgtctgtccggtctcgatgcaagcgcgacggcttgggtgaggattatcgcgtcccgagcatcgaatccacgagagggtgcggcttctgcaatataggatgggtcaagcggtgctcggccggtgtccggctcggaatggtcccgctgcgcgttgtctagttcggaataatccgtttgttcactcttgtcatctgactgcaatccccatatcagcaagagcaccgagccgaccacaacaatcaccacgccgagaaccccggtccatgccggcattggtgcgggggttgtagccgacgttgatgcggatgaaatctcgggcatgtcttgcactgttgaagcgatattgtccaggactttgctgatgccggcgttccagtatgatttcttatagtccgcatgcccggagttgatgatgctctcgcacgtggattggttgaatgtctgtccaatccccgtgccgacggttagccggtccttatggtccttgatggacagcaggtatacgaggcctgtgttcttgcctttcatgccgggtttgtaccggtcgaacagttccttcgccttccgttcgatgggcacaccatccaaagtggagacggtgacgacgagcagctgcggcttgtcctcacgtgactcccacgacttattcaggtcgtaaacatgtttttcagtttcagcgctgagtacgttcgcctgatcctgcacgaagatattgccagcagaatcgttcttcggaacatacgtatcatcggttgcggccaatgccggcatggaaatgccggccatgatgaacagtgtggcgatggccgcgatgattccgttaaccagtttgcccatcaggtttcccctcgatatgcctcttgttccaaaacccgcagaaaatctcatatagccaccacctgtggtctctcgcgactcgtggattcccagattcccatccgagcccacggcatgccggtgtatttggatgaaaatatgtccagttctgcccatgcggaccattgctcccggtctggaaccagttggacggacaggataatcgggatacgggcgtcactctcccttaccgtctccatcaaagctgaatcgtcttcaagacccggattcacatggtcgataatcagaaaggaatccggctcttccaagatggacgtgggatcgttcaccggaatcacaccttgcacgggcttggtataacctcgatccacatacccgtcaaacatatagacccgttgccccatttcgttgagaccaggtatcagggtgtgtgtcagccaccaggtcttgccgcatcccgcgccacccgtcaccagtaggttcccatcggaaaccgggttccatgtcgcaacgccatcatcgaccaatccgattgtgaggcttttcaccatgcgcagctcacctccatccagataagcccgcgcccgtccacaatcgatttgaactcgtctatccgccagcggagcgcggccgaatcgaccttgaatgattcaagcccgccgtcgcgcaacgattcgaacaacgcgtcggcctcggcccgggttccgaacggttccggccatgcgacccatcggccgggataatcggctagccggcgggccagctcctcgtatcgcctatcgtccatcggtcttcttcttgtcatttggcttgtggtcgcggacgatgaggatcatccagccgaagcacgggagcatccggtattcgccgtaccgggtcagggcggccgccaggcgttccgcgccggggcgggtggtccattcctttgagtcctcgtcgtagtcctcggcgatccaacccttcttcagcagcccgtaatgcgccttcttccacgcccagctgacgatcgcgccgaacagattgcccgtcagatacaggagcaggattcccagtatgatcgcgaacggggtgagcacgccccaccagtacccgtccatcagaaccgccccaaccggtgcagggcttcgaccgaatggatgcgggcctgttcgccgcccgctcccccactggcgttcacggccgtctcgttttcggccggcgtggcgaacgccgcgggctcgtcccggcataccaggcgggcgaacgccctcgcctccccgtccgacagcacgacccggccctccgacccctcgcgcatgccggcgaccgtccacaggccggacttcggatcgcgccacgcgcgcccccattcgccgaggaaatgatatccctccggaacatgcagacccatacggacccctccttattcgaaacgacgattcccggtcggcgaagggtatgcgtcacgtcggatccgaccgtctccgtggcgcggccgtgcggatcgggacgatcccacgcggtcagcgcgcgaggccccgcatccggacggcggcgatgcgacggcgccgcatgtcccggcgcgccagatcacgccgttcctccggggtcatgccgccccagatcccgtactgttcgcccgtctccaacgcctggcggaggcattcggcccgcaccgggcaggacaggcacgcctgtttcgcgatctcgttgacatcctccccgcggctaaagccgggggattcccttcgcagatcggactccaagggaacttccggcctgggttgaggggttgacgcttcatcgggccgccaacgcggccctccacgtcctaggcggtgcccccgcccgtttgaatcaaagcacggcccaatatgttcttggccgcgttgacgtccgcgttcgcctcatacccgcattcgacgcaatggaagaccgcttggctatcacggttctccttgacgccattgatacgaactttctggctcatcgtggaccacctccttccgttaaggctctatgcgtcctggccttggaccccagcgctgaagcgcggggcatgaattttttcggtcatgcgtcccgcctcacggcggcgatggcggagcccaaggggccatgcccttcggcgggtcgccccggataccagacggcccaatcgcccccgcgcgcccgcagtccgtccatgaaccgctcgtaccgtggcacgccggacatgagcaggagcgtgcggcgcggaagcctagggttcgcgcccagccatgacgcgatgtccgagacgacgtggaccgcgttgcccgcccggtaacgccggggcggtgtgtagtcggctcccccgcacaggtcataacagtcgacatccacgtaacggccggcgaacagccccgcttgcacgcccacgtagccgcccaggtcgacgaccgtccaatcggcggggacgagcggcgcggccgccgcgtacaggtcggtgaggcacaggaacgtcgggtcgatctcgatgtcctcgaaacgtccgtaccagccgtcgatctgcgccatgtcgagccggccgccgagcgccgtgtattcgtccgcgtccacggctattccttccccgcgcaccagacgcaccagcccgggaccgcgctttcgcagtcctcattgagcaggacgccgcatcccgtacagtagtcgtacatgtcggagctccaggcctgcccgcatatcgcacccgcagccggggacgtcagggtccaatcggtcctcacctcggcctgcgggaggtcaaagccgccacggccgtaggcgtagtttttcgccgtctcgaccagcaggtcgaggtccgcgcccgtgcggggcgcgcccagcacgtcctccgtcacgtcactgccatcccagaccgtgacatccagcgtccggcctttgttgtccgtgtatatcatgggcttatccttttctcagtacgtccagcacgtcgtcggcgcaggaggtcatagtcgcgggtcaggtcggccaccatgcgcattgacgcgcaatgcgcggtcatacggtccgccatgctcattttcccgtctcccatctcaccgtgtactccatgcaagccgtgacatcgacgacgaccccgcactcgtcgcagtggaacctgtgggtctccccgtccagcatcccccagtcggccatgcgcccatcgatttcgttgccgcattccgggcaaatcaatgcgtcattcacaatcatcgtccgttcgccctctcgtatcgttccatggccttttcgcccagtccggtcagcccgtcgcatcggatggtgtcggggaaccggtagccgcgtatcaccagtcccatgcctttcaggcgcttgtagtccccgtcgggcaatgtgacatgcgcctgcgggtcgcgtgcgattccttcgagaagcctgtaatcgttcccgttcaatgcggaaggctcgtccccgatgggaccatgcagtttgtcggcgatgtcggccagcgacttcctgcgggcctgcagattatcgggcaacggcgtctcctcgccgccgcacagctccctccacttgtccgcgattgccttgacctcgccctcgtagtggcgggagagccgttcgatgacacgcagacggtattcgttgaacgcgacctcctgccgcgtgaacccgtcgtagaagccgccgtccggtaggatacaccgctcctccacgtattcaaggtcggggatggagatgcacgccacggcgtcctcacccactgggtcggacagtgccatgtccacgccgatggcggcaagttcggcctgtagtgtgcgtatgtccctcaatgactgttcgattctcagcatggcattcagtcctcgattcggtagtattcatcgtcggggtcgtagtccaacggggcgcattcgcagtcgcctgcgtagtggaagacgtggcggggcctgccgcacatgacgcaacggttcagcacatcgtccactatgtccctcgcgtccacgtctgccatgtagcggcgcgtccagttgggcttgggtgggttgtccccgtagatgagtacacactcgttccatacgctgatatggatgatgccgtcttcgagcgtggccctaatccagccgtgattcggcatggagccttccagcgagcttttgtcctcgttgaattcgataccgcattccgcccgcgatagcccctgttcgagtcgttcgattctcagcatcgggggactcctttccctttcgccccgtgccatgcgtcccggaaccgacggagcgtcactcccctctcagcacgtccagtacgtcgtcggcgcaggagggcctcacggccggcggccgcgggtcggtgcagcgctccgccagcgcgggcggcaataccgtgcgcccgaccggcaccggcctgccgtccccgtcgtgcaggacgtggagcgggcagaaggcgtggcattcgccgtcgtcgcccttgatcatcgcccagcgtcgcgagtcgtgcaccgccgtctcggccgcgtcctcgtccggataccacatggcgccgaacggctcgtcggcgaacacggcgccgcaatgcggatactcgcagatgggaagcaggaagggatggtcggccgtgacgagctccgaatggagcagggcgtcgagcgcgccccgctcgcagtcgggatcgggcaacggctctcccacatggccctcataaaaccccgccaacgcggccgtttccggcaccacaccttccgggtcgtaacggacaagccggccgtcaccgtcgtagagcagatgctccggacagatgcagaccggctcatcgtgccggccgtccagcaccagccaatcgtcctcccacgcctggtcgagggcccagtacgggtccgtccaccactcggcctcgtccccgtcgtattcgttcccgcagcccggaaaggcgcagacggggcggtggaaatgcctgatgtcgtatcgcatgatgttctccggctcccctctaatggcagttggggcaatacctaagatcgccctcgtatgcatcgtccaggaatgcgccgcactcactgcaacgttcttcttcgcaccaacacttgttcgacgcctgtccgcagaacgggcacctgtaccagatgtcctccgcgatggcctccgggtcggccggatcgtattcgtgcgtccaatccggctcgggcatggaagtatattcatacgggttatcgctccacgccctgacagacaccctgccgtccccagccaccgtgatgcgggcgaggccggtctgttcgccgtcgaactggtcgcgcaggccgcattccagcatgccgtcgtccagtcgcgtccagtcgccctcgtattcgagagccttttcgattccggccagcatgtcgaccttgtcgctcttgtcttcgccgcacgcgatgcactcggtcatcatcggctcctttccgttcattcgttccggtcgcatgcgtcccggccgcgacgcatgcgaccggacatggaatccctatccgacggcatcgattgggccatggtcgcccaagcccgcgaaccgcatcccgaacgcctgcacctggtcgaggacgagcgccgcgccagacgcaaggcggccgacgcggcctattaccaggcgaacaaggagcgcatcgatcggcgcaacagggcctggcgcgaggcgaacgaagaggagatgcgccggtatgacaaggcgtacgcggcctcgcaccgcgaggagcgccgcgaggccgcccgccgctggcaggccaggttcaaggccgagcacggcgtcagctactccgcctggcggcgcaggcgcctgagggagacggacccgcagacggccgccagcacgccgcagacggccgcgcccgcgaggaacacgggcgagaacgggcaggcggcggccgataacaacatcaggtcggtcagcgccgcgtcggcggaaccccacaggtccggccggcgcctgtgacgggcccggctcacagccaatcgcccccgatgacgttgccggacgtgtcaagcacgccgttttccacgagccagtcgcggatgtccgcgtcgagggcggcccgctccccttcggtcagccgcaggtcgaaacgcccatcctcgtcgccgagaagatagacgcgcagctccgcatggacggggccgcccaaccggccgcgcgccacccagcgccagtcgagacacgcgatggccagtccgtcgcggtcccccacgccgtacgccccgagcgcgccgcaccgacgcatccattcgtcctccatgccgccctcatccagatcggcctcccagccgtccggcgccgtcagctcgtacgtattccatctattcagtccgaaatccatatccggcccctttccttccgccgacaggcatgcgtcccagccgaaaaacggaaggccccgtcgcatccgttgtcggatgcgacggggccttccgtgtggaatggcgcctacttgcgcttgccgaggatggcgagcgcgatggcccccgcggcgagcaccaccacggccaccgcaacgaccgccactgcgacgccggtggaggcgagcccgtctttcggggattcggccttggctttggctccgttatggagatattgccccggcttagccggatcaggcttcggcttcgggcgcctcgtcatggccttgacgtccaggtcctccatggcgataaggatgttcttttgggcgagccttgtcgtggtcttctcgatccagtcgttccgacgtcggacgatacggccttgcagagcgttgaatcggcttagcgtctttcgcctgcgcttggaaacgaatttagcggtcctgccgctccgtgcctcgttgacatggtcctgccgggccatccggcgctgaagatacttcaaccgtttcaattcggccttcgacggcttcggcatgtcttcgaacgttccatcagacgaagcgagcgtatgtacacagccgcggtcgaggccgatcgcgccatcaccggtcctcggcaacggcaatggcatgttgacgaacacgaggctacgatgggtccaatcgacatggacgctcgtatacggccgtatctcctgaccgacacgcacatggacgatgatgcgccaatgcgccttttcgccgggtttgacccatcgcttcgggttcatgcctgtgatgacgaccacgtcgctcttccggccggtcttatggaatatggcgttgcctgatcgggaggcgttgcgccagcagacgaagcccaggccgcgatggcgcgacttgaagccggggatgcggcctccaatggtcttcctgcgtttgagtccggcgaaccattcggtattctcgatcctgtccgtgctggacagtatgggcgccggaatgcccgccatccacgagcattgaagacgcgcctccctgtccgagatcaactcaggtacgtcagggccgcccaaaggctccttgacccagtcgacgacttcacctgtcgcatcgtctttgacgggcacgttgcgcgtgcgttgctcgcgcctttggttgaatctggcgcgccatccgtcgcacagccacaccatgacgcgctcgggattacgcgtccagcatgggttgccgcagcggtccacgccgaggaagacgctcgcgccggtgtgcttgacgccattgatgcggaccttctggctcatcgtggaccacctccttccgttaaggctttatgcgtcccggccgcgaaccccagcgctgaagcgcggggcatgatttttttcggtcatctcgcacgcgtacgccccgtctccgaccgggtagaagatgtcgggatccagccgcgagcatgcggcgcgtcccctccagtcgggccctttcaagtcatgcccctcccggtcgccggcgtacggccggttcgatgaattcgagacggggcacggggccgcgcgtcctgtcacggaccatgcggatcgccgtggcgaccgtccgccatggcaggcctgtcctcgccgccagttcggtggcgctcatgcccgccctgtgcgcctcggccaggcgttccgattgctcatcgttcacgcgatctcctccaacaatgcgggcgcggccttggcgcgcgccgtccaatcgtgtatcaccgtgtcctcgggcacgccttcgacacgccggtaggagacggcgagcccgccgtcatgctccacggcgtccaggatcacgccgacgggaattccggccgcaatcaggatgtcgcatgcgatgcctttcagatcacggcgcgcgagatgccgtacggcctgctcgacccgctcctcgcggtacaggccgagcaggctcgtgggatcgggaccctccatcccgtcgtcacgctcccatgagccgtcgttgaggacgcgcgtggcgggcgcgcccgacacgacgaccacgcaacgcgacccgcagacgaacgcctccctcacgtccgcccggtagccgagacggttcaacgcgggcaggaggctcgcgtaggaggcggacagtcgtgacgggcgcatcatcggccgtcctcccccatgcggcgcatgtggaccgcgccccaatggaagaccagcagcaggccgcagccggcgaacagtacggacgagacggccatgagccatccatgggtctgccacatgagcatgccgcccgccacgcacagtatgacgagcaccagattcgccatgtgttcgaattcgctttccaaggccgtcccccgtcccgtatcgcacgtttccatgccccgcgtatgcgtccccggtcagcgcccgtccggccgtatgcgatcgccccgacgggcggccatgcacagggctgcggtgaagaagccaaggatgaagcccgcgaacaggcatatgacggcgatcatgatgatgtcctttcgttttctccggatgcgcgtgccgctatgcgacaaggcaggcccatgccctcggacatgggagggtgttgttccgcttgattttccttgcggagccgagcgacggccatgatgcttcttgcttccggtgattccgccggacaaaaggaaatccgtgaacaagatcgtggcctatcgctgtatcgtttttttgaggaccgtcgccccctcttctgcgacgatccacctgtttccgttgtctgctcggctgtttcggcggcttccgttccgctgaggttcactggtggaggagtttttcgagttggatttcggcgatggcggcgttcatgtatccgcgcgtgtggaagtgtttcgggttgaggcagccgattgtccatgtgatgcgtccggtgggattgtccacgtggcgtcgtgcctccatcggccgcccgcagttggggcagaaccagtcgtttttcaatggttgtcctttctgtcagaatctgagtgtgatgccgcctggcatagggctgcggtgaagaagccaaggatgaagcccgtaaacaggcagatgatggcaattggcatggtctttcctgtttcgtcagatggtttttgcgatgaggctgattgagacgatcagcacggcccagaggatcgcgatgccgaccgtccaacggttcaggttcctctccgcgaccccggaggtgcccgcgttggcggtcaggccgccgccgaacatgtcggacagacccccgcccttgcccttgtgcaggaggatcagcagggacagcaggacgctcaggacggcgacgatggttttcaagacgatgacgagaacggtcatggggttccttcgtaatagaagacgacgatgatgacgatcagggccgtcagatacgcgacggcccaacggcgataggtgctgcgatgctccgggtcgtccgtccatacgctcatgaggaggaacgcggacgaggcgatgagcatccatagcagcatggcaaggatcacgggatgtgttaccgtcacccgaacaccatgagcgtgagttcgccgaacccgagatccatgcccgcggccaatatcatgggcaggatgacgaacacgaatgaggtgatgctccaggccggccattcgcgggcggccggagtcgcggtcttgcgcagttcgtccacgatctgccggcaatatcggcctatcggctgaaacgggtctgatgccaacgatttcctttccatgcttcctcctatgcgtccggaaaacggaaaagcccctcccgcgcgggaggggcggaaccgttccggcatgaggaacggcggatgggccatgcgagcaaaggaattcttgtcccgcgaccggctcatgccaccgatcgcagactatctcccgttcgggaacccggcgtttcgcatgtggccgccgggcccatcgtgcttcgacgggattcgaacccgcatcaccccaaaaacggggcatcctgaccgattgaacgacgaagccatgttgcggatacgatgctggagaggcggttccgttcaggccactgaggtgcaggcctgcgccttgaccatcgttccactccgccccaatatggcagcgggcgggtggcggcgttgacatcgtattcgcaagttgggtgcggaagcgggcgctgcaacggttacgggtcccagttatgaagagaacctaccgtggcatcgttccctttccggcagacgttcgaaccggatcgggcggcgttgacgcccgtgtttccgccagtgctttcgccgggattcgaacccggaccggacagttccttggattgtcgcctctaccggttgggccacgaaagcatgcgcaggcaatccgcagggatatgcccgcgcagtccactgtggatccggccactcgtgccgaatcctgcactcatgcttgcggtggacgcgcatactgcaacacgaggcatgacagggatcacagggctgaacccccatgctccaccgagaccgttcccacatcctgtgggtcggctgacaagaaacgcggtcgcccgcgttccaggaaacctttcccgcactgggcggataggctttatcggattcgcaccaacccttccgacagagagctgttcgcatcatccacccataggatgatgggcgctgacgatattcacgtgtccgtcgaacaaacggaggcgtgaaccatcggacacgacccgcatggtcatgactgccccgccgggaactcccaacgggcatggaatcgtatcgagcggtgtacgggaatcgaacccgcatcatcagtttggaagactgaagcactgaccattgtgctaacaccgcaaacaggaatccgcacaccgtatcagaagcggattccttagcggacgccacgggattcgaacccggatctccacccacagggggtggcgtgctgccattacaccagcgccccgcacgggtcatgaactccgtgcgttcgcctagccgtgattcgtcagggttgagatcggctggaactccgttgcccgtatccgtggaatgctttttcattctgcagatacccctttcgtcgtgacggtcaactgagacgacgcgcatcgaacggcagcacggtaccgtgccaccgtgggtaggagccattcgccgggtcagcgtccggcccctcttaaccgtccaatggttctatttttttagggtgccggaaccatcaaagatatggcactcgtgcattgcgctggaatcgaaccaacgaccttcccgttatgagcagggtgctctaaccgactgagctagcaatgcaaagtgcccaaggccggagtcggaccggctgcgcccggtttaggaaaccggcgctctatccgttgagctacaagggcgttgcctcgtaatgcacgaaccgtacgaggcgcgacggcgtgagagagaagagaagagagaatccgctcattatggttgacggagttttcgtgcgtgccctcaacgagaatcggactcgtggccttccgctccggaggcggacgctctatccactgagctacaagggcgtggcgtcgtttcgcggcttgggtgacgcctgaccctgtatgtccggtacaacaaacatcgaatcgagtgtagagggaaaaccgattcgacgtgctgccgccaagctcctcctcctggattcgaaccaggaccaaaggttccaaagacccgtgtgctgccgttacaccaaggaggaatgcgcgcgaacgcatcggacacgtatgcccgactgcgttccgccatgccgatccaacccgttttttgccggccggattccaggccctatcccgtggcctatcactgcagatcggctagcggatggtgcgagagtcgaactcgccagggacttccgccccaacagtcttagcaggactgcgcctttgccgcacggcccaccatccatgccagtgtttgcgattcaggggcacaccggccaaacctcgataaacccctcatgggaacgattttcatgcgggggttcgcggagtagggaggattcgaacctccgggggcttgcacccctgctgctttcgggacagtcgcattcgaccgctctgccaccactccaccgatccacacgaaggaacaaactggtcgacgtattcgtgcggatctcgtgctcccggtgggattcgaacccacgaccataaggttagaactcttctgctctggtccgctgagctacgggagcaaggtggatgcctacttcggttcaggaaaagcgacaacccttttccaaaggagtaattcgttttttttggaatattgttgttacttaggcatccacgttttccgccttcttttcgcgcgtggtctgcggataccaccgtatttgcgatgttgcgcttacgcatggccttgtgccatgcgtcgtgttcccggcaggcttcgaacctgcgccgaacgccgtttaggggcgtgcctctgccggttgggctacgggaacctggccgactgttcctcaccaaggtcgaccttcgtggccgatatcaacctgagcatcccgcaagagagaaggaaatgggatgccggtcatggggaagaatgcggggcgatggctccggtcgaacagccgaagagaatagaacatccttcaaacgacgatcggaaccgggtgggacggtatcattcggcttgacgaatccgtgagtagtaaggagccaaacgataccgtcctggcgcgtcgggtgagtctcgacctcacacccaccggttttggagaccggtactctgccgttaagctaccgacgcatgtggagcaggaagccgaagataggcagcggaatagcttcctgctccgagtgccctcaacgagaatcggactcgtggccttccgctccggaggcggacgctctatccactgagctacaagggcgatggcacatttcgttcctttaacgacgtacgcctgtgccgggccgtgttcggcatggtcctcattgatgtcgctccggagaccatcgctgcaaaaagagcgtcctccccacccgtcctgaatgacggatggagggaatcgggagactggattgggttttcaccagcaacgtcgaggacaaacgggaaggttcagatcccctctggacgtgccgcatgttcggtcgcaaaccaccctgccgggccatgctcgccttgggcgtcccgttttcgatacgcctgttcagccactcccatgaaaacgactcattgatcggatgaaccgtttcgtgcctccgtctgaaatcgaaccagcatccacggtgcttcagaccgttgctctaccgtttaagccacagaggcgccgtgcgacggaccgtcatgggatctgggttacaggcccttccccggtccgtcgcaccagtgtgtttccttcccctgtttcgcgcgcggccggaggaagaagctgccgcagcctatctgataatagattgatgcgcttatgcatggcgatgtaccaagcatcgtgcccccgtgggattcgaacccacgaccacaaacggattaaaagtccggtattctgaccgctgaactagaggggcttttctgatatcaagcaacaggaaggaattttgaattgcttccaatgcgctcagggaacctatcgtcgacgttgaaaatcgaaaccttgtttcgaagatttcctgcggcgatgaccgcatcattcagatctcgatattcaccaccgtagaatgtttccccttttcgggttacattgacttgccatcttttatctttgttggaccagctcacattgagatggccactccgtgaatttgttgttgtcgagatattttgacgatttaattcttgggtgccgagtctcaagtgatttggattcacacatttacgattgcggcaaatgtgatcaatgatcaagtcgtctggtatgaaaccattggcgattcgatatgcgaatcgatgagaaccgtaacgttggcctccatatccgaatactccgtagccgcatctaagagagcccgtccattcccaacagccgtatgtcatccgctggacgttagaccaaaatctgacagcgttctgtcgatcgactggctcattgatgcttttacgtcctccaccttcttgaatgggaagatgaggtaatagatgatcaggattgaaacaaagcggatttccacagatgtcatccatccagttgcaatctccctcatcacctttgaataaacgataagctatccttttcagaggaatggactcattgtttacatagatgcacaaatcggctcgactgttgtctttcacgattacacacccgttatccaattgagtggtgagctcatcgaagtcctccacagagaaagacttgtgatgtctgagtctatgtatcggcttccctcgataccactgctgataatgtccggtgcaaaatcctcttgcgagaacctttttggcgcatcccggaaaggtgcattgtgccatatattcctttctccttgggtataagaaaaagaaagcatggagtgtttcgttccgtttacggtgtccacccacttcgaggtcgtgttcgttcatgcgtctccggattcctcggcacgaaaatcaaggaataatagatattgcatccggatagagcggatgacggggttcgaacccgcggtctcctgcttgggaagcaggcgtgctgccactgcaccacatccgcgtcgcggggacgggccggccggcccgctgtctcgcgtattccattccgggggcgcgccgtcttgacatgacgtcgtccctcggaatgtccgcgcttacacgcggcggcatgccgcgtgtcgtggagccggcggggttcgaacccgcgaccttcccgttgcggacgggacgccctgccactgggcgacggccccgaagcgcccctgacccgattcgaacgggcgacacccggatccggaatccggtgctctgtcccctgagctacaagggcgtgcatccgccatgcgacggcatgcgtccccgcactgggcggggggattagggcgggatcatggcgctggcatggtcgcggacgggagaataaaagaagaaagaacccgtctcgcatgccatcgttcccgcacgcgcggagagaagagtccggcgtcgcgtgcgggcggcgttcacgccatgagccgcttcgagccccgggccggacacgatccggcgaccttccgcttacgaggcggacgctctaccggttgagctaccggggcggatgccggaaacccccggccgtccggcgacggcccccacgcgcccgtcacgggccatggggccggaccgggaggcgggcatgccgtcgtccggtccgaggggcgcgccgtttccgcggcacgggcctgcgcgccatggaggagtcgaacctccgtctacggttttggagaccgtgtgttttagcaagttggcgtccgctttgtgagcggtgtttttccgcagtgtaggcagcgggttttccgcagggtgtgcggtatcggccgctgcctgtctgcgttgtgttggttatttggtcatgagggcgtgttcgcttcggtaggagcggccctcgaatctgatgagccgtccgtggtggacggtgcggtcgatgagggcggcggccatgttcttgtcgccgagcacgcgtccccatccgctgaattcgatgttggtggtgtagatgatgctccttgtctcgtaggaatcggaaatgatctggaagaggagcctgctgccctcctcgtctatgggcaggtagccgaactcgtcgatgatgagaagtcgggccttgccgatgctcgcgagttcccggtcgagccggttctcctgctgggcgcggcgcagacgcatgagcagtccggtcgcggtgaagaagcgcaccgggacgccccgctcgcaggcgagccgtccgatcgcgatggccaggtggctcttgccggtgccgacgggcccgtagagcacgaggtcctcgcatccggcgacgaagtcgaggttctcgagctgcgcgcgcccccagtcggcgggcatcttcaggttggtccagtcatagccgtcgagggtcttgtcggcggggaagccggcctgtttgagcaggcgcaggcgtttggatcgctcgcgcgagtcgagttcggccgtgaaccatcgttcgatgaagtcgagctggttgggcgtggcctcggcgagcgtgcccgcgagcacgctgcgtgtcagggtcaggctgcggctcatcttcaggatcctctcgctcttctcggtcgtggacgcgcgacggcggcgggtctccgggatcaccggatcgggtctgacgctcaccgttcttcccctccgtcgtccgtgccggtgatgaaccggtcgtagccgctcaggtcgggctcctcgatcccgccggggtattcccactcgccgtcgcgcatgcgcaacgcgataggggtgagcgagtccgcgtgcaggcccatgtccctgttcgagcgcaggatctcgccgcacgcctgcatcgcgggatcgaacccggccgcccggcacgcgtccccgatcgctttgaggctctccctcaacgtcttttcgtccatggaatcaagccacgcgcgtatatcgtcgggcacgtccgggcggatcgagctttcccgccacgcgcggggtttgaccgcgagccggggaagcacgagcgcgggatcctccacattgcgcgaccgtccgtactgtctgggatactccgcgaagagctcgccggtggcgggcgaggtgagcgtgaccgtgtcccaccggatcgcggccaataccctggaacgcgccgaatcggggccggcgaggtaccggttcgagtcgatgtcgaccagcccgtacttgtcggccgtccggctttcccagcgaaccgggtcgaacgccgtggacggcaacggcatcaacgcggccctctcctcgtcgaacacctcggccacgggcacgtccagcaacctcgggcaatacgagtccctggcgagcccgtcgcaccgctccagcaggagacggctcaactgcccatacgattccgcgcgcatgggcggcaccatgagattgcgccgcaaaaacccgaccgcgttctccacgctgcccttctcgttgcccgaatacgggttgcagaaccggacctcgagccggtaatgcgccacgaacgcggagaacaccccggtcaacgcgacctcgcccttcgcgttgcgccggccggcaccggtcgcgttgtccatcacgatcacgggaggaacacccccgatatgctcgaacacgagcatcaggccatggcacagacactccgcgttctcgcccggcaacgccacgcacaaccgcatgttcgaatacggcaacgagaccaccaggcaatgcacgtccgccatctcgccagcgatccgggcccgggccacgccgaaatcgacctgcatgctgcccgccgcccactcgagccgcacgtacccctcgcgatccggcacgccgcggttcgcctcgcgccaccggtgcacgtaacgcatcgtggtcgaatactcgccgtcgtaatccgtctccgccagcagacggtcgtgcacgcgcctgatcgtgtgccgctgcttcctgggcagcagacgatcggcctccagccactcgtccaccagatgcgcgtacgggtcgatcttcgacccgtacctgcgatccgccttcggcttgggcgagcaatcctccatatccgcgtacttcgcgaccgtcccgcgatccacgtgaagacgccgcgctatctgcgcgcgcgacattccctgccggtcgagtctcctgatatcttgcacaatgggcatcggtatcgccatgttcctttccttcccgagcgccggccggcggcaaccggccgaatcaaaaccgattggcaactcgggaatatacaggcggcggcaccgatgcctatcacatcaccgggaaacgatgacgacaccggggaaaaccatcagcccacactacggaaaaacactgccgaacctgtcgaacaaacattgaagcaaaacagagaccgtcgggctgccgccgtcccgatggcgcgttcattgtttccgctcttcggttttcaaccatgccatgccggccgtgtccgcggcggcatggcatggtatgcgtctccggacggcaggccgacggaacgcgttccgccggccgagtggttccgggcggcttcgctccgccggcctgtccgattgattcgggccgttccgccggatcgggctacgaaaccgaccggaatcccgtcgtctcatgaccaggtgtcatcccggcttccaccgttcgccgtcgatccaatgggactggcctgacaggcggatcaaaccgcctgtcgtcgatccgcctgtttgcggccaggcggatggtggtggcgggaggactcgaacctccggtgtttctctgtcgcagagttacagtctgctgccgtcgccgctgggccacgccaccggtgcatcgcttttgcccgtcacggtgcgatgcgtaccgtgcccggttcatctgtgcccgcaagctcatgggagatggatcgggtcgtggagctgccgggaatcgaacccgggtctggcctgccgtcaaccattgcttgccgtcacgtgcgtatccgacgcttgacgctcatccgtggacgggtgcgttcggcgaacccgcacggcttgtagacgatgttcgtatgctggccgggcgaatccatcgtccgactgtccgaccagtccgattcgaagttctccggctttgacccgttaatcggcaatgggatcaaagccgggtttcacgccgcgagggtgaaacgggaagaagaaacggtgttggcgttcgttcttgtggcaaggttgatgacggttgtccctgccggcctccggcacgtagcgaatggtctccggcaggccatcgaaagcctgtcagccccgtgacatgggtcggatggcgtgaacatcagccatccgacccatgtcttcaatgccgccatcttgcaggggtggcgtctggtccaaggtcttgtcctcacgcccatgcgggtatgagtcgccttggacaggaatgtttctgatgtcgctcttcggttttcaagtctcgtcgccgaccgtccgtgcggtggcatgcgacggtatgcgtccccggtcgcggcgatcccctatgcgggggcgtgtatgcattccggccggcctgtatgcatccgtatgcatccggggatgcatacatcttctcttcccgtttcggcttggttccaacgttccggggatggtccgggggcgtgtatgcattgtatgcatcattcccttataggggattcgggaaaaaggaaggaaaccccttatattgatgcatacaatgcatacaagagaaaggaattctgtttttccctttatatataagggttttcgggctttttccaagccttttttgtatgcatccccggatgcatacagatgcatacatgcatacaagacggccggaagaacttcacaatgttgtaaagtccgcgcatgcggctccacggcatcgcgaaccccccggggagcccggcgaaacggatcggaggatcgcttgacgtcctcccctcggctgaagccggggattcctcccatcctgacgatgggaggaatccctccccacgcctgaaggcgggggcaccctcacggcaaaacggtcggggcgggcatcggggctgtatgcattccggttcgcgtgtatgcatccgtatgcatccggggatgcatacgtcttttctttccgtttcggcttgtttccaacgttccggggatggtccgggggcgtgtatgcattgtatgcatcattcccttataggggattcgggaaaaaggaaggaaaccccttatattgatgcatacaatgcatacaagataaaggaattctgttttttcctttatttataagggttttcgggctttttccgggctttttctgtatgcatccccggatgcatacagatgcatacacgcatacaaaacgggccggaaaactttacaatattgtaaaggccgggaccatgcccgtccggccccgcccccgcgtgacgcatacatgcgcgcatgatcgaaaaccagtacggccgtcccggcatcacgggcccggccacccccgggcacgcggacggggcgttcctcgcccgcgtcgccgaccagcacgtgctgctcagaaacccgacgggcgtgaccggcgtatgcaacaccatccaccccatggccggcgaccccgcgaccgacatgcccggcatccccatgctgcggagcctcgtgcagagggacggggcgagcacatggacatggaccgatccgagcggcctcatgcccatgtgggcgatccgcatgatcagcgagatcgtgtgccccgaccccgacctgcgcgtcctgcccgacccgcaggcgcccggcaagggcatcctctaccggcgcgtcctgcccgaccacaccgtcgaacgcgcgcccagccgatgggcgcccatcggacccgtgcgcatcgcctacggcggctccaaggccaaggacgaccaattggacggggacgacggatgggtcaaggactcgctcctcctcgccggacagaccatacgccgcggatgcagcttcatgtgcacggacggggagatccgcttcgaacacgaccccgtgtccggcgcgtggacgcgcaccgagacccgatccggcgtcacccgctcctggaccggcgcgaaagacctcgaatgccgggaaccggatttcaggacggccacgctccgggagacgacgccgaaccgggtcgacgagcccatgacctacacggtggagaccggatgcacgtgcgaacaggccgcgacgctcgcgaacgaggccggatggatcctcgaccagtggaccggccaggacacggacagcaccctcaacctgcaacgctcgctcgccgccccgttcctccgcagccatccggaatgcgcgtacgtgtaccaggggccgggcggcaccggcaaaagcacgctcgccaaggacctcatggagcatctcggcgaccaggccacgaccatgagcctcgacctgctcgcccagccgaccgccatgagcgccgaaaacaagatgggcgacctgatgagccacctgctcgccctgtccgacgactacgatccgacccacggacggttcgagaagagcctgccgaacctgaagaccctcctgaccgggctcctccccttctccgcgcgccgccagggcgagaacagcgtggacggcatgccgcaaagcacgcatctgatcaccacgaactaccatctgcccgtgtccagctccgaggccgaacaacgccgcttcgcgttcagcaccatcgcctcgcagacgacgcgcgcccgccactatctcccgttccgccgcaaacacggtttctggccgttcatgctggtcggcgcgatcacatggctgaagatcggcgaccggcaatgccggtccgtcgcgttcgtcgacctggaaagcctgtccgacatggaggtcgccgccatccgcagcgtgctcgacacgggcgtcgtgatccccgaccccggcatgcgcgtcaactggaagaacatcggcctggtgcgcaccagcacgcgtatcggcagcgaggacgggcgtccgcacaccgcgtaccggcccgccccgagggcgacggcctgcacgccgtatggaaggcgtgcgcggccgccgtgtccggcatgcccgccgacgagcccgagatccggcccgtccccgaccgggatctcaaggtcacggacccggacgggtgggcggacatgatccgggaggcggatccgcggatcttcccctgccatgcggacaagagcccgtccagcgacgtgccccaccattcgtggaaggacgcgtgccaggatccgcgggtggacatgtcgcaccggatcgacccgtcgaagccgatctacgggacgaccgtcgccgacgactacatgtgggtggacctcgactgccacaagcaggatcagacgtccggctgggagcagatccagacggacgtcggcccgtacgggacgccgctcctgccgcgcacgttcgcggtgcgcaccccgtccggcggcgtccacctcctctaccacatccctgacggggcgcgcctgaaatccaggacgcacaacggaggccagatcgacttcaaaatcggccgcgacggctacgtggtcatgggcgggtccgtcctgcccgacgggcggcgctacacgccgatagaccggcccgaggatcggatccccgacctgtccgacgcgttcctgcgctgggcggaacgcgtcgacgcgaccgacaaaccccgtcgccccgcccccgcgcggacggcggccgcgccggcgggcggcgcgtacgatccgctggccgcgttcgacctgccctcccccggcgtggccgggggcccggagggggagccggacatgagccccatccccgaggggcggcgcaacgacacgctctaccggtggggtacgggcgttggaagaaccatcccgaggacggggagcggatcgcgcgggacatcatggaacgcggacggatcagcgggctgcccgatcgcgagacgcttcagatcgtgaaaagcgtgagaagttcggtggaaggagaccgatgacgggcatgagcacggacgaatggcggctcctggtctcgacgcgcgccacggggcgcggcgaccggacggcaggcagggacgacaacagctgcggggcgctcatcgacgggcgcggcgaacggcacaccgcgttcatcgaccacatgcccgaacatccgagcgacgaatacaggcagttgcacgagtgggcggacggatacgggtggatgctcaccccggccgcggaccggctggccgaccggatcatcgacggcatgggcccgcatcccgcgcccgccgtcgcggccgcgctcgcctcctgctatcccgaccggctgatcatggcggacacgcgggccgtccgccgtcccgcggaacgatggttccacgaggccggacccctgcgtctcgaccggtacatgcacggcggcatgggcgacgtggcgcgcatgatcgtccacgaccggctgcacccggacatgcccgtcctggcgggacgccgcctggacgagctgatcgacgcccacgcgtacgacgcgctcatcgcgacgggcatgggcgacatgctcaccgtcgcccaatggacgagtatcgcccgccacggcgatccggcagcatgccggatcctcgacgggatgcgacgcggcatggacgacgcgttcgcctgcgggcgtctgcgcggcatgtgcacgcccgcataggccctctccggcggatcccgcgcgcgcgggacgccggaaagggaacctgaggaacaacaagatcgtgacggcaatggcctgcgcgaccgcgagcatgctggccggcctggcactggccccatccgcaatggcagccgacacgaccatcacactgcaaggcgcagacggagcaagcctggccggacacacgttcaacgtctaccagataggcacatacaccggagtggtgctgaaaggcaaccagatctccagcctcggaatccaaggcaccaccgaatccaacgcatgggcggatgacgccatcaccatcgccaacggttacgacaaggacacgtccgacgacatcaccaaggtcggcggatacgatgccgcaggcagcatcgccgccatcgacatggccaagcaggccaagcagctgagcaacatccaagccgccctcaacgcctccagcaggaagccggccaccgtcacgggcggagccgacctgaccacgcaggatgccaccctgaacatcaccgtgccggaagaaggcctctactacatcaccgactccgcaggcagcccgatcatcatcggcaccaaatccggtgcaggcaccgccatgagcggcgcccccggccgaaccctcggcgtcgcggtcatcaagtcgaagagcgtgacaaccgacaagaaggtcgtcgtggaccgtgacggccgacaggtctccaagcagggtgatgccgccgacccggtggccgtgaccgtgggcgataccgtcacccacaccatcgacgtgaccgttccgaacacggccgtcaaattcaagctcgccgatgcccctgccggacaggaatacgtgaaaggcagcctgaaggtggctttgagcgggactgccactgacgtgaccgccgataccgtcatctacgacggcgaaacccagcacggcgcgaaaaccctgccaggtgacgccactctcaagaaggaagacagaaccccggccgacccggatatcaccgttccggccggaggctgggctctgaacgccaccaagctcatcaccacgcagggcggcaagaagatcaccatcacctaccagagcgtcgtcaccaaggccacggccgagaaaccatccgaaaactcggtttccggcaccgccatcttcaaggacggagcccactacaccgtcgtcaccaatggcgacaaggttgacctgaaatcctacgatttcaccctcaagaaggtgagcgcagccgacgtgaacacgctcgtggatggagctgaattccagatccaacgcggagacaaatacctgaagctggatacgacgaccggcgaatggtccgaagccgccgaccaggcttccgcgaccacattcaccaccggtgactccaacaacgacggcaaggtcgaccataaggacaatgccgcgcaaaagggtcttatcgcattcaagggtctcggctacggcacctatacggtgaccgaaaccaaggagcccgccggctatgcctcctatgcgaagccgagcttcaccgtcaccatcgacgatgcaggcaccgccatcaggttcgccggcaaggatcagccgggcctgaccaccggcatcgacaacaacacggtccaagtcaagaacatcaccaacctgacccaattgccgcagaccggtggagccttggccttcgccttctggctggcggtctcctgcccattgtggggcagtggaatcgtcctcgccgaacgcagcctgaagaaccgtcgcaaggcagtcaatctggccggcaacggtctcgcctgatccaagagagaccatgacgcgggacgtgcgtcggaaaacgaaaacccgtcgaacgtcccgctcaataccttttttccaaaaccatgccgaacatgagattcaggggaagagaaaacacaatgcacagcatattgaaacgttccgccgcactgatcgcatccgcggccacgcttctcggcggaggcatgctcatggcgggcaccgcgcaggcggacgggatcggcctgccggtcatgaccatccatccggccgcgagcacatcgtatccgaaggagctggtcaacggcgatttccagacgttcggcaaccggatcgtcgacaaacgttccggcggccggcagtacctctcgttcgtcgacggcaacggcatggccatggaaggctcgagcgagcgaccatgggcgaaggtggacggctgggatgccgtgaaattcggctggaaatccaatgattccgtcagcgggcacagagggatcgtggaagtccaacgctttaggacggccgtcaaaggcagcacgggcaacgtgtggggcgagatcgcggccgccacgcagggcaaatacctctaccaggacatcgacacggcgaacacatccgacgccatgtacacggtccgtctgaagcacgccagccgcaacaaggacgccagggacagcatgcaggtgctcgtcggcgcgcccggccgggagaagccggtcacgatgcgccgcaccatcgccaatgcgggcgacaaggccggcgaggaatccaccacgatcacgtccacgggaaccggccaggacgaccagtgggacacgtacgagggcacggtcctcgtccccaggggacaggatgtcacacggttcacgttcaaaagcgtggccgattcgaacagtgccggccgtcccgacagcgcggaaggcaacctgatcgacgatgtcgtgttcaccaaggcctaccagctcacgtacgacgcgaacggaggcgtgaaaacccggaccagccagatcgactacacgacaggcggtgaaacccggggcaaggtgaagaccgtgcgggattcgcccgcaccgcccgcaggccaagagaagatcgtcaacggcgacttcgaatactcggggaccggggcgggcctgtccgactccccgtttaactacgtgagcctgagccggaaatcctactattacaaggattccaggaacgtcaaccaccgtgtcgccctgcccgccggattcgacgcgaaacggttcgcatggaaaagcgaccagaccggcaaggatctaggcaacccgccctacgaacaggccggcgacgtgcaggtgtggaacaggtacgacggctccaaccattacgccgaactcacggccgcccaggccggatcggccatctaccaggacatcgacaccgaatccgacagcgacgtgcagtacatcgtcagcctcaggcacgcgagcctgaacgccagccacctggacagcatgcaggtgctcatcggcgctcccggccacgagaccccggtaaccatgacccgcgtgaccgccaacgggtacggcgacaaggttggcgaatcctccgacacgatcgccaccagggtgtccaacccgaaacccgcggacagggaggactccgaccatacaggccaatgggagacgtacacgggaaccgtgaccgtgcccgctgggcggccggtcacccggttcacgttccgcaacgtgtcgtcgaagagcgcatggaacggcaacctcatcgacgacatcgcgttcacgaaagcccgcaggctcgactatgacgcgaacgggggaaccaaagcgcaggccagccagatcggctacaggaccgacgcgacccaaggcgcggtggagaccgtcgcatccaagacccttcccaccgaactggtgaacggttcgttcgattatctgctggatggcggttgggatactatcagcccggtaggtcgtggcggatacgctgatgaccgtggttggggcaggttcacaagtgtggaccccgctagcggcgaatacatccagaacgccggacagaatccggcaacattcgattccaccggcaagtgggtgaagtggcccggtttcgatgccgcgaagttcggctgggcttcggaccaaaagggcggacagccgcaaggcggagtcgggttgaccgaccggcccaatgcggtcgaattgcagcaggattccgtgacaggcaacacgtatgcggagatcgtcggctcggagaggggcaaggcgatcctacagaagatcgacacgcagcatgattcggacaccgtatacacggtgcgtttcgaccatgcgagcctgtccaaggagcacgcggactcgatgcaggttttggtcaacggcaagcccgtgaccatgacccgcgtcaccagcaacaaggcgggtgacgaacagggttggaccggtacgagcatcaccacgcacgcgaccaacaccaaccgtttccagcatgacggccagtgggcgacctacgagggcaaggtcacgatcccggcgaacacgcctgtcagcacgttcactttcaaagccctgaacgccgtggacccgaccaagggcaacctgatcgacaatctgacgttcaagatcgcatacaggctcagctacgacgcgaacggcggaaccggccaagtgccctcgcgcaccgagacgggcaggaccgaaaccgccgcctccaggatgaacggcacggtcaggcttgcggccgacagggacaccgaaccggagtccggaaccaccaccgacgatcgcaaggtgctgaccgacacgatcgccagacaggatgatgggaccagtcagcggacgatcacccgatccgacggcagcgtgcaggtgcagaccatcgccacgacgggcgccgtatccggctgccaggtctactatccggccggcgccaggatcaccctggcgaccgcgaaagccgactccgactgctgggattccagccagatcggcaagaccaaccgcacgttctacgggtggagcgcgaacacggacgccaacgacagggacgtgcccgtcgccgacaccatggaccgcgccaccctggatgcgaacgtcaggacggagatcgtcatgcccgccagggcgaagaccgtatacgcattgtgggccatcaaccccaccctgtcgtacaacgtgaacgcgcccgccggcagcaacgcgcccggcacgcccgcatcgcagaccgtgccctacaacacggccgccgccgacaaatccggttgggcggccggcgacacgggcaagattcccggctaccggttcgacggctggtacacggccccgaacggcggaaacaaatacgatttcaacacgccgctcaccggcaacgtgaccgtatacgcgaaatggacggccaacggctacaccgtgaaatacgatgcgggcggcggcaacggcaccatgagcgaccagaagttcacgttcgacgtgccgcagaacctgagcccgaacaccttcactcgcgacgggtacacgtttacggattggaagcgtgccgacaccggagactcctacacggatgggcagcaggtccccaacctgaccagcacgcccaacggggtcgtcacattggtcgcccaatggacgcccaaccaggcggcgatcaactacaacgcgaacccgccgacaggcaggacgccgggtggtcagggcaccgccaactggacgggccatacgggtgatacgccgaccatcagccagaacggctggacggtggacggttacacgttcaccggttggaacacgcaggctggcggcaaggggcaggcttacgcgcccggcaccaagtgggccgcgaacggcacgctcaccctgtacgcgcagtggactgcaggcgaggccagcctctcctacgacggcaacggggcgaccggcggcaagaccgacccgcagactggcaagaccgacgagaagatcaacgtgcgcgacaacggattcacccgcgacggctacacgttcgtcacgtggaacactcaggccgactgcaagggcaatgcagtgaaacctaacagcgagtggacgttgcgtggttccagcaccctatatgcctgctgggccggtaacgcacaaaccctcacctatcacggcaacggcgcaaccggaggcaacacggcggcacaatccggcaagaccggtgacgaactgaccacaaacgccaatggtttgacccgcgacggatacacgttcgttcgttgggacaccgccaaggacggttccggcaccgcatacggcgaaggcaagaacggcgtcagccggtacacgatgaagccagcaggcaacgacctgtacgcgatctggcaggccaaccccgccagcatccaatacagggacgactggggggccaccggttcgacgcccgacaccacgggcgtcaccggccagaacgtgaccatcgcccgaaacgggttcacccgccccggctacacgttcaccggctgggccagggacaggcgcacgaatccgagcctccagtccggaggccggtacacgctcactcccggcaccacgacactgtgggcccaatggaaggccgacccggcgcacctgatctacaacgcaaacaccggctccaccagccagacccgcaggacggacggcgtggtcgaccagacgctcaccgtcatcgccaacccgttcacccgccccggctacacgttcaccggctggaacacgcaggccgacggcaggggcagggcgtacacggcgggcaacgggttcagactggtcgccgatccgaagagcaacccggtcaacacgagcgtcctgtacgcgcagtggaggatcaaccgggtcaccctgaagttcaatccgaacgggggaaccggcggatacccggacatcaccatcgacgcgttcacgacggtcaccatcccggccgacgcgaaggagcccaaggtgcaaaggcccggcttccggttcaccggctgggccatgaaacccacgcccggcgccggtgacacgatcctcagccccggcaagggcacggtcagcatacccgaccggggcagcatcaccgtgtacgcgcaatgggcgccggccatgaccacgctcccgttcaccggcggccacgcccaggtgccgaccatcggcctgtacgcgggcctcgcgttcatgatcctcgccatgggcgggctcatgcccgtgatccggctgcgcatggccgcggcccgcaggggacgccacgccggcggcacgggcacggccggaaggcatgccaggtgagtatgggcacggccgcacccgacgtgtgggagaccatcgcggaagccgtccgcgaccggcgggaccgtgacaggcgggcccgccggctcctcgcccgcagccgcatgtacgcggccgcggccctcgcctgcctgatcgtcggcggcatcctcatctgcatgccgcggatccagcagctgatcggggaccggaccgtcgaccggcaggcgcgcggcgtcagccaatccgcggccatgttcccctcatccagccgccaggacgcgatccgcagcgccgtcgcatacaacgaacggctctaccggagcgggcagccccagatcggcgaacccgtgttcgacggcaagaccaagggaaacttcgagggcgacgacgaataccggcgccaactgtccgtcaacgggttggacgcgatgggtgaactgctgattccgaaaatcagcgtggatctgcctatcatgcacggcgcgagccaggatgtgctcgaacatgctgcgggtcatctggccggcacgagtctgcctgtcggaggcaggagcactcgtgccgtgattaccgggcattcgaacctgagggggcgaccctgttcacccggctcggggaactcgatgaggggacccgttctatatcaaggtcatgggcaacacgctcgcctaccgggtcaacgacatccgcattgtcagccccacggacacgaaggcgttgaagatccggaaaggacgggacgaagtcacgctgctgacctgcaccgggcagggcaacacgctccgtctcctcgtcaccggggaacgcaacagcatgcccgaccaggccccattgcccggcgatgcgccgagcgacacgaaacaggcgatcgtcatctcgctgatcgtcatggccggcgtgctgatcagcgggttcgcggcctgccgcagccgggatgtgttcggccggcatgttggaggtcatgggaacggacgtcgatagccgtcccatacggatcaaggacccgtctcatccgtgatgttgcttcgcggatgagacgggtccttgatgttcccggcggattggaatccgtcagtcgttcacatgccatccgtccgcatgcttggcggcacgcaccctcacgagcacgcagccggcgcccgcgatggtcatgatcgccgccagcgtggcgattgcggtggtgtccgatccggtggaggccagaccgtcgccggtcacgcctgcggcctgcttcctggcctgttcggccttctgcttcttggcttcggcatccttcttggcctggtcggccttcttctgggcttcctgctgcttcttggcttcctcctcggccttcttctgggcttcggcttcggcctgcttggcggcggcgagctccttgtcggacgcctgcttgtcggcgagcttggcgtcatagtcggccttggcgttggcgtatgccttgtcggcctcatccttggccttgttcgccgcgtccagcttggactgagcttccgtcagcttcgcgttcgccttcttgaggttctcctcggcgttctgcagacgcttgatggtgttctgggcgtcgtggagcttgccggtggccgtgttgaggtcgtccttcgccttcgcgtatgcggccttggcgtcggcgatggcctcgtcggcggccttgacctgcttgtcggcggcttcaaccttcgcgtcggaaacggtcttggcgtcgagcgcggcctgcttggccttctcggcctcggccttcgcggtcttggcggcggccaggtcggctgcggccttcgtcttgtccgtgttggcctgcttgatcgcggcttccgcatccgtcttgttcctggcggcggtttgggccagcttgtcggcggtatcgatcttcgcctgtgcggcggcgaccgccgtgttcgccttgtccactgccgtctgggctgcggtctgggcgtcggtggcggtggcggctgcggtctgggcttccttggtggcctgctgggcggcggagtacgcttcgttcttcgccgtctgatccttcctggcttcctccaacgccttggccttgtcctcgttcgccttcacggcctcgtcatacgctttctgcgcctcgtcggcggcagcctgcaaatccttggccttctgagcggcctgctgggccttgtcggcggccttttgcgcggactgctgggcggcggccagcgccttggccgcggcggaggcgtcctgtgcggcctgcttgctcttggacaatgcggcctgccagttcgcgtccgcgttggtcagcgaatcacgccatgcggtcagatccgccagatacgcgtccacgtccatgacacgccccgactggtcgggggccgcgtactggaacgtctgcccgtgcgtggtcccgtagccgagcgtcccgttctggctgatcgcgaaaccggtgaccgcgtagctcttgttgacgacattcagataatggccggtctcgcccaccgcgttcccgtccttgtcctggccgtcgagcacgccgtcggtcatgtccttctcgtaattggccttctcggtcgtgtaccagccgtcgaacgggtccttgtaaccccaggccatgttctcgccgacgtcgaactggccggaatggccgatgttgtcgtcggaccagtcgacgttcgccatgctcatcgccatgagcgtgtccgacaccttcaacggcgccaatccctccttggcgcgaagctggttcgcctccttgatatacgagagcgcggcgatcatgttgtcgaggctggtcgcatcgcccttcgccccgttctggatgctggacaggtagagggtcgtgtccttgtcggtgaggaccttgaccgcgtccgacgcgttccggtcgccgaagtaggcgaccgcaccctgcgagagcttcgactgcgcgtccgccgcgacctgcttcagccggtcggcctcggccttcgcctgttcggcggcctgccgtttcgccgtggcgttggaagaggagtcggacaccgtcttgtccgcgtccttccgcgcctgttccgccttccgctgggcggccgcggcatcggctgcggccttcttcgccgcttcgagcttcgcggccaggtcggaaagacctccatcatccttggacaattgctcgaccttggcatcggccttccgcttggcttcaagcgccttggcctcggcctgctcggccgcggccagcttggcctgcgcggcgttcaccgcctcgtcggccttcgtcttgtcgccggtcgccgtggcctgctgctgcttggccgcggccagctccttctcggcggccgccttgtcgctcgcggcctgcttcgcgtccgcgtcggcccggtcggccttcttctgcgcatcactgatggcggtatccgcctgatcggccttcttctgcgcgtccgtggtctgcttgtcggccgcgtcgatatcggtctgggccttgtcggcgtcctgctgatgggaggcggattcggccgtggcctcatccttcgcggtctgtgcggtctgcttgtcggcttctgccttcgactggttgtcggatgcctgttgcatggccttgttggcgtcgttgatggcgttggacgcggcgttcgcggcctgctgggcggcggcgatcttgtcggccgtgtcggtcgcatcctgtgcggcctgctgctgggccttgctggcatcgtcataattcttctgggcctgctgctggccgttcgcggctgtctgctgctgggcggcggcggcgtcgaggttccgcttggcggtgtccaacgcggctgcggcggcgtcggccttcgcctgcgcctcggtcacgccggtaggcgcggcctgcgcgatcgcctgattggcgtccgccgtgctttgtcgggcctgcgcgacactgtcctgcgcctgcgcgatcgcctgaccggcctgatccgtggtcgtggtctcgtcggccatggcgaccgcgggggcggcgagcgtggcgagcgtggccgtcgcggccaccgcgactgatgtgagtttgcgtgacatgttcgaatcctttcttccgggacttcctcatccaaccctccatcataggaaagagtggaccatatccgacggtcccgtctcatcatgcgacgcacggacccgccggcatgccccgtatgcgtcccgggcgcatccgccatgacatcgcggaccgggcgatccccgacccgttcccatgggcgtatgcggaccatcatcgacatgaatgcggcgtacaggccgctcccgccgcccgtacgccttccctagtcgagcacccaatcatcgtcgtccgggtccgcggcgacgttcaccgtcgtatccccgtccgcgtccgacgattggtcgacgacgcccacctgcttcggtttggccggcagcagatccgaccagtcgaccggcgtcgcgtccggcacgcccgccatgcgggcccgcacgtccgcgttcggaccgcaccaccagcattgcaccatctgcaggccgcgccccatgcgctcgtacacgcccctgcctttcggcatgccgcccgaatccatggcctgacggatcagccggccccccctccctctcgttccgcgcgctcacgttccccctcacgtcgcccgcgccgacgaacaggcggcccatctggctcttcgccagccccgcgtccggcaaagcgtccatgctctccgccttcatcatctgcgagcccaggatcatcgtgatcccctgggagcgatgctgggtgaggatatggctcaccgacgcgccgatccggcgtttcagccggtcgcgccacgcgtccatcatgatcatgttgtccacatccgggtcgcccgtcggattccgtttcacgcccttcgacagttccaggaggctcacgaactcgtccaggaacacgatgatgcgcggcgggcggatgccggccggcagcatgtcgatgttctccgccccatgctccttctgcaatgcgagccggcgccgcccctcacggtcgatccagtcgagcatggccgcgcactcgtccaacccggtcgcgaacccggacagtttgcctttcacgggcgcgaaatcgttgcccgacttcaccggatcgccgacgaacgcctgccagccgtgcaacagggcggcgttcaccagggtgacggccgcgctcgtcttgccgctcatcgtctgcccggtgatcagcagatgcgccgtgtcatgagggtcgaacaggaccgtgcgcccgtcgtcgccgaccgcgaacggcaggcccgtcgaatccgggtccgcgcccatgagccgccagtccgccatgacccgttccggcagcggatccatgcgtgacaggaggagcgtgagcggcgcatctcccctgacgcggcgcgcgtacatgaacccgccggtcgcgcggaacgcgtccagacggcccatcgcgccctccacgcccaggccggccggcagggcgaacgacgccttgacgagccggccgcccccgtcctcgacgcgcagcgtggtcacgggacgcccgtccgcgcccgtcgccttggacgcggcccacgcctcgtccaggcgcagcctgatcatccggtccatgtcccggcgggaacgccagtcgcgcgcgtccatgctcggcacgccgcccgcccacaggatcgcatgcccctggtcgcgccactcccacagcgtctcgtccgcacccatcgcgcttttcagacgttcctgcacgcgacgcagatccgacgcggtcagcccgccctccaggcggatcgggatacgccatgcgctgttcgcgcccacgcccaactggcttgcggccccgaccgtgggcggcgtcttcagggcgagcgcgcacgcgtgcgacacgatgacgcgcgccaggaggctgcgcgccctcgaatcgccggtcagggcgcgcagcgtgtccggcatcccccggttgtcgtccgtgttgggcgcgtgcacgaactggaggagccgggagcggggccggtctccttccagccagggcaggaagtccgcgatcgggctttccgagaacgcgccgcgcaggttcgaacgcatgtagtcggcggccgtgtacgcgcggcctatcgccatcgcgtacgatgtgatccgccagccggccggatcggcgatgatttccgtgttgtcgtggaagatcgtttcgggggcgggcagtttcacgggttccaggccgcccgacatgatcgatttcaaccgtttgtcctcgccgatcagccgcatgtagcggaccggatcgtcatggcggcgggtcagcgtgtcggacatgagcggccgcatcgtctccacgtcccattcataggagtcccagtccgcgtccacgctcacccagccgtgcccgccgcccggatccgcggtcaccagtatgttctccgtgttcatccagtcgccgaacgcgccgggcgcggcccccttcagccagtcgcgggagatcatgtcccagtcggcgttcgacccgtcgatgcggaacgagcggaccgcgggcctgccgtcccgggacgcgacgatcctcacgtccgtgacgcgtccggggaacgcgccgtacatggcgcccatgcgcgtctcgtcgaccatgaggcgcgcttcgagcatcgtccggtcggcgagcaggtccgccgggtcgggcgcgtccgcggggcagacggcgaccgtgacccgcgtcctgtcgcgccccatgaacgcgaagcccgcaagcatgccgtccgcctgggtgacgggcgtgaacgtcttcatggtcgaatcgttcgcccattggacggcgttcgacacgtccagttggaagacgcgcgacccgtccgcgccgacacgcgtgtcgtgcgcgccgccgggcagcgcgtcgaacggcggcttgttcaggcccgcgatccaccggccgaccatgaggcggctctcataatccgtatggaagcgtttccggttcgcccgccatgcgggccacatggggcggcggcgcccaggcacatgagcatgggcatgggccaccagacgcccgtccacgcggattggaggacgccgagaacgagtcccgcgcccagtcccgtgagtatccacggcagccgtttcctcgcccatctgacgcgcatgcgccgcatgttcgaatccaggccgcgcacggtgcaggtcatgtcgcggcgctgctggccgacgcccatgacggccagccagcaggccagcatgtccgcgcccgccatgatcggacgccacgtgccggacgcggacgatatccacccgtagtcgaggcatgcgatcgccatggcgggcatcgcgtccgcatacaggggagacagcccgccgtcgagccaacgggaggcgcgacgccatgacgcctccatgcgccgctccctctcgtccccgggcgccggccggccgtccagacccttgccggacaggacgggacgccgggccgtcagacgggccgccagccagcccagacaccagacggtcatgcccggcagacggaacgcggtcagcatgagcgcgacgacgagcgtgaggacacggacgaacgcgtgcgggctggacggttcgtcccgtttcgttttcggccgcgaccggccgttccgacggtatgccatgcgcgccgcctatgccggcccgcgcataggcgcccccgcagacgaccacggaaaggagccatcatgggcgtggacaggaacgggaggagccacaggccgagcggactgccgcaggggtatgcgggcacgttcgacaggacgggcggggatgcgggcggcgacgtggccccgcccgacccgctgatcgccatggcgagcgaaagcatgcgcatgcgcgcgctgaccgaccatacacaggtgaaaagcgcgtcggagacgcggggcctgctcgacatggccgaccatgtcgaatacgggccggacggcgcgatcctgtacgacggggacgggaacatcctgttccgtgaggatccgtccgtgcccggactcgactcgacggtgatgcggcacgatccgaaaacgcaggccgcggttcgagccgcgttccaggcggacctgggcgaatacccggccgccggccggcgcgccctgatccgtgccgcgaaccggcatgcgagcgcgtattcacggcgccgcgccatcgattcgagcccgaaccgcaggtatctgcccgcatccacgatcgcgtcgagcctcgcccggcgtgccgaccgggacacggcggaccggatcctgcgcgaactgcactacgaggacgcgaacgcgagcgcgaacgtgatccgcgccggctacccggacgacaaggcgagcgcgttcaaattcatcaactacacgaagatccgacgcgacaaggacggcaggccggtgcacggcgaatggaccgaccgggacgggaagcgcaagagcgggatcatgcccgaaccgcgggggccgcgtcccgcgcctacctcaggatgctgtaccagccgaccgacggcgtcccctcgaagcaggagtgcgaccgcatggcccacgtgttcgcccgcatggacgatccggacatccaggccagggcgttctggaacctgtgccacggcaacgcgaacccggacgaccggtgggacgacgtgaacttcgaaatcgggctgatcggccagaaaaggacggacaggggcggcgccgcgctgctcgacgcgtacagtcggcgcaaaggcggtcagggcaacgcggcgcgcatgctcgcctacaggaaatgcatgagccgtgacgcggccgtccgtttcctcgccatggacgacatggacgcgcggcgcgcgcacacccagtacacgcgccgccgtcgcagcaggacgacggggctcatggaggacgtgaagccgaaacggctcaccgagatgcgcgcgttcatccacgcggtctaccagatccccaaccgtgaggtcgacgagtaccgggccgtacgggacgcggacgcgtgacgatcagggaagaaaagagggggccgtccggttcccgcctgccccgatggggttgcgggaccggacggcccctcttcctgtgccggaacggcccgtcatgcgacgggtcggggttcggcgggctcccagtcctcgccgatctcctcctcgttgacccagtcgcgctcccacagggagtagccgccggccagcgcgtattccacgccggtcaggccgttcaggtcggccacgtgcaacgcgtcctccttggacgcgcaccatgtggcgttctgcgcgtccggctcccatgcgccgtccgtgccgtcaaggtcggcgtcgtacagccatgcgccgtccatatcgcggcgcaccgcgtattcgacgccgcccttaccgttcaatcggaccatgtcgtcttcctttcgtccatgattgatgccgttttccgaagcccgctatgcgtccccgcgcagcatgcgcgtggattcggcgagcatgagggccgcgaggcgtcccgcggcgcggatgcgttccagccgggcgtccagcgtcccctccccgtccccgtcatggtcgaggatgaggcggatcacgcgttccacgtcgcgggcgagcgtggagtccagccacgcgaacagggcggcccgttccggccggccttcggccagtccgggcacgtcgggcacgatcggcccgtacgccttgcgcgccgccgcccattggacgcgcagcagttccagcgcgatcgggcggatgcgttccgtatgcccgtcggcgagcaggccggcgcgggcgaacgtgagcgtcagctgcgtgaacccgtatccggcgacgttgaacccgtgttccgaccaggacgggtcgtacggcctgcgctccgcgagcgtcacctccggcacgggctccggctcggatgcggcggattccggcgcctgttccggcacgggttccggcttcgcctccggatccgtcgcgggttccgtcccggatgcgacgggttccggcttcggcgtcggattccacggatcctcgcccggacccgaacccatccaccggtccatcgtctcacgcccctgcggcgtctcccacggatccggcgccggggcgggcaggcccgcgcgaggacgcgccacggcctccccctccggccccgagggcttcgcctccgcgacgggggcgtccaatccgaacagatcaagcatgacgggctcctttcccacatgattccaaccgccggtatgcgtccccgcgaacccgacgcgcggatcgtccggaccgacgctcgacaaggcgtcccgccggcccgacggtatgatccgggccagcgggcaggcgcgcgccaccggacaccaggcgcacaggcccgacggcctcaacggcaggacgccgtccccgtccgcgcccgtcgcgcgcacaatcccgtcccacgcatgatggaaacgggacacggtgtccgtgcacgccgcatccgacaggtccgcggccgcccacgcatgatgctccacatacacgtcacgcgccgcacgcacctcgcacacgccgttcgcctccagcatcagccggtacaggcgcagctggtccgcatgccgccggcgggcgtcacggtacttcggcgtgccgcccgtcttccaatccaccaccgtgccgtccacgtcacgatagtccacggcgccacgcaacgggatgccgtcgacatccgcctccagatcctgctccaacgcggccggctccaacacgcggcccaacgcgtccgtcaaaacgaaccccgacagcttcgccgccgcggcccccacccaatcatcctgcgtggcgggcgaaccgtccggcatcgccacgccgggcgggatcggctcatcgccccaaccccgcgccctccaccgctcgtactccacgccgacgcccctggcgcacagggcccgccaatccggggcgacacgatccggcgtacggcaggcaagctccaacgcggcgtgcgcgatgccgcccaggacgagcggactgccccacagacggggcttcggcatcagcttctccgccgcccaacgcgccgggcacgacatccacttgtccaacgcgctgaacgacgcgtgcgagggacgcgccagacgcgcacgggcgacacccgcccccatatcgaacgtcatcaacagttcatcactcatacgcgcgcttatgcgtccccgaaaaaaaacaggccggggcccgccggccccctcccggaaaaggaaagggacgacgggtcccggcccatgtcgccgccggttcaggcggcgagcctccacgcatggtccaggcactcccacaaggggcagtaccggcgcgacgcccactcgaaccccctgaacgggggacggtcagccgcgggtcgatccgcgcgagctccctgtcgcacaacgggacgcccagacggcgcagccacggcagacgcgccatcgccgccctcaccatgcgcgcgtcatacgagccgtccgccgacggccggggcagcgcatgatgttcggacaggagcgggaggaacgattccggcacgtccaaaagacgcgccgtctggcccgcggccagcatgcccggcatcaccatcaggccaaccccctgaccgcatccacatccaggccgggcgcggcggacgccagcgcgtactgcaggtcggtgggcgacgagcccgtcggcttgaccgaacccgccagatccgggtcgagcgcgagcgcgaccctggcggcgcgcctgacgcccgccatgtccttctccaacgcctggccgaccaggatcgcgcgtcgcagcggatccgtctcgtcatgccatgcgacaagcaggccgaccggcgccgacaggccgcccttcaacacggccagggcgagacggtccgcatcgtccgcgtccacgtccgcggcggacgcgaccacgcggcgcgtccgcccgtcgtccagcagggccagcgcctcgcgcgcctgacgcacccgatccgcggtccacgcgaacgcggggcgcgcgcgtttcggacgcggcctcgcctccacggccttcggctccgccggccccgcgtcggcctgcggttccggcgcggccggaacatccggcacgggttccggcacgggttccggctgcgggtcgaaaccgttccaaccccgatcaccatcgaacatcgacatgctattgctccttcaatccagggacggatatcgtcacgccgcccctatgcgcgtgcgacgcatcatgccacgccccgtcgaacagacggcggcgcggccggcgggcgtccggcgcaagccgcggacgaaaacgaaaaaaaggagacaaagaaaaggaaaaagagaaaaagagcaaaagaggaaaacacgatacgacaccatcccatcagccatcggaaaagaaaaaagacaggacaccgacacccaggaacacacgcgacggacatcacaccacaaaacagcatcacatcaaggggagggatcgtttttccttgcaaaaaaccgggtttcgggggcgcatagccgcccgccatgactcaggcggctatcacgttcgtgaccggcggatccggcggcatcggcaaaagcaccgccgcccgcatgctcgcccacgcgctcggctccgcccggctgcgcaccgcgctcgtcgacggcaaccccggacagcagtcccaacgcgcctggctgaacgtccccgattcgaaggcgttggaatacgcgttcgtcgacggattgcagtccgcgctcgtccggccccgggacacgggcggcatgttcgcgctgctcgccggacccgccgacccgcattccagggacatgacccacgactacctggaagcggtcatcggactgcgggccatgtgcgacatgatcgtcgtggacgcggaccgtgtcgacgggcgcctgtgggacgatcccgcttcgttcgcgggcggcgtcatgcggcccatggtcgagacgggcggggcgcgcatcctgttcaggatcggccagtccggctcgcagacggacgacgggctcgccgcattggacgcgatccgccggccggaccggatccgcgcggtggcggtcgcgcctcccggcgtgaagccgtggccggcccgccgctggcgggcattgctcgacgggctcgccgaatacgggggcgtggacgagtgggatgaggcgagccgccggctcatcgactcgcatgcgtgcggatgggcgcatggcatggaaccggattggctgcgcggcgcatgcatatggatgggcgtcgaccctcatgcatggaacccggcggagggggggcgatcatggctgccatggtcccggacgcgatgagcggcgtccaggcggcgcgggacgcgaacctgatacgcgcggaggccttggtcgcggtgcgcgcgaaggcggagcgcggggatttcacgcatgccctgtccgacctgctgcgtgacgcgttgggatcgaggccgctgctgcgcctgcacatctggcgtgtcgaacaggccgcgttcgacaatcggacggcgacatgcaaacggcatgcgcgcatcgcggccggatggtgcggggtggacggggcgcgcgccggatccctgacgctcgcctggctgttggacgagcggacgggcggcgcgaggctcgccgcatggctgctcgccatcagcctggacatgcgtgacgcgcatggcgggcacgcgttccgcctgtccggcccggacccgttcgcgcatgtacgctcctagtcgctgatcaggcgggcggccatggtgccgagctccctgatcacgtcgaattcggtgacgtcgttggcggcggcgacccgttggacggcgcgtttcaggtcgggctgccagacgcgccgccggctggtctgggtcggccagtagaggcggacggcgtcatgcatgccggtccacggatgcgggtcgtgttcgaggagtggcgccatgtcctgcgggatgggggcgagcatgagcatgcacgcggtgttcgcgtcgagcctgtcgagcgtatggtcccacaggcccgcgtcgcgtgcgatccggatcgcgtcctcgcatgtgccgtcggtcacggcgcgcatcatctgctccctgatccggccgacggggcgcggcaccctgagcgtcggatcgcgttcgaacggggcggacgccatgctgccgccggccacgctcgtgctcgacgcgtcgtcgtacacgggattatgcccgtcctcggtctcgaacgcgctcgcgctgggcgtcctggttttgagcacgcgtttcgcgttccactgggcgagcggcaggctgatgcgccgaacccatccgcagaagctggtgggttcggtcggatcccacaggccgttccagttccattgcgtgcttttcgattcgacgggcacgcccgtgatcttctcgaacacgcggaccgtgacccagcgggtcatggtgtcccgctgctcctcgaccgggtagaggcgtcgcatctcgccttccacgaggtcggtctgctgcatccacgcggcggccagcatccgttcccgggatccgaattcgacggccctgtcggtccagtcgatgccgcgcacatgccggtcgagctcctccctggcggccggatcgtcggccagcctgtgtttcggcttccattcgcccatcatgcgtccgatcgaggtcgcgatcccgtgccgcgcatccgcccccatcggcctcctttcacgcgcgcgtatgcgttccggggcataggggcgggcatgtggttcgaactggttcccgcgccgcgcgcggatgagacggatgacgatgtgaggttccagcgtgacgcgaaggccatggccgacgcgatcggcttgtcgtcgcgtcccggatggctggactggtggaggcatgacgacgggtgccggctcgtggcggccggcgaacgccggtgggtggaggtgtccgaccggtacgggcagaaggcgggcgaactggtcgcccgtgcggcgcacgcgtcgattcgcgcgtgcgggcggccggacgtgctggaccgtccccgcgtgtgggcgcacgcgttcgtcccgatcagcgcgtccctggcgcgtacggcgcgcgacggggagccgagcatggagcgtccccgcctggatgcgggcgaggacacggtgatcgtggtgaacgtgcgccggctcggctgggtcgagtcgggccgcctgtcggattggctgggcgacgagtacaacatgcaggcggacacgtcgaagctcaggggcgaggggttgggcgcgtgccgtgtgatggcgggcggcgcggatccgcgcacggcgatggatcaggcgaagcgggcggcgaacgcgttgaacctgggcctggtgccgggcctgtccgcgcatgtgagccgtcccggcctggggttcctcctgtgcatgctcctcctgacggccgtgtccgtgcctgccgtcctgctcctgcccgccgcgcccgcctggctcatgaccgtccccgcgttcatgctcgccgggacggcgggggcggtcgtgcgttggcgtctgcgccatgatcccgtgaacgatctggctcagaggccccgccattactggtggcgtgcgcgcagacggtgggcgcgcgccgcggatttgaagacccggatggcgggcgacgatcagaacgcggacgggccgggccggaagcggcgcgtccacgcgtacgcgttccaacggtccacgctgccgttgccgtgcggcgcgctggccgccctggcggtcccgtcgggacggcgcaacgcgtcggtgagcgcgctgacggtcatgcccgaccagttggacgggtgcgacgggcccatactgggcgtggacgcggaacggcgcacggtgcgcatgagcgtggacgcgttgtacggcggcgtgttcctcatgggcgagcctggcggcgggaaaagcaacatgatgcatggggtggccgggtggatgggcggccggcatcggacgggcgacgtgctcgtcgacttcgaatcgaagggcgtggacgcgcagcccgtgctgaagcgtctcatcccgggcctgctcgtcgtggacgtgaacgatccgggcacgccgatgatcgacctgctgggcgccgggtcgaacgtggagcgtgcgggccggttcgcggatctcatgcaggccgcgttgggcgtccagcagatcggcccccagtcgcgcatccagttgcgtgacgcgacgttcgtcgccctggagggtctggcggcggcggatctgggggcgcggtgcaacgcgtgctccgttcccgtgccggatggctgggtcgaatatgcggcgcgccttttgggacgtaacggggtgatggatgcgcgcatgctgggccgtgcgagcgtgttcgcgtgcgacacgcgtggggtgcgggacgcggtggagcgattgcatggcggcgtgtcggacaaggggacgccgaagatccgcgacggggagcttgccggcctgctgcgcgcgcccatgaacaagatggacgtgctcgcgtccgcgggccgcgtgttcgcgccgtcccggcgcgtcctgtcctgggcgtccgtgatccgccggtccgcgcatgcgggcgacgtgcgcatcatggtcaacctgggcgccgcgatccggacgggcgcggacggccggcatgcggatctgcccgacggggcgcgccgtctgatcggcgcgctcctgttccgcggcctgaaggacgagatcgtcgcctcctgcgcgggctggcaggcgcgggggcgtgcggcgcgcatcctggtcgacgagctgacggacgtgctgggcgcggacggcgacacgggtggcggcaacgcggacatcctcgcctggctgcgtgagaaggggcgcgcgtacggcgtgcagctggtggcgggcacgcagaacgcggtccagttggagggcgggctgctcgcctcggtgaccggcctgatgacggtcggcacgttcgtgttgcgcgcggatctgacggcgggcccgtccgccgtggcggtcgggtcggatccggcgacggtgcgcggcctgccgttgcacacggtgctggtgcgcacggtcggccctcccccggacatggcgggcctgcctcccatgatcctgtccgtcccccatttcgacgcgggcgcgcccgtgtgacgcatacccgggtcgcaaaccgttgttttgtgtggaaaggacatgatggtgagggtattggtcgatgcgagggagttcgcgaacatggtcgcgcatgcggcgcgcgtgctggagcgcgacaacccgtatgtcgcgttggatgccgcggatgacggcctggcgatcggcgcggcgggcgacagccagtggtcgcatggccgtgtggacgcgaccgtcctggaggcgggttccgcggtcgtgtcgggcctgtggctgaacgcgttggcgaacgcgatgccgtcgggcgagatcggcgtggaggcggatggcgtgtatctgacgttgcgtggcggcgaggcgtcgctgcgcatgcgtgtgggcgatgagggggatcgtccggccgaaccggccgccccggagcggatggtgcccgtggatgccgacgcgtacgccgcgttgtgcggcagcgtcgccccggaggcgggcggcacgagggaccagccggtcctcgcgtccgtcaggttcgtcgcggccggcggcctgctgacggcgacggccacgaaccggtacatggccggccgcaggtccatcccggtcggcggcgtgccggacggcgaatggctggcggacgcggattgggtgaaacgcaatgcgaagggggtgaacgcgatcgggttcacggaccggatgatggttgtggatacgggtgggttcacggacgcgatcatgctgaccgccggacagtatccgatggtggaccgcctgttcgacaggccgggggatccggcgggcgtggcggtcgtggacaggcgcgccctgatggatgcggcgcgcatgctgaaaagcgtctgcttcgactcgcgcatgggcatcatcccgctgatcctggacgagcgggacgggatgcttcgcgtccggtatgcgggcgacgggcaggatgcggattcgcagggcgtgcgtctcctggaggcggacatcaccggggatgtggacgtgaaactgaacgcggattacctgctgaccgtgcttgcgggcatggatgcggacagggtgtcggtggtgaagacccgtgaaatgaagcccgtcctgttcgaacaggacgattccgcggtggagcatttggtgatgcccgtccgttaggattgtccccgacatgcgggggaaacggtgtcgcgtccggacggacgcgacaccgttgtagatgactttgttttagcttgtcgctagagcgaagtcatctgcatggcctcgttgccgagaccagctccaagcctcacgcggctctcgccgccgcttggttcgcgtttcacaggggtcggcattgtccgactgctgccggtctgtcttacgtcccctccacgcgcgtttaacgtctccggggcactcccggcgacttggatgttgatggccgcgttcagatcgcggtcgatgacaagcccgcactcctcgcaatggtagacgcgctcggacagggacagtttggctttcaccgtcccgcagctcgagcatgtcttgctgcttggataccagcggtcgatgacgtggagcctcgcgccggcgcgtgcggtcttgtaggtcagtagacgtcggaactccgcgaacgcggcgtcctgaatcgattgggcgagcccgtggttcttgaccatgcccgccacgttcaagtcctcgatgccgatgtccgcgtaggcatgggcgagcatggtggtggtcttgtccagtaggtcgcggcgtaggtccgccacgcgggcgtgcagacgcgcgactctcgttctcgccttgcggcggcggttggagcctttccgtttgcggctcagattcttctgttcccgcctcaatcgtctgaggttcgagtccaacgcgcgtggattgcggatgatggtgccgtctgacagtgtggcgagctgtttcacacccaaatcgatgccgacactaccacctttcagcggcgtgggcatcggaccatccttgcgctcgacggtcaaactcgccatccagcgtcccgcatgccgggatacgctcatgcgcagtatcttcgcgccatccacccgcttggatacgttctccatgcaatgcacgcggcctatcttcgggagccgcagcgcataagggtcatagtcaatgagaccaaacgaacccgtcgtgtacgcgaagcggggtgtcgccctgtccttggacttgaatcggggaagccgaccctgcgccccttcctcaatcccttgcgagacttcgaccagttcgacagcgcgtccgccaaagacttaagaccagcgttgtacgcctccttactgttcttccgccaccacgtttcgcccgtcacggcgttgacggcgagcgtgcccttggcctgattccaccacccgcgcagcgcgtagtatgaccattccggcttctcctgccgttcaagcatgtccttgacgtgcgccagtcccgcgttgtacgcgaatcgcgccgcaccagcatgggactccaagagtcgttcctgccgtggcgtcgggtcgagcgccaccttgaccgcctcaagcatcgcgtgccgccctcaacgccgcgtccgtcttgtgcttggcggcacgccttccgtacagtctcgcgcagaacgaggtcagcacctcggtcatatcgcgcaccaaatcgtcatccagtcccgtgtcatccaccacgatgattcggcgtccctgcgccttcaacgcgctctccaccaagcccgcgttcatacgggcgagcctgtcgcgatgctccacgatcagccctttttttgtccggtcctggccgtcaggggcgcgtgtcgtgcgcggcgagcatcctgtcggcgaggctgtccccggcgtcgccgagggcctgcgcccagcgtcgccccaacggctccccgtcggccggcccgggcgtgtccggtcccggttccgtatcgtgatccgtctcgatgacgggtccggggtcgtccggtccgggcgtgattccgggcgtgggctccggcgtcggagccgccgaaggcccggccgggtccggcgacgcggcctcggccatggcctgccggtcgaacgtgcggcccgcggcgagcacgatcatgtgcgtggtcgcgagcagggcgaccggcggcacggtcatgatgaccggcggcacccagtcgggcagcagcatcccgttgacccgcaccggatgcgcgtgcagcgcgttgccggccaggctgatcacgctgaacaggacgagcatgagccacgggtacagggtgcccatgcgccgcgtcttgaacgcccacgccgcccacgtgaacgcgagcgtcgacccgtcgatgatgatcgggaacatccacgccagcgacgcgttgatcccgcacgcgagcccgacggcgcgcaacgcgtcgaagctgatgatgaacgcgagcagggcgagcacgaccgcgaccgtcacgcccggccacatgcgcgcctcgcgccccccgttcacatggcctccgtgagttccgccgccacccggttcagcagtctcgcatgtttgaggtcatgggccttcacgcacgtgtcgtacaggccgagcgccagggtggccgcatgcgacgggtccgccgcccgggcgacgcgggccggctccacgcccgcctctttgaacaggttcagggcatgacgcgccctcgcccggcgtcgatcgtactcgttgtcctcaagccaggcctcaatgacgccggccaggcggcgcatgtcctcgatcgtctcgtccatgggtggtcccctttctcgatggtcaaccgtccggccttgtatgcgtcccccggccccgcgcatagcccggcatgcatgaaacgtctcctgcccttcctgctcgccgccggcccgccggcgctcgtcctgctgctcgcgctcgccatggtggtcgtgggcgcgcccgcgggcatgaccgccaccaccatggccaccatggcggacatggccgactgtacggacgacacggacacgacggccgcggcggcgacggggacgacggtcacgcccaacgacgtggccgtgtccctcgccagggcgttcgccaaggccgggtattcgagggcgagcacggcgggcgtgctcggcgtcatccagttcgaatcgggcatgaaccccgcgcaggagcagatcggcgaacccgatcccatgctgcgcggctacgggctgaaccagtggacgccgcgaagcaagatccgcgactggatggacgcgaaccacgtgtcgggcgaggattccgacgcggacgtgcagatccgcatgctcgtcgccaccgcgcagaccgatttcaacaaccatttcctcgccgccgtcagggccgaggggcacgagcccaccgacaacgacctgcacacgtggtggctgaaggccgacaatcccgaggatgcggccgtcgcctggatggccggctacgggcgcccctactgggcggaccggcatgagaaggaacgcgagcagtacgcgcgctcctactacgattcgaaggagctcgccgacatcgacttcccggccgaatcgaagccggacgggaagaaggacgccgccttcccgtcggacacgtcggacacggacgcgtcatgcgacgcggatgcggacgattcgtccgacggggacgcgaaatacggggatgtgggcggcgctcccacgaacacgcatgacttcggctggatgtgcgccacgaagctgaagatctgccatgccggggacatgggcgcccctcccctcgactggcaggccgtgggcgactaccagtgctactggtattggctggcccgctcctggctggtgcatgacggggacgtcatcaacccgcacacggcgaacggcgggcaactgtccgactgggcggcgggcacgaaggggtggacgcgttccgacgagcccaggccgggcgcgggcgtctgcttctggggcggcggcaacaaccacgtcgcgttcgtggagaaggtggacaaggatccgtccggctggaagatcatgatcagcgagggcaacttcaacgacgggggcgcgggcctgtggaccagctacaacgcgcgctggctgacgaaaggcgaatacgcggccgcctccggcaacgggttcttctggaaggacagctggaagctctagcagtagcccgggttctggcaggactggccgtcgccgacccgcacggggatgctcccccacaggctcatgtccacgttttcgtcggccatgaaccgggtttcgggcgggatgacggtcagcccgtcgccggtcagcgccccccagtcgggttcgcccctcacggggatgccgacccttccccggccgttcatccggtcgccgatgcccgtgtcccatacgccgagccacgggtcgatccaccaggggtcggcctgccggtggcggatccccgtgatccgcccgtcccggaccgtgagcctgtcgtccaccggatagtcgatccaggtgggcgtgatcccccaccagtcgtccacgtgcaacgtgttcgggttctggttgccggccaggtacatgaagcggacggtgccggtcacgcgtacgcccgtcccgtccgcggccgcgtgggggccgtccgtccaccggctcccgtacccccaggcgatgcgggcgagccatgcggccgcgtcgagcccgtccgcgcaccaggcgcgttcgcccgtgtcgccgacctggtcgagccgccggtaggcgcggcatgcggggttggcggcgtgcgggcccgcgtccgcctggcgggcgggcaggttctcgcccgtggccggatcgtccgcgggcggcgtgccgtgcagtgaggcgagcacgcttcccgcgtcctttcgcgcgagcgtgtcggcgcggatggtgctgtcggcgccccattcgcgcaggcgtctctcgaacgtcgcggcgtgttcgacggtcttcgcgtcgggcgcggccgtcacggcctgcggtttcgtcccggtcttccccgtgtcggtctcctgccgcgcgcatccggcggccagtatgacgccggcgagcgtggcgacggctatgagggtgcgcgatcgtggtctcatgcgcgcaggctatgcgcgcataggcgtcgcacatgccgttcaatcctttcgccgccggtcccgccgaacccgtcgcggagccgtcgccggcggagccggccgatgggggcgcgacgcgggaatccgacgtcgacgacggctggtgggatttcgggagcggaccggatgcggcggacgcgacgccggaccccgatccggcggacgccgcggcggacgacggccggcgggatgcggacgggaggggcgggcgatccgaagacgcgcccgatcccatgccggacgacggggcggacgacgactggtggggcatggcctccgatgcgggaggggacgacgcgcccccggcccggacggcgcgggaccccgccggacccgccgcccatgcgggcgacgacacggatgcggacgacgactggtggggcatggccggcggggaggccatgccgggcccgccggccgggatcccggcgcgcacggggacggacgagacccccggcatggacgcggacgacgactggtggggcatggccggcggggacgggccgcgatccgacgacgccgatccgacgccgcggctcgtcagcgtgcccggcaccagcgtgcgcatccccgcggacttcgactggggcaccgacaccccgcggccgggccggccgacggcgtgcgggagcccgccccggcccccgcacgccggcccggcccgtcgcgccgcatcctcatcgccgccacggccgccatcctcgccctcgccctcctggcgggcggcgtcgtcgcggcgcgcacgctcatcgcctccgaccggcagcggaaggcccacgacgaggcgtgcgcgacgctcaccgcgcaggccggaacatgggacgggctcgcacggcaggcgaagacgctcggcgtgaaacccggcgacgggcccgacacgtcctgcaaggcggacacggacacgctcagggcccgggcccgcacgctcaaggcccgagcccgcaccctcgccagggcgaaccggaacgcgctggacgccgcatgggaaaacctgtccggccggatcgcggcaagccgcaagaaccatccgaaggccggcgggcagacgctcgccgcgctcgaaacgctcgccgagaccgcgcccgaggacgcggacggcctggccgcgaaggaacgcgaattcgaacggctcgacaagcaggccggacgggagcagcagcaggccgaacaggaggagaaggcggaggccgaggcgcgacaggaggccgaacgggaggccgaggcgcgacgggaggccgaggcgcaggacacgccccagaccgccgcccccacgccggcgcccatgccgcagaccacccccacgccggccccgcagcccacgccgacacccacacccacaccggcgcccggcaacgcggacgccagcatgtgacgcatacccgaccccatgaacgacgcatacgaacgactcaccatcggccaggcgcagaccctggcccgcatcatcgacggcctgcgcgaccacgggttcgaccccgacgggcagggcatccacacgcccaacctgcacgtcgaacccggggacgggacacgcgtcaactggtggctcgacggcgacacggcgttcgccaacggcagcatggacgcgcaggggcacggcgtatggtggacgcgccgcgcctacgcgcccaccctgcgacgctcctaatccagggaaccgtcgacgcgcaccaccaccgggatcgcgctcgccgcatcccccacctgcaggtaggcgaccgacccgcgcagcagcccgcccgtctccggatccctcaacgggtacaggctctcccagtccggggcccgggaatccggatccacatacctgtcatgcatcatgcgcgcatgcatgcgcccgtccaacggctggttcgcgagccggcaggcggcctgcgcctggctgtcgcggcccgaaccctcgttgcgggcccccacggccagcacgtacaccttgccgacgaaatcctcgatccccgcgtccacgaactcgtcggccttctgggagagcatcatcaccatgtaatgctggtcgcgggccagacggcccatacggtcgacgacgctccggccgaaccggtcctgcagcaggctccacgcctcgtcgatgacgacggccccgttgcggccgatcaccaggcaggaggcgcccagcgcggccatgcggcacacccagcgctgcacgtcggtgggcgcgccctggatctccttgtcggtgatcacgttcaacgagcccgcgctgatcagggtcatgccctggctcagggacaggcggcgcccgcccggctccgtcccgtagatgagcggcatcaacgggtcgttcttgacggcacggtccaacacgggccggatcctttcgacgagcgggtcgatgtccttcgcctcccgccccctatgggaatactcctcccaggcgaggcgcacgcattcgcccagacagtcggcgccgtggcgcaaaccgtagccgacgatgctggacacgcccatctcccaggcgcggtccgggttcgcgccgcccgtgatctggctgagcatcgcgaccgacgtctgcacgatcgtgtccgtcatatgcctggggatgcagcgcagcgggtcgaggatgccgcgcgcctccggccggtcgagcttgacgaccacgccgccgcgtttcctcacgaacggttcgaagtcggatgatttcggtttcggatcccagaagacgacggggatctgcacgccgggatgctcggggtcgggcagacgcccccattgggcggcgacatgcaggccgagccgggtgttatgcgtgggcacgtagccgccgatcaggtacgtgcgatcggggctggcaatgctcagacaacggtgcgggcagtcggcgatcggccggatgcctttcacgtacagccatttcgaggtctcacgcaattcagtggggagaagcgcgcgtttgcgcggcagggagaacacgggcaggcttgtggtgaacgtgaggcgcagacggtcgcgggtctcgtggcgttccccgtccgccgtgtatccggccttcgtgcgggtggcctcgtgcacgacgacgcccagggagcgcagaagacgggtcagcccgtcgacgatcggcttgtggtcgatggactgggtgaactcgacgctcccgttccggtcgatggcgccgtcctggtcgagcaggcctcgcacgagttcgagcctctgttcgacatcggcatggaaatagggttcggggatgtgcttgtcgccgtaaagcccgttcgcccggagctgtcggacaaggcgtttcgcgtaggtcttctgcgggtcgcacgcactccgggtgacctcgtatccggcggttcgcagacggttctccagatggtcgaggtcgccgttcgacgggtcggaagcgaagccgccgccggtcttcgacccgtcagccagccatgcgccgagcgtccacgggtcgatgggcaggtccgtgcggacgccctggacgggggccgtggcgcggatcgcccagttcgcctgcccgccgtcggcgagcagcccctcgtcgagcatctcgcgggtggtgacggtctgttcgccgtgtccggacccgggttcgtcccggtaccgccagccgatgcggtcggcgaggcgggcgagggcgagcggcgcgggccatgcgacgcgcatgcgacgggccgttcccgcaggctccgcccgcggcccgtcgtaggatctcagggcggactcgaacgcgcctttcgatacgccgaggtccccgaaccgttccaggagccaagccgtgtcgatcggttcggcgggagggtcggcgatgagcccgtcgagcctggcgagccgcagcgccctggcttcgaccccgaaaccgttgccgacggtgtgctcccacctgtcgcggatgtgcccgagcagcggggcgggctcgtagaagcgtcccccgggcctgttgcgcgccctgccgggctgcatgcgggagggcacgtcggcgaagcggagcgcgttcctcacccacgtctccccgcccttgcccgcgaacggcgcgacgaggggccggacctcgcgccagatgcgttcgcagtcccaccattcgtccatgccgtgtccggcggccatggcgcgcagccgttcctgcgccttccggacccgttcgcggcgttcgaggctcttccggtgtttgccggtgcgggcgaagttgcggtcgcgccatgtccacgcgcaccattgatggtcgccgctggctttgatcctctgcccgtcggacaggacgatctcgtacatgtcgtcgtcaccgatggggctcatgccgagaatcgggtaggttttcccgtcgcgcgcatagagcatgtcgccgtcctcgaggtcgcgcaacggcacgaggccgccctcggggaaccttttctgcgggggacggggagaggcgtgtcgagggaaaccgattttccggatcctgtgctgcccacgattatggaaatcgctttcccgctgcgtctggacgcggcgaacggcgaatcgtagaccggctgcccgtccgcctccgtgacgcccacgaacgcgcccggcaggtcggagtccaggccgcgccccgaatcgtcgcccgtcatggaacagcccgcgagcccgctgaacgcgaggatcggggccggccagtacaggggggacggatcgtattcgatcatgtcgtcggaaccgatctgcatgtcctcgaacgcggcctcctgacggtccgggttcaacccgacgtgccccggataggggacgcggttcgactgctccacgatcatgggcagtgcggcgtgcgcatgcgcctggacgagcgtgggccacggcttgccgtccgcctggtattcgccgttcgccgcctccagctcgcgcgccacgcccaggttcgccttgcggccgcccgccgcctgctcgtacgccttgtcgagcaccttgtccgcgtccttgtccaattgctcgcgggtcatctcccccggttcgaccaggcccttcacgctgatcgcgaccgccccgcaccggctcgcgtccaggaggccggccgcccagtcggagccgggggcggtgttgttctcgcccttgaaggggagcacgccgagcgtgaccacggtcaaagggtaggagccgggaatcctcgccgaccatttgcggcagtcgtcgaccttctcgcgcatgcgggccgcgacgaacgcggaccggtagtcggggaacgtgtgcatgtggtcgtgctcgaccatgacgggcagtccctcgggcttgcggtcggtgggccagaacgccatggcgcggcgcatcgtcgcgtcggacgggatgcggcagcccgcgtcctccatgagggcgcgcacatcctccagatcgtgttcgaacgcgtcgtcgggcgtccacccgtcctcgtcggcgacgcctttcaggaaccctttcacgccgccctgcccgccgcccgtgttcagccggacgccgaacagggtgaaccggtcgcgcacggcgagcccctcctgttcggcggcgaggcgcagccggttgtccgggtcgagcgtgggactgggttcgaaggggcgggagccgctgaccgcgaggatgtggacccgccggtacaggcccttcatggccttgcgtccggcgaatgggacgcgcggcgtccggtcggcgagcccgccgagtatcgacagcatggggcgggcggccttcaaacgctcctccatgccggacgcgtccgtgacggacggctggtcgggcatcctcatgtacagccatgcggcgccgttgaccgtgcgcacgaacccgccgcccatatgccgggcgaacgtgcccgtctccctgacaatgcgtttcctcgtcatgcggcgcgcctatgcgcgcgtcgcatgacggtcagccgagcgtggcgaggatcgcgcccagaccgtccggatccgtcggatccgagcacaggcgcgccagcaggccggccgcctcgcgcatcgcgcgccgcgcatccggcgaccccgcagccagcagccgcaattggcgtggcgtgtagccgccgtgccgtcggcgccggtagagcacgtccatcgcatgcgcgtccgcgtaggcgagcagcatgtccacctgcgcggacgacaggccgtcgccgaggcgggcgagcgtggccgcgcccgaaccacgttcgaggatcatgtcgacgcggcggggcgtgaacatctgcctttcgacgctgagggagaggcgttccagcaggccggccgacccgtgctccgcccaatggtcgtacagggtttcggtcaggcgttcgcggcgcggatcgtcgtcgggcatccagccggacaggtaggagccgaccatgtccgggtcgccgtgttcgagcaggaggcggatgtccttctccgtgagcgtgggacggtccgaaccgtcgcgtgccgcggcgtccggcgcgtacaggctccagcacgcccggtcggccaggccggattcggcgatccggcgcaacagggccgcgtccggccggccgtaccggagcacgagccatgcggcgtccgggcttccggtttcgaacaggcggacggcgcggtcggcgatccagccgggggcacggtattcgagtttcgtcaggacccccgggtccgtctccttgccgaacacgtgcagacggtcgtcgggcgtatggtccaccagttcgaggcgcaccgtcggatccggatcgtccaggaacgaatccagccggccgtccgtcagcatgcccatatgcttcaacgcgtccagacggattttcggatccgggtccgcgagcacgaggccgggttcatgcgcggcgagcgcgcggcgtatggccttcggcagcggttcgcccgcctccgccatgcgtatcgcgtcacgggccgtgtcgcgtcccatgccggtgacggtcaggcggcgcgcgcgccagcctccggccgcatcgtccacggcgaagcagccggtgcgggcggccgcgcgcgccgcgttcgcgctcgccgcctcgaacgagttcggcacggtcccgccccatcgttcgcgggtctccggctcgccgtagtgggccatcagcaggttccattggctttccgacagtttcctaaggctcatcgtgttctcccgtcatcgcgccccggcatcgtcgccgcgacgcatgcgtccccccccggcggacgtttttttcagcccgattcagaacaggctgtcctgcacgggcatgggcggcctggggcgggcgagccggcccatgaacccggcgaccgccggatcggccttcacgtcgcgtgccgtgagcggccggtcgaggctcaggccggccagggacgtgcaccggctcaacgcgacgtacgcctgcccggcggcgaacaggggcgcgggccgagctcgagccgcacccggtcgaacgtcctgccctggcttttgtggatggtgaccgcccagccgggcctgaacggcagctgccggtaggagccgaccaccacgttctccagacgcccgggcttgtcgggctcgtcggggtcgcggacgatgcgcggcgcgacgatctcccacgcgtggacgcccacgtcggcgaccgtcccgtcgtccatgcggacggtcgcgaccgggcccgccgggtccatatgctccaggacgcccatggtgccgttcgcccacaaacccgtcggatcgttggacagcatcatgacgcgcatgccgggcttcacgtcgagcaggcgcggcgcgggctccagggtctggttccattcgccgcccgcccgggcggcgaagcgcatgggcggggcgggcagacggtcgagcatcgccttgttgatggcgtcggcccgccggttggcggcgcacaggacgacgctcccccgggcgtccagggggctcccgtccgccggttgatcacggcgagcgcggccggtccgggcgtcccgtcgcgcaacgcgttcaacgcgttgacgaacacggggtcggactgccggtgcacccgggcgagcgcgacgccggcgagcagcccccggtcgagcaggcgggcgatcgcgtgggattggaagaaccaggggccgtcccattggccgccgggccggaacgcggcgccttcccggcgttcgtcgacgacgggcggcagttgggcgaggtcgccgaccagtatggtcctgaggccgccgaacgggcggtcgtcgccgcgcgcgccttggaggaaccggtcgaggcagtccatgaggtcggcgcgcaccatgctgacctcgtcgatcacgatcgcgcccagtgtatttagtcaagtcggtgtttcgtgtttcgtcactaatttttttcggttttcggcatgaggagtgccggccggtggtttgttttactggttgtccgtcttgccgaacatgagggcctggctgacgcgtcggctggggccggtgaattcgatgaggcgtccgtggtggacgatgcggtcgatgatcgcggcggcgagtttgtcgtcggcgaagatcgtcccccatttgctgaactcgatgttcgtggtgaagatgatgctgcgccgctcgtagctgccggcgatgatctggtagaggaggcgggccccgtcgatgtcgaagggcacgtagccgaactcgtcgaggatgatcaggtcggcacgggcgaggtctttgagcaggttgtcgagggcgccgtcgcgtttggccttgccgagctggagcacgagctccgcggtctgccggaacctcacgctcctgccttgctcgatggcgagcatgcccagggcggtggccaggtgggtcttgccgcgtcccgtcttgccgtagaacacgaggtcctgcgccttggccacgaaatcgaggccggtcagctgctccttggtgtatccgtcgggcaggcgcacgttcgcgaagtcgtagccgtcgaggcttttgggcaccgggaaccgggcctggcgcatgagccttgcccgtttggaggcctccctgttggccagttccgtggcgagcatgcggtcgatggcgtccagttggcggggcgtggcccattcgagcgtttcgtcgatggtggcctgcgagatgaacaggctcctcgcccgctcgcgcagcgggccggggtcggtccgtccgttcttctggttcactcgtcctccttggtgtaggcgatgtcgtattcgctcaggtccacggggtcgtcgtaggccacgggtcccaggcccgaggcgtggcgtgccgcggccagacataccccggcccggtccgtgcctccggtggattcgaggatctcgagcatgccggccacggccgcccgccagccgctctcgccgtcggcgtgcagcagggcacgcaggctgtcgcgccgcgtggcctcgtcctgcgcgtcgatccattcgcgaagcgggtcgggcatcgcgtcgcgcacccggctgttgcgccaggccgccggccggtcgcacaacagcccgagctggctcgacgggtcgccgctgtcggtcggcttgtccccgtaggacctcggatgcgtgatcacgcgtttgccttcggcatcgaggatctccacctccagggccctcaggccgacgatcatctcatggccggcgtgttcgggtccggccgcgtaccggtggcggccctggacggtgacgtttccgtatttgtcggccttcatcctcgtccacgtgaccacgtcgaacggcttggcgggcaggggcagcagcgccttgcgatcatcctcgaacaggccggcctggctctcgcccttcctgtaatggtccttgtccccctcgagacagcggtcgggaaggcgcaggttgaagttgtcgaggctccacacgctgggcaccggcacgaacagccttcggcgcacggccccgaccctggcctcgaccgcgcccttctcgtggcccgagtacgggttgcagaacgagtactcgaacccgtaatgggcctggaacgcctggaacaggcgggtcaggcggatctcgtcgaaccgtcggcggcccacgccggcggcattgtcgtacacgatgcgccggggcaccccgcccagccattcgaacaggttaagcaaagcctgacacgtgcattccgcgttctccccgggcatcagctggcacggcgagatgttcgagtacgggaaatccaacacgaaatgccgcatccgcgtcacgacgccccggtagcgcacgtcgacctggccgaagtccgcctggcattcgcccggatgccacgacaggtccaggaaacccatctcgcgctccgccatgaactcacgcttcaaccgggccaccgtccgggtcaccgtcgacaacgacgcctccaccccgtactcgtcacgcaaccgctcgtggatgcgcgtcgccgtgtgacgttgcttgtgccaggtctcccggtcctcggcgagcatgccctcgatcacgggaatccactcgtcgagcaccgagccacggcgtctccttaccggaggcctggccgacaggtcgtcggccttgagatacttgcgcacggtcggctcgctgaccttctcgccgcgcgcgatcgaggcgacggactccccattcctgcgcctctgacggatagactgtattttgggcatgctgatcatttgcctttccggccctttcccgaatggattcgaagcaccatcaggctaaggcccacgggtggtcggcatgcctttctgcctaaacccgaaaaaactacgtgactaaaacctcaactccctattgaacacatacagcgcccagcatccggtagagggggtcgcgggcgttctcgcgtcccttgcgggccgcctcggccggggtgacgccgggcttggcgtggatgaaccggtggatggtggtcccgttcacgttgagggcggcgatgccggtgggcgcgagggtgagcgtgttgcgcggcgcgatcgtgcttcgccaatggttgacgagggtgcttttgcccgtgcccgccttgccggtcaggatcgagacgccctggggttcggacagcatggcgagcgccttcgcgtcgaaagtgaggtcttcggtcatgcgccggggtatgcgtcagtcggcctccgggccgtgtatgcattccggccgggctgtatgcatccgtatgcatcaggggatgcatacacgcccgttctccgtttcggcttgtttccagcgttccggggcggcctccacgcgtgtatgcattgtatgcatcattcccttatagaggattcgggaaaaggaaggaaaccccatatattgatgcatacaatgcatacaagataaaggaattatattttttcctttatttataagggttttcgggctttttccgggctttttctgtatgcatccccggatgcatacagatgcatacatgcatacatcggggtgaaaacagtacactgacggactgttttccaggcccttccgaccccgatacggtggatccatggccccggcgggcatgacgaggggcggccgacagtacacagacggactgttcgcgattgaacgcccggatcgccgacccgtatgttccagagggaaaggagtctcgcgatggaagacaaggacaggctggaagggttcggacagcatggcgagcgccttcgcgtcgaaagtgaggtcttcggtcatgcgccggggcatgcgtccgatcggcctccgggccgtgtatgcattccggggcgcgtgtatgcatccgtatgcatcaggggatgcatacatgcccgttcttcgtttcggcttgtttccagcgttccggggcggcctccacgcgtgtatgcattgtatgcatcattcccttataggggattcgggaaaaggaaggaaaccccttatattgatgcatacaatgcatacaagagaaaggaattctgttctttcctttatatataagggttttcgggctttttccaagctttttctgtatgcatccccggatgcatacaaatgcatacatgcatacagaacaggccgggggacgtcacgattggctgtacagatggacgctgtacagccacaccggggcgttggtgaggaaaatcctcgctaaggacgtcggactgtcggaggtcgagattcgggagatactcaaatgagcgcacacgtgaaatcagtgaagatcgtataccaccgtgacgagggcgcatggtgggccgactccccggacatgccgggattctccgccgtcggggacaccttcgacgacacgaggaagcttgccctcgagggcatccccttctacttcgatggcaataggcccgatatcgtggacgagcgcatggagaacggggcgagcctgaagcccacgagaccgtaagacgcaacccggacgccgttccgggggcgcatgtcacatcaaagcttagaatcccccggctttagccgtggggagaagtcaaatcatccgaagcgagaaaaggccggtcttggtagaacgtctcgccaacactaccgttgtagcatacggtaattgtattggctgggtgcatattctcggtattaccgaccattgcggtgcaaccgttgttcatcgcagaagaaccgataaagcgtatatcacccggaatcatatttgcttttgtcagccttgttcctttaacaacgtcaaacagcttccaaataacaaactcctgccattcggctatgcccagcgcatgcttgctctcatcggcttgcctcagcctctcaaggcttgcttcagactctcaaggcttgcttcagactctttcatgactgccgacatgtactcgtccatgtaagcccaatcaggctcgccggacgtatcaacgggcaaacgaatcatttcgtcttctatagtcttggaatttaactggtcagaatacgtatatttggtcagtgactggcgaatcacagacgaaacaaatagtcccgacagttctgttaaacctgcattgtgcaacatcaagattgcagaaccagcaccaccacgacccagaaaaggcttggcttgataaaaagctgaaccatcaatcggacttactgtgatgcaatttcctgcatccagcacttcatcatcttttggcttacaccacttagtgacaccattgttgaaatttccagatgcaacaaaaggaatatttccgtcttcatactttgcttgactacgagcaactggtcgctttatttcaaacaacttacctatcttgaactctttccatccgttcgtatcaatcttcgccatcgccgtctccgcctttcctcatggttacggtcacggacttgtcatcggcgctcactcggctcgaatacatcgctgtgtccagcagcttctcgccgaactcctttgcgtcgatgccctgccggaacatcaggtagtccatcgccgtcttgcggaagtcctcctcgaatatctcgaacggcttctgcggcatctgataggacaggtgctcggcggggttcacccactggcatgtatcgtcgccggactgcttctcgaccacatcgacccaatgagcctcaatggccgcccacttgccgtagacgtcatggcgtcccttgttcttgaccgtcgccagaccatcggactccatgtaacaggcgaaaaactccttgccgtcctgtccgacgcccgcctcgaacacgaagatgctcgtggtcacgcccacgccgaagaacaggtcttccggcagcttgatgaccttgcgcaggcgatggttcttcagaatgcgcttcatctgcgccttcgatgctttctccagcttcttgtccggcaggatgaacgcgcactgggtatgtgcgggaacgctgtccatcacgttctcgacgatggtcatgcagccgtacttgttctcgtacggcgggttcatcagcaccttcgtgatcggcttggactgcatccattcgttggctgcatccgtgcgagtatccatctgttcaaggttcgtcttgccgtccttgtgaatcagcatgttcgcgcacgccagcgcgtaaatctcgcggtcgaactcgatgccgtagagctgcttggatttaatctcgccggccttcttcgtttccatgccgccggcctcgcgaatcatgttcgccatggccttcacgaggaagccgccggaaccgcacgtggcgtccagaacgcagtcgtccatgttcacttcgagaatcttgtatatgaagtccgtgatgtgctcgggcgtgaatatctgccccgattcggactttttcttgtaacggttgaactcgttgaagaaaatgcccatcacgtcctcgccgcgccattcgttcgagttgacgcactcggaaatctcgacgacccagtcgatgaagtcattgattgccttctggttgtcggtcgtgttcatcttgatgtcggaatattcctccagcaggatgtcaattttcgcattctgtttgcgactggctatcaatgattttgcaagcgtcgagtgaatcgccgtatggaacgtctcatacccaaggtctttcagacgcttcaatcccgcaccgtaacgctcggcaaccaacgcgcatgccgtgaaaatcatgcggtggtacaggttcttgatgccgaactcgaaatgcaggcagttgttgatacgtgccgtcagctggtagatgcgctccttgtcgatgctatcgacggtatagagcgacaggtaatagccgacatgctgcaacttgtcgggcgtcttgacttcctcctcgcccttgaacacgcgcacatcctcgccgttgtacaaaacgccgacaaccttctcatattgtgtctgcatgatgcggacgttcttcagcacctcgtccacctgcgccttgcccagggcaatgcgcgtcgccttcgtctccaacaccagcgctacatccgccttgttcttcggtagataccagccgtccggcttgtcggcaatgcctgaaaatccgagctggttgaacgtcgtgagctggccaacgccggcacaagccaaatcactatccgcaagtccaagaatgtcacgtgccaaatcgcgcacggcatcctctgtcatattcttcgccactactcatccacctcctcaagatactcctgcacccactcgtggatgattgcggcaatcgtcgtcccacgctccgcagccgtcatcttgagcgccttcttgtcgctcacggtgagcgacagcgagagcgtggtgcgcttctcgtccgccgtcgtgtcggcgacgacggcctcctctgtcttcttctgcccggcctcgcggtcggcggcgtattgctcgaacatgttcgccatggcccgacctcctttaatcatttgcacaattgcacaatcatacatcttgctttatgggatgcgcagacggaacatcgccctgacctcccagaagtgccgggaccgcaccccgcggaaccttcccaagcatccccgtgggatccgccccgtggaatgcgtgacgcatacccgggggcatgagcacacacgacaatgatgacaagccggtccgcctcctgtgggtggacacggagaccacgggcctcgacccacgcaaggatcccatcctcgagatcggcatgatcgccaccggccccgacctgaagccggtggacgacgggttccacacgaccgtccactgggaaggcaaaccatccgaattcatccagggcatgcacgggcccaacggactgctcgccgaatgcgcgcacccgagcgcccccacatgttcgccgccgccctgtccgcacgcgactacgtggcccgacacctcggccagggggtccgcctcctgcccgccggcagcaccgtccgcttcgaccgggacatgatcgacagctggatgcccggcgtgctcgacggctgctcccaccggtccctggacatcagcgccgtctgcgaggccgtccgcatgtggaaccccgcgatcctgcccgacatggaaccgtccaccgaccaccgggtcatgcactgcctggccgacacgctccgctacgcgcgcgcataccgggggctcatatgctcgatcggctgaaacacgcgcccgcccgcctgtgggcgtggctgaaacgcctcccccgccggatcggcgcatggaccatgtccgagcgcggccgcatcgtatggacgcgcctgctcgccgccctcctcctgctccccctcaccccgtccctgaccgtcgtatggaagatcatgttcgagggcggcaccatcgccgaccagaccgtcgtcatctacatcacgatcctcatcctcctgatccggggcatgcgacgcggcctgaaacgccatccccgcgacaaggaggacgagcggtgagacgcccgccgcgcgggttcacctcctacgccgcctacgccctctggcatgcggccgtgttcgcgtccatgaacctcctgtactggccggcggtcatccccggactcgccggaacggtcccgcccgcggcgggcgtcctggtcgcgggcatcgggatcacgctcgccgcaggcgtcgaatgcacgcagggatacggtttcgaggaggcacgcgaaggcggcttccataccggcctcgcggtcgcatgccagatgcccgccgtctgcttccgcctcatcctcctgaccatgggaacgccggacggaaccctgttctggacgcgcacgctcgccgtcctgggcgtgctcgcatggcagacatgctgcatcgtcatggaccggctgtgaccacaatgggacgcatgaccagactcatcgactacggggcgtgggcgtcgtcccgctccgacccgtcgaaacgccgcacatggccgttgcgccgcgccggatggcgtttcgaccgcgcgtccggcgcatgggacgggccggacggcgaacggctgaccgtatccttcctcgggttcgccatcctcgaacgggaggacgcggactgggagcatcccggcacgggctacgggacgcaatggcatggcggcaggtacggcatgccatatgcccgacgcgtcgacggcgactggaggccccgcgtggccgtcatgctcgcccggaacgccgtcaaggtccaggatctgatgctctcccgtcccctgaccgccgtgtccgcggcggacgcgcgccggctcctcgtccggtgccggcgcgccgccgacctgtatccgcccgacgatccggacctgttccggcgtctcatggacggattggaggagaggacgacgcgtatcggatcgtacgccatggtggaataccggcgggggttcgccggcccggtcctcgccctggcgggcggcctgctcaccccggtcggctcgttcctcctcggatccgatccggcggggttggcgggcatcgccgcgctcgccgccggactcgcctgctccggactgtcctcgctgatcgacgggacggaacgcgcgggcggcgcataggcgtcgcgccgacggcatgatccgttcatgaaaagcgatatgccatgaccaatccgaacccaaccaatctcaatacgcgcaaccagcctacgggcagccgaactatgcgccgccagttcaaccccgtatacccgcagcccacggcatcctatgggagaacccctccgacacaggctccttcggtttgggctgttctcggcttcttcattcctctggtcgggcttgttttctgtggatgatctggaagaacgatcgtcctggtgatgcgggcatggcaggcaaaggcgcactggtttcagcgatcatcaacgtcgtgctcttcatcctatggatcgtgttcgcaggcatcctattcgccgcatccggctcctactaaagagacaaaccgaaacgacagtcccataaaagacgagggtggcacatcccatatcaggatgcgtcaccctccttcaagcggaaactgaaagcgattagttgcagggtacctggacgcctggtttgccactggtatcaaccgcccagcaaatatcctcgtacccgtcatcaccgccgccgccctgggacggcggtggcgcgggctgcggctgtggcgtcggcgtataaccgcctccggtcgaaccacctgtggactgctgtggcatgtacgcgtacccgccctgggattgcgtgtagcctccgcccgtgtatccggtgtagcctccggttgtatcgcccgtgtaggagccgctgttatccgtctgcgcctgggcggcattgtcggccgcctgcttctccttttcggccctggcattcgcgtccgcatccgacttcgccttgatggagtcgttgaccgccttcaccgcatccgagatcgccttcccgtccttcgatttgatggcgttctccaatgcggcgcgaaccttgtcgtccttcaccctgcccttcgaatcattcaggatcctggtcgcgtcggcaacaatcttgtcgagcttcgaggcgttcacggcctcggcctcggccttgacctcgcctacggtcttcgcgtacacgtccgcggtcttgtcgagccacgcggtcacggccttgatgtccttcaacccatccgccgggcatccggggatatcggttttcgtcttcgaggccgtcttcaccgtcgaagccaacgtcccgaccgttttcgcgtccctgacctccgaatccttgaccctgatcgcggtctgcagggcgtccgacttcaggtattccgtcagcttcttccgcgccttcaccgccctgtcgtatgaggtggcgcattcctctgaagccgccgtcaaccgatcatggttccaatacaggcatccgccgataccgcccgccgcgaggacgacggcgcatccgcccgcgatcaccggcaccagccatttcgggcgcttcggtttcgaggcggcgcgggcggcccccgacggttccgtcgggggctggggcacgggattcgatccgctcatgttatgttcctctttcatgtttccgctacgcgcacgatgataaatcatcaaaacaataaagaggtgtggcatatcccattatgggatataccacacctctcacgcggaaagaggaaagatcaactgcagggaacttggacgcccggcttgccactggtatcacccacccagcaatcttcataataaccgtcatcaccaccagaggagcctccgttgccgccgccctgggaaggctgctgtggctgcggctgtggcgtcggcgtatagccgtctccgttaccggtgggctgctgtggcatgtacgtgtagccgccgccctgggattgcgtgtagcctccgcccgtgtatccggtgtagccatcggtcgtatcgcccgtgtaggaggagccgttgtccggcgcctgggcggcattgtcggccgcctgcttctccttttcggccctggcattcgcgtccgcatccgacttcgccttgatggagtcgttgaccgccttcaccgcatccgagatcgccttcccgtccttcgatttgatggcgttctccaatgcggcgcgaaccttgtcgtccttcaccctgcccttcgaatcattcaggatcctggtcgcgtcggcgacggtcttgtcgagcttcgaggcgttcacggcctcggccttgcccttgacctcgcctacggtcttcgcatacgcggtcgcggtcttgtcgagccacgcggtcacggccttgatgtccttcaacccatccgccgggcatccggggatatcggtcttcgtcttcgaggccgtcttcacggtcgaagccaacgtcccgaccgttttcgcgtccctgacctccgaatccttgaccctgatcgcggtctgcagggcgtccgacttcaggtattccgtcagcttcttccgcgccttcaccgccctgtcgtatgaggtggcgcattcctccgaagccgccgtcaaccgatcatggttccaatacaggcatccgccgataccgcccgccgcgaggacgacggcgcatccgcccgcgatcaccggcaccagccatttcgggcgcttcggtttcgaggcggcgcgggcggcccccgacggttccgtcgggggctggggcacgggattcgatccgctcatgttatgttcctctttcatgtttccgctacgcgcacgatggtagcatcatgcgtggcttgttccggtcggtttcctcacatcccggggattcatccattcctggcgcttgcctcggcttcaatcatcccacggtatgcgtccctcgggaagccaacggatttaaaccatgaaagtgaaccgggtgccgcatcccctgcggcccgtcatgggccggggggatgcggcaccctttgccgtcccgcgtgtcaggcgcgcctgcggttgcgcagcgcgaacgcggcgcccaggccggcgagcagcatgccggccgcgacggcgggcaggacgcccgtgccggtggaggcgagctgcttctccctgacggtcacggtctcgttcggcttgcgcgcgtcgccataggagacgagcctgcccgtctggtcgtacaccttctcacgccagtagtaggtgccggtctccttgacggtcacggtcggcgagtggacgccgtccttcgcgccgaccttgccggtgacggtgatgagcacgtctcccgactggtctccgttggcctgcttccacagttcgaattcggccttggctgcctgctcgcagttcttgagcaggagctcgtcgtgcaggtcggccctgccgttctccaacgtgacctcaccctggctcctggtggacacctcgcacctgggcgtttcgggcttcctgccttggacgcgcacgatttcggatgcgaggccgaaagcgtgctgcaccctgccgtgggtgagctgacgccaggccaaggcggcgagcggattatggttctggtcgccggtcaggctcggtgtcatgacccaatgccaagcgtaggtgcccgattcggtcagggtgaacgagtcggtcgtgtaggtgccgaacctggtgacgtccttgatgtcggcctcgtgaaccttcaccgcgttttcgggcacggtgtcggtctgttcgatcgcggcggacgggtcgtcactcaccttgtagaggacgccgtggaagtcgaggctcaacggggtgctcttcgcggtctcgccttcggtgacgttagtctccgggtaggtgggccacacgtccttttcgttggtcttggcgacgacgagcttgtcgatggtggtctcccccgccttgacttccttgctggacaccgtggagtcgagcttcggggtgaggcggaacatgacggtctcatccgcggtgaacggagcctcatgaacatccttggcgaacggatagtccctggacggttcgatgccggtctggttttccgtgtcctgatccttgttcgcgatgtcgaacacgaacgtggcgtatccggatggcaggttcgtcagattcacaccatcctcggccttccattgggcgacaggcttgtcctcgtcactgctggaaatcaggtagtcgccggccttgttcgtggtgaacgtggcggtggcgagcttcacggcctgcttgggcagttcgacggtcttgcctgcggcggtatccttctgagcctgttcggcctgttcgcgggtcataccaccgtagatggtgccattcacggtaagcgtgatctggttgtcttccgtttccttgccttcgccctgaccgtccttggtgtgcagccagtcctgggtgtcgaccttgccgtcaccgttcacgtcggtcacgttgagtgtgaccttatcgcggatgacgctgcccttttcaaggtagacgacatcggtcttgtcggatgcctgagcggaaccgatttgcacgctcggacgttcggtgccgtcggcgccggtcaccgtgctctgatcggtcttgtaggcgtcgctcacactcgacttgatggtcggctgcatgttgcgcacgtgctgagtggattccgcttcgagcacgttgtcggaccagtcgtagtccgtggacaggtactgcttcatgttggcgtcctgcatgtcgggcgtgatctgccacacccacgtgtaccagccggtgtccggcaggctcgacggggtggctcccgggtgcgtcttcacgaagtcggggtccatggtgatggaggcggcgtccacgtgattggtggcgccgtccctgtcgccggcggcggtcgcggtcgcggccttcaccccatccttgacggtcgtccggccttcgaccggcttgttcgcgaagtagtagagggtgccggtgctcttgatggtcgcgccttcaatccagtcgccgcccgtcgggtccacatgccaggtcagatcgtcttcgggcgcatgcccgtattcgatgcgatgatccgactggtcggactggatggtcggcttgaagttgttcagcacctcgaactggatgttctccgacacggtctcgggatcagagggacccatcaggttctggttcggggagctcagcttgacggccttcgggatctttctccatacgctccacgtcactttgccgttgcccgttgccgtccacggaaggtggatcgcctgacctgtggtggtgccgctgatcgtgttcgtcttggtctggtcgaacacggccgggccgttcagggtcgccgtgtactggatgcccgcgatttcgacgccgttctcggtcgtgatgctcggggtgaccgttcccttgcgtttgccgatggtgtactggtatctcatgtcgaggttcgagggcgtgttggcgaccgcctccgtccacaggctgttcattttggccgtgtacgtgtcccagctggtgccgtccttccagccgaggcgttcgatgcccgacaggtattcgttgcccatcgggtcgagcttctggtggatgaggcctgcgatcgcggcctgcgtgaggtcgtccgtgttcccgttgtacttgtcggtcagccatgcgagccgctgcgcgtccggtttcgtcttcgcgtcggtccactcgccccacgtgcccgccgtgcccgtgtagagcgtgtcggcctggatgcagtacacgttcttcccgttgaccttgtcgaccacgccgagcgactgctccatgccctcgtacttgtgtccgttgctgaacgtgatcgtgcccaggttcgcccacaggcccgggttgccgttctggatggagcgctcaaacggatcacgcatgtcggccgcgtccgccgtgcccgcgacgagcatgcccgccgccagggtggcggctgccgcgacgcccgcggcgagcgtgcgcgcccagtgtctgtcgttatgagtcgaacccataaggatgtttcctttctgtcggataggggacggcgtacgtccgcccccgcacgcgcgtctatgcgggccggaaaggcatgatcgtcccgggacatggaagaacggcatgggattggatttgacggtttctagccgagcgcgtccctgaccttgacgacgatgtcgagcaacggggacaggagacccgtcggcccgtacgtccttcgcagccgatcgtattcgacgcacgcgtcccggacggtcacgtcccagccctcacgggcgattagcggataccggccggccgtgttcaggctgcggcgcaccggcccgaacatcaaccggtatcggagccatgcgagacgcggccgcgcggaatcctccaacgttcgcgcccggtcgaggatgagcgtcgcaccgtaacgcagcatgcaggcgcgaaccgtcatgtcaaggtcctccgcgtcgccggtccggtacgtccacccggggtatgggacgcgacgggagcgcatgccgtccatcaggccgcgccgttcccgcccggccacgcatacgctggcgcttaggccggtggcccggcccatgaccatgagcatcgcggaatcccccgccgtccgccccatgaccaggctccgctcggaatagcggaacggggaccgatcccgtctccacgaggcgtcccgatggaagtagcgcgccgggttcgcgtcgaacacgccgtgcccgatgaggaacggccgtatcgtgatatgcccctgtcccgtcatggcggcccatggtacgcgcgtccgaaccggccggtcccgtcgtgtcccgtgatgcggacgggggatggcatcccagccggccgcgtagccgacggccaggagcatgaggcgcggagcccacacgccgccggcggcgaacggggcgagcacggcggcgaacagggcgagacgcgcgggccatgggccggggcccgccgcccgcgcccaccgttcccggcccgcgtccaggagcatgagggggacgagccagcgcagcaggattcccgcggccggccagaacaggatgacgatcggggtcatgcctcccgtatgcgtccgtccggaacgcatacgggaggcatgcagcaggggacgcccgtccccgcacccacaaggaaaggaaaccgtcatgaccgatcaggagccgggagcccagctcacccaatcatacgaatcccagtcatacgcgccgcaggagagcaagcgccccgaaatcacgaccgtcgcgttcggcggataccggacggaggatgtggaccgtctggtcgaccagtacgaggagaggatggccggataccggcgcagcctcgcccggcagatcgcgatcgccgacaacctgaggaacctgaacacgcggctgaccgcccaattggaggccgcctgccgggaacgcgacgaactgcgccaccgggcggaaagcccgttcgaggcggccggcaaggccgcgcaggacctcgtcgacaacgcgaggaacacggcgcgcgacacgatcgcggaggcgcgggcgcaggcaaaaggcatcctcgacgaggcgaacgcgaaggcgggggacgtcgtcgcgtccgcgaagcagaccgccgacgggctcgccgaggaacacaagagggagcatgacaaggcgatggccgacctcgccgagcaacgcgacgcgttgaagacggagcacgcgaaggccatggccgacatcgaaacgcgccgcaaggacgcgcagaccgcgatcgcggaacgcgaacgacgggcgggggaactcgaacaacgggccagagggacggtggacgagatccgggagaccctgaagaacgcgatccgcacgctcgacgactgaaaacgaacgggatcaaggggatgcgggcatgcggccgtccggaccgtttcgcccgcatcacgatcccctctcaagcgcataccgggtgcgcattctcccaacgaaacgcgaaccaagcagccccatgatggcgtgagacgtggagcgaccacccgcaaggatggcctgcaagccagaacaaaccagtttgcaacggacaagaccatacccgcgtccatacgccggatcggtccagcccggttcgccgcatggacgcgggtatggtcgggcggacggcgacgcccaggagcatccacgcccagacgttgacgggcgtcagacggcgagcctttcgcgcacgcggagcgcccagtcgaccgccatggcggcctgcgggggcacgaccccgttgcccagggcgcgcagttggaggttcctgtgattgccgtccacatgccgccagatcgccggatcggtgacccagccgtcctccaggcccatcatccattccacgaacctcggggataggtgggcggccgacgggaaccgggggccttcgaatcgggtcttccaataaccgagcacgcttttgtcgggcagacgggtcgcggggatcgggatgtccgggtccatgtccttgcagccgggccagaacatggggtcgatgaggctcatcccccggtcggtttcacgccagagcgcgagcatgcggtcgcgcatcggctggtccagccgggctttcggatgcgcgtcgaacggggcgtggcgggcgagccagtacggttcgaacagcgtggggtcgtcggcgttcgccccgacccagcggcgcaggccgccggtcgcctgcgtgggacagggggcgggacggccggacacccgctcccagcggcggatcgcggcggcgaaccggccgaagcgcacgccccgcccgtcgtccagaccccagagtcccccatgataggggccgggcgcggggatcgcgcgcgtcccctgttcgacggcgccggtcatgcatgtctggtcgttcctctgattgcggcctttcacgtcgctggcgcgcggcgtgggcatcatatccacatcatccgtcatcacgtcctccctcaggttcccggtcgaatcgcgtcggctcccgtcccggtcgccgcgacgcaggacgcgttccaacgcggccccgtcgcggggcgcgatcgcatccatgcagttcggcgtggcgaacaggcgggcttccggcaggatgtcgatgtcgtcgctcttctccgcccagtcggcgacggtgaccgcatgccccatggccgcgcggcgttccgggatcatcgtgcccccgttccactcgttcgacgtgggcgtgggcaggtggtcgatgtcgtcgcgcaggttccggtagccggcgccttttccggcgcgcggccgttccgcatccgcatgcgggggcagcatgtccatacagttcggcgtgcccggcagttcgttttcgctcatgcccgtcgtatgcgttcccatgatccggatctcccccgcgtcgaggatcgcgttcaccagggcgacgccccgccagttctccccggccgccagcagccgcgcaccgtatgccgggtcgcgtccatcaccgtcggcgtgggcagccacagatcgtcatcagtcatggccacgggtatgcgtcaggcggggcaggcgtatcggatcatggaaacgggacggtccccgccgttccagacccttagtcttggccgcatggacatcatccgcttgacttcctcccccgcctaaagaggcgggagtctgcgccacccaaacaaagatcaagactcccagtatttccttcatgcccgatcctcccccatgccaatccaatctcacgaaatcgcgggaatggccgaacaaggtcttcccccgatggtcacgaacatggacgggtggtcgcccatgtggtcaaatacgcgaacgaggcggggcgagcccatgccgctgcgatcccggttcgggtatccgctttccatacgaggatcgcgcgatccggctggaatggcgcgagacgggacccgaagggcctatggacaaagaaacccggcatgcccgcgatttctccatgcgcaacgaagccgaccatgccccgggtcctacaggagattgatcgcatccgccaatccgagctgcgcgccccgcctccggcggcggaccgcatcctccgctgtgcccgccttcacgctgtcgtacaacgcgttcggcgtgggcagcatgacggccgccgtccgcaaatccggcgccccgtccccgtgcacgcccgccccgttcgcatcgttcgccctcggggtcggcagcttcgaatcatgctccctgaccttctccgggtccatacggcccggcaggtccatgagacgcacctgcgtggacaggaacgtgctcctgtccaacgggcggcccgacgtggccggggcggcgaacaccccgtccgactgcttcggcgtgtacaggaacccgtcggccgggatccccgcagcctgcgcgggcaggggcgcatcccccgtcccatacgcctggcccgggccgcccttcgccccgtcggacgccttcggcgtcgccaaaacggaaccggccgccggctccgggaccttcagccacgattcgggcaccgtatacacgcggccggcggccatcacgccggacttcggccacgcgtccatgaacacgtccacgtccccgaacagatccggctcgcccgtcgtccacacatccctgtccgcatcccacacgccccatgcgcgccccctcggcctcatgggcggcagttgggcgagacgcctcagccgggcgttcgacggttcgcgcgccgacttcggatcgcgcggccatgcggtcacgaagatgcgcagcctgtggtgggggcgccgatgtcggccgcctcaaggcctcgccacaccgcgtcgtagcccagattcgccagatcgcccagcacacggccgagcgcccggatcgtgggcgccgtatgcacgccggacaaccgttcgtcatccgccagcaccatgtcgcccctcacctcgaacacgcggcggccgcactgcctgcacgtgacgggcgagcaccgctccggatccgcatgcaggaaaccgcgcaggacgacggccaggggctgcgaggtttcctccttgggatccggggcttcgaatccgtcgggcagttcgaggtccggaatttcgcaggagcataatccggccttgtccaacgcttcggagcggagcgcgtccatgcgctcgtcctccttggagacgctgatgccgctcaggagtccggccacgttctccgcgaccacgagactggggcggatgatgccgattcccttggcgtagtcgagccacaggccgcttcgcgttcccgccttcaacccggcacggaaccccgcaagagaaagggactggcagcagaatccgccggccatcacctcgatgtccttgtatttctcccagtcgattttcgtgatgtcgcccaatcggcgggctttcggcgcgtgatgggagccaagggcgagaggcccgggttcgatgtcggaccatccgaccagttccccctcgccgatcgccttggatacgccgatgtcgaggccgagatagccggagaacagggaaatcgtcttgtatgtcttgttctgcatacgcggctgtatgcgttccgaggcattcgaaaaaacccgtcagccgttgcagatgacttcgctctggcgacaagctaaaacaaagtcatctgcaacggatcaatcctcgacgatcccgtcgggcgtccattcgcatgcataatagggtccgttgtcggtcatccacccgtccttcccgtccgccggacgcccctcgtagcggctgatgtcggcgatggccggatcgtcggtcttgtggaggcggatgaggtcgcccggctccggttcgcgccgtacggcctcgggcagcacggcgtccgggtcggggaacgcggagccgtccccgacccaatggtcggtgcagtccgagtccacgatgtaggattcgcccgcatcggtcctgccggccaatgcggggcggaagcgcgaccattcgtcgccgtcccgttggatcaagatcccgcctttgatgcggtcgaggaggcttgcgggcaggttctcccaaccgatgatgtcctcgttcatgcccgcgcgcatgcgtccccgacgcatggcctccggttccgcggacgggttcgaggacatggtgctcacggccgtcgacctcggcatcggcccgacgaccattcccatccgacggacggtccacaagacgacgatccggctatgcgccgtcgcgggggcgcatagccggatcgcatggtcatggacaggaacaatcgaagccaccgggcgaagggccttccccaagggtgtgcgggcaccttcgagccggcgtccggcacggcgggcggagacgtcatgccgcccgccgccgaggatctcgacccgaaacgctacgggcacaagagggccgtcaggcttgtgaactggcgggtcgaacacgatccgaccagcctgtggctgcaagaccggctcaaggccaccatgcccggcgtggacgcggacggcaacccgttcgactaccgggacgagccggtgctcgacccggcggccgaggcgcgcatgatcgacgacgcggtctaccgggaggatgcggacggacgcccgcactacgggcggatcatgcgcgccctcgcctcctggtatccgaacgaggcggaacgcttcgacatggcgcgcaggatcgcggaggaccggtgcgacgcgctgcgacgcaacgtgatcggcgacccggcccgatgctactccgccaggctcgtcggctacgcgctcacccgccccgtgcgcatggaggcgatcctcgcccgtccgccctacaatctgagcgcgcaccggatgcgcgtcggcaaacggtacatggaccggatcggcgcgtacgcgcgcgaacacggcggacgactgcccgacaaaaggcagcgcgaccggatctgggacgagaacatgggcgacttcatccacgagaagatcgcgaagggcgtccagtacgggcgcggcatgtactattccgacgggtcgaacgcgcgccccgaataccatgggcgcccgccccgtctggacgcggacgggaacccgttcaacgcgcgcgaggacttcgaacgcatgctggccgccggacgtgcggagctcggtcggacgcccgccgaattcgacgacgtggtcaacaggatggacgcgcatgcggcgttcgccccgggggcgcggacgcgcacgccgcatgggcggaggcgcgccggcgcggcctggacgtgcgcctggtcgaggccgcgctcgacgtggacgcgtcggacgcggccgcatgggaggcggagtatcaggcgagctcgggcacccggtaggtgcggggcacggccgcgcccgcgggccacatgtcatggtcgcgggcgaacctgaccgtcacgttgacgacggtcccgggcatggggcgggcgagcatcgcgtccaggccctttttgtcgccggccagccagaacacgaggagcgcgaggtccatggcgccggccgcgcatccgggcctcgtcccgacgagcgtcgaaagcgtgtcgcgcgcggccgtcagccggccgggcctgggcgtgacggggatgggacggcggcgcagcacgtccatcgcctcccccatgccggcgggcaggcgcgggtgatccgcggcgcgtgcggcgagcgtgcgcgcgtcgcacgtcgggtcgaggagggcgagcgccatcatgtcgcgtcccctgggatcgttcaggccggcggcgagccggtcggcggtctggtcgttcatccacgtgcccgcgccgccttcgaggcgcgcgatccactcgttggccaggttcatgtagtcttccattgccgttcctccgtttcgacggtgttgtgcgccccgggtatgcgttccccgtccgtcagaagagcgggaggcttgcggggcgttcgagccggtcggccgtgagcggcaggtacgtggggtcgagctccgtggccgcgcaccgcaggccttcccgccggcatgcgtccagtgtggtgccggagccggcgaacgggtcgaggacgaggccgtggggcgggcatgcgaggcgggcgagccatcgggtcaggtccaggggtttgacggtcgggtgggcgagccgtctttcgcccgccggcacggtcagggcgagcgccgccgtgtcgagcaggcacgcggggtacgcgtccgccccggattcgagtcccaggcgcgcgcagcacgccttccacgccttgtcccgtgtccgggggcggacgatgcgttccaggacgcgcacgggcctgtcctgcgctttcgggcagtagtagaagcgcggcgcgtccgcgggcaggagccgggccatggccttgtccatgaggacgttcgacgggtggcggcccggtatgcgcggccccatgggcctgggcgtgtccgaatcgcggaacgtgtcgccgccgcgcggcgcgtccggacgcccccggcggtcgcgttgagccggtagcggcgccccagctcccccatgtccgcgtccagggcgcaggcggccacgttcagggcgcccgtcccgtggtccatgaggttgcggccgagcatggactcgcgggggcgctgggcgacgaggatcggctcccatgcgggtttgagcgccgggttgaacccgcgccagggccgcgcctcgcgggtcttcgcctcgtagcgttccgtgtaggcgacgttgcgttccagggacgcggagtcgcgtatgacgccggtccggtcgtccttcacgccgagcgcccggtcgaccgcatggtcgccccattcgcccttcggcatgccggacgcgtacagccagcagaactggtcgcggatcagccagcccgcgtcctccatggcgcaggcgagccggtgccaggtgcggggcgagccgaacacgagggcgaacgcgccggggcggaccatgccgagcatggccgtccagaattccgggtcgaaggcgatgccggtggagtcccagcgtttcacctcgcccgcggtgcccaggccgagctcgtagggcgggtcggtgacgatcgcgtccgcgggcgcgtcgaggaggccgggcaggcgtctcgcgtccgcgttgtacagggtcaggccgtcatggtcgatgaatggtctcatgggccccgtgtatgcgtccgccggggcgggcgtcgggcccgtatgcattccgggcgggctgtatgcatccgtatgcatcgggggatgcatacatcttttctttccgtttcggcttgtttccgacgttccggggatggtccggaggcgtgtatgcattgtatgcatcattcccttataggggattcgggaaaaaggaaggaaaccccatatattgatgcatacaatgcatacaagagaaaggaattatattttttcctttatatataagggttttcgggccttttcccaagccttttctgtatgcatccccggatgcatacagatgcatacacgcatacaaaacgggccggaaaactttacaatattgtaaagccccggccccggactttacaatattgtaaagtccggggccggggagcccggcgaaacggatcggaggatcgcatggaagacgggaacgtgaaggcgacgctcgacatgctcgccggactgggactggacgtgcgcgtgatgcgcgagacgccgttcctcgccgtcgtggagaaccccgccatcccctcgcgcagggtcgccgtcgccgtcccggacggggacgggcccgcccgggccgccatgttcgaaaccgacccgcgcaccggccgcaaccggccgcacggggattccgcggccgtcccccgcgacgacccgtggccgacggtcgccggcatgtgccggacatggctggccgggctcggcgcgctcggggacgccgccgggctcacccgggccgaactcgcccgcaggacgggcgtcgcggccaccaggatcagcgaatacgcccggccgcgccccgggcgcgcggatcccgccaacatgacgctgcgcaccgcccgcgcactggcccgcgcgctcggcgtcaccatcgacgccctgtacgacaccatggcgatgcgcatcccggaaaacgggccgacggcccgacaggcgggaacatccgatccggcccgccgggcatgaaaaaaggcccgcacggcacgtcgccatgcgggcccgggatgcgccccggctaggggcggacgagcaggaaacggtacgggagcggatccgtctcgccgcgcatccacacgcgcagcagcggccaccccgcggcccgcgccgccgacgccgcatccgacaggtccgagacggcgtcgacgatcaggttcgcgatcccgtccgcggacacgaacgcgtcaggcaggcccgggatgcgcgccggcaggccgtcgcgctccatacggtacagctcccacacgtgcagcacgctcgcatcatacgggtgcgcttccggccccgcatgatccgacccgtcgcgcagacgcccggcggccgcgagggcggccgcatgcggcaggatcgcgacgagcctgtccgcacgcctgtcgaactcgcggaccgtcatgccggacggcatgtcacggctcgaatcccacgccacgtgcacgttcaggaccccgtcgaacgtctcgaacggggtcagcttcgaatcggctatgatacgccccctcttccggtcagacgcccatgcccgcgaacgggtccgggacgccggccgccgacgcgtccggcaggccgaacgccgccagcgggtcggtttcgccgccgatgcgctccccgtcgcccgtcttgacgaccgcgttcagcatggcgcccacgcccgaattgtcctgcctgtacgggtacagccagatgttggcgcgcacgatcgcgcccgaatacagttcgttggcggtcagacgtcgacggttctggtccacgacccagcccgcggcgacgaggtcgttcttcgtgccggccttcaggatccaatggccctcatactccttgtacacgtccttcttcagcttgcccacgttgtcgcccctggtgaacacggccgtgtccccgtcctcgacgggcaggcccaggcgcttcacccaatccgcgtcgtccatgctgtgcccggcgaacggcgcgtacgacttgccgtccctgccgggttcgccgtcgatgccgcggcggatcgcctccgtgcatttggcctgcaggtcgcgcatcatcttctgggcgtccggatccttcttgtcgaacaggatggacagcgtgtacttgccgttcttcggatccgtgtcgaacaggtgcgggaagttcgcgatcccgggcactgtcacgaggttcaggcgttccgcctgctggttctggtcagccatcaatgggctcctttccgatcatggtgggccgccccacgatggttgcggtccgacggttcccgtcagcgtccggtatgcgtccccggctcacgcgcggatgctttccggccggaagcccacgtcctggatgtccggcccgtcgatgcgcaccgtcgtcagctcccgcccgtcgaacagggccgcgtacgcgccgtccgcgaacgggatggagtcgcccgcgcacagggcgcccgcctcgtgggcgagccggcgcgcctgctccccgtcgcccaggtccgccagcgattcgatccggtccttcaaaccccaggcgcgcgcgtcgtcctccacgccgcgcgcccgccccgccggcgggccggcgggggcgggaccacgtccccgccggcggcccgcatgggcgcgaacgtgcccgcatacccctgcggcaggccgcccggcctgtgcgccctgttgttcctgtccacgctcattccagctccttccggtcgtcgtcccgcatgctatgcgcccgcccgtccggccacgcgtagccgcgcagacgggcggggaaatatttcaggcgcgaccggtacagcagccacgtgcgcaggagggtcggtatcccgtccgacttgcgcaggttgtggcgggcgcacaggccgaccagattgtgccggtccgtggccccgcccctcgaccacgggtaatgatggtccatatgctcgatcggcccccggcatcgcagcaggccgaacaggccccgatgctcgcaccggccgcccgccgccatgcggatccacgtccggtccgcgtccggaaacaggcggaccggatcccggtcgaacgggttgtcgggcttcggcatgcgcaggttcgcgagggccaggagcgcgatcaggacgacggccgcggccagaatcgggacgaggcgcgcgcccgacgcgtcccggatctgacggagcatgcgcgccagccccgccgcacgctcccccgcatgccacgggtccacggccgtgtccgccgcgtattcgggcgaatcctccgccaggccggccctgagccggcgggccaggagcgtccagtacgcgcccgccaggccgcccgcgccggccagcgcgcccgccgcgtacgaggcgacgcggagcagacggtacgcctcccaggcgcggcggatcgtgcgccgcacgctcacagcagcccgatcagccaggacaggagccgccacacggggatgaggaggaacgagcccacgccgatcagggccgcccacggcgaccaccggtccgtgtccgacgcgaaccggtcgcgttccctgtcctccgattcgcggctcatcgcaacgcctccatgtccccgtcggacgcgagccccatgcgattgaggaggcgcatcgccgcgaccgcgtccccgtgcaggtccgacacccatgcggcgagcgcgtcccggtcgggccggtcggggaacaggccgggccagacgcgcatggccgcgcggatcacgcccgtcgccccctcccggtcgccgtgcgcgtccatgtcgagggcgcgcatgcccgccaacgccagattggccgtcaacgccaggccggccgtccgccgggcgaacccgatctgctcgccggccggatacccgccgggccaggctttcagcatgcgcgcgcgcatccgttccacgaccagcatcgtccccgcgtcatccgcgtccccgtcgagggcggcgagcgtgcgggccgccgcgtccgcgtccgacggcgcgtcctccacggacgcgtaccagacgccgtcccccgtgtcggcgagcaggcccatcgcgtccagggcgacggtgacgcgggtcgcgtaccccgggtccgtctcatgcgggtagcgggcccagatctcgtcgggcagccatgcgaacgggagggcgagcagttccatggtgcgcggcgaatccggtctgacggccatgggttcgggtatgggcagcgggcccgtgccgggggcgagcagccatccgggcggcgtgccatgccccagctggtaggcgacggcggtccggttggcttcgagcagtcgcgggtcggacaggagatacgggttgtgttcgctcatgcgcccctcctatgccgcgccgtgttcgcccgctgttcggcgaggaacctccggtagttcggatcgttgctctcgtctgatatgtcgccccgctgttcggcgcggctgaaccgccgctcctccgtgctgcgcgcccgttcgcgttccaggagcgcgcgcgtcgcctcgctgttcgacgcgggtatgcggatcggacgggccggcgtggcggcgcgtccggacgcgggccggttcgtccggccgcgccgccgcatgtcgttcaggaggcgttcgccgacgcgtatcagcgtccgctcgtccaacccgttgttcacggtcagcttgtagcctttcccgaagccggccaggagggcgttcttcgacggggcgaggggccgggcgggcgcgtcggggcgcgcccccggacggccggccgggggccgggacgcgtccgcccggctcgcggggccgttcgcggcgcgcatgcgcgactgcggggaaccctgggcgaacgcgggccgggacggtgggcgcggggccttcgcctgctcgtggatgtcctcggcgagctggccgatgtcctcggccgccgtgtcggagcgcatgatcttcctcacctggctttcgagctcgtcgccccgcagggatttcgccaattcggcgcgcaccttgttctcgtatcggacggtcgccagccggttctcgtccggggtgggacggttcgcgagatattcggttctcgcccgcgcctccttgtctctggcggcgatggccgccttgtccgcctggctgggcccgtgcccgccggccgaccggccgccgcccgtcatgccatgcatggccggccccatgcccgccttcaccccgttcatcgcggtcccggcgaacccgccgcgcccaccgtccttcatggccatgcccgcggagccgagcgccatggcggccgagccgccggtcgccacgcacacgcccgccgcgatcgcggcgcccgcggccatggtcaggccccgtttcatgccgttgccgaacccggcgagctgggcgaggccgggcaggctgaacgggttgccgatcctccacaccttcacgcacaggagcttcacggccttcacgtacaggatcggcaggaagatcgccgcgacgagcaggcccgcgaccccgccctgcgtgttcccgtccgcgtcgaccaggcccaggagggccatgccgatgttggtgaacaggatgccgagactgccgaacagggcgacgaccgtggggcccgccacccatgcgagcatctggacgagcgcgttgccgaccgcccgccggcccgcgtccgggctgacggcgagcaggagcaatgcgaggaacaggccgagcgcggccaggcaggcgacgagcatgctcagcgtctgcaggctgccgcacagcaatccccagacgatcaggttcacctcgccggccacgccgttcaggaacccctccgacagggtgcccagggagcttttcccgtgctgctggtcgatgagccggtaggcggccgtgttctgctgcatgttcccgccgccgttcgtgaacacgagctgctgccagccgctggtcgccgtgttcacgtcgaacaggagcgtcaggttcgcgatctcgctgcgcttgttcgtcttgtccgaatcgtcggtgacgggcttcgccttgtccgcgtcgccgcgcgtcacataatacgtgtcgttcccgtccgggtcgatgccggtcaaagccgcctcgcaggaggatgcgagcggccctcccgcttcccggctgacgacgcccgccgcggagcccgccaggggtttcctctcgatcgcgccgacgaacttgaagcccgcgcgcgccttgaacgagccgtccgcatccaccttgcacacgttccacagcatgacccaccggtcgagcatctgggtggtggaatccgcgggcagtttcagcgtgtactggacgcgcaggtccttcgccgtgctcatcatggtcggccagaacgcgatcgcgttctgctggacggcgttcaagccgcccatgcccgcggtcgtgatgtcgctcatcgccttcgcgtccgcgcccgcacggtattccaggatccggcagaacacgttgctcgcgttcgcgcccgccccgtaggagccgcgcatccacacgcgcaatccggtctcctcccacatgaggttcacgccgtccgacatggcgttccggttcttgcgggccgcctggttcaatacggacgtgtaccgtcggcaggacgccatgttcgactggtcggacgggtcggcgaccagtccgcccgtcttctccaacgcgccgttgaacgccttcgtgacgccgccgcccgcctcgtcgaccacgcttttcgccgtggacaccagccagtacggggtgcccgggtacgcgtccgtcggatgggcggcgctcgtcgcgcccatcatgtagaacaggccgagcgcgaggaacaggcagacgagccgtctggcgagcacgcccgccccctgccgcatgtagacggcgacgacgcccgccacgatggcgacgaggacggggatggcgaggaagaagccgatggtcgccggatcgaacagggccttgtagatgccggccgccatcgtgttcgcggccgggccggccagggcgatcgccttgtccgacccggccaggacgccgccgtcggccaggttcgcggccgccgcccacatgccgttgcccaccgcgttcagcatgtggccgagcgagttgccgatggcgtccgtgaagttgagcatgttcacgatcttcgacgcgaaatcctcgcggctggtgcccgatatggtggccgtcgcccaccggtcgacgggcaggcagtcgagcgccctgcagaccacgtccgtgttgagcgtgtccgcgctggcgggcgcgcccggcgtgacgcccgccccctgcccgccgcccgcgtcctgcgtggcgagcacgatcatgtccgacatgaatcccatgcgggatcctccttcgttgtcagcggtcgatcacgtggtcgtggaattcgatgagctcgtagccgcccggatcgtacggttcgaggcttcccggacggacgaaccggccgtccatgccgtgccggcgcgccatgatccggtcgatgcgccgcatgttgcgctccccctccacgctgcgccggcggacgaacaggacgagcgcggcgaccatgcccgcggggatcagcaggtacggccaccattggccggcggcggccggcagcacgcgtacgagcgtggcgagcgccgcgcccgccacggcgcccgccacggcgatgaacaggttcgtgctggacacccattggcgtccgcccaggtgcagttcgtcgacctgggagacgcgctggccgctgaccgacgtcagatcgaacagcatgatcctacagtccgaacacctgggagatgacgttcaacacgatctggaacagcatggcgaccagtccggcggcgaacgggaggatctgggagggcaggatgccgcacaggccgagcgtgatgcccgcgcagcaccatccgaccgtgcctcccccctgcagcgcctgcccgatctgcgtggacggccaccatttgcgcaggacgagcagcacgacgcaggtgatgatcacgaccgcgccgagcaggacgagcagggtcgcgagcgccgcgttgcccgtcacaaagccgcacagtttcgccacgccgtccatgatgggccgcacgatctggggtgcggcggcgacttccacgcttcgcatggcttccatcctttccttccgacgtcatgatgcacgccccctatgcggcatagggggcgtgcatcatgcgaaggaaaagaatcgacgaggacgcgggctggcgcgcccccgacccgaaacgcgacggcgacccggaccgccagttctcgaggcgcgcgttccgcctcaccggcctgcggctgctcagatggcagcggtggatcgcgatcatgctgctcctgatcgtcgcctatctcatgtcgaacccgccggacgcgtcgaagcccgcccccgccgcggacctcgatcccgcgggacgcgtcgaatcatgggcgttgacggagcaatggctcgccaagggcgcgttgggcgcggacgcgcggatcgtcagctggaacggacaatcccacgccaccgtgtcggacgggtccaaggacatgacattgagcgtgaacacgctgatcgtggactccgcggccggctggtggcgggtcaggaccacggtcacgcccgacgggcgcctgtccggctggccgagcgtggaacgactcggcctggcgggcgcggacgacaggggcgatacgggcatgtggaaggacacgctcggacaattgaccgcgtccgacatgctggacacgaccgtgcgcaaatgggcggacgcgttcatgggctccgattcggacatgctgaccgtgctcgtcaacgatccggatccgaacgcctggtatcgggcgcaggggctcggcaaggcggcggcggccaccatcgacgggggcgcctacctggacaaggggaacgtggaccgtaacgaacgcaggtcggaccgggcggcgctcagggtcaccgtcaccgtcgcgcacgcggacgcgggcgacggttcggccgcccaatcccaatactcgtacgatctgctggtcgccgacccggacggcacgccgcgcatcctcgcctggggggctcccggcacgggcgcgaccctcagggagcatgggaaccgggcgcccggcgcgcgccccgcgcacgacgcgtcatccgacacgtccgcgtccgcgggcacggggggcgcggcgaaatgaggggaacgcatacccgggtccggcatgggaggacggacatgacggcggacacgagacgggatcggaccagactgcggcgcgggcgcgtcaggcagcggcatgtcgccctgctcctcctgttcgcgctcgcggcgtcgggcatgggagcatggctcgcgaaccccgcgcccgcgacggcggacacgacggtccgcgcctcgatcggcgtgcagggccgtcccgacccgttccccgccgcggaccgcgaccggacgcgcacggacctgacggtggacggcacatgggatatgggcgaccggccggagggcaagctcaccatcatccacgcggacaatccaacggtccgtgacctgatcaacgggcgcgacgaggatcagactccgaccggattcaatccggaccatgcgaccggcgacacgggcaacgcgtacgcgtacgggcaatgcacatggtgggcgtatgtgcggcgcacgcaactgggattgccggtcggcagccggctgggggatggcggcatgtgggccgattccgccaaggcgctcggctattgggtggatgatactccccgacaaggggatgtgatcgtgttcagcccggcgcaggtcaacaacgcatgggggcacgtcgccatcgtggagaaggtcaacggcgacggttccatcgagatcagcgaagcgaacgtgaacgggcaggtcggcccgttccgacgcgccatcgaggcgaaacagacgcatgcataccagtacatccactattagaagagctcccattgtcctgacggttctcctgccaatcgtcatgctcgccatgccgacgatcccggcatgggcggacgccgccgattcggctccaatccacatggcgagcagtgtcagatcgttcccgaaacacttggttccgcatcgttcgttcagtgaggccgtatcgaccgacgtggacggctcatggggaggcatcgaaaccctggacgtgccgcatgcggaaagccccgaggaacaggccacgcgcatccaggccgaacaggcgcgacagtcggaggccgcgtcacgcgccgagccacgcacaccggccgtatcggcgccgacgacaggtgacaaggagaaacccgcctcggatacggccgccgccctggtctcctacgcgctccaataccagggcgcgccatacgtgtacgggggcaatacgcctgccggctgggattgcagtggtttcacccaatacgtgtacgcgcggttcggcatccaattgccgcacccgtccggcatgcaggccacgatcggcacgcccgttactgacccgcagccgggtgatcttatggcaaacgcggggcatgcgggcatttacatcggcaacggtctgatgatccatgcgatgaacccggtcgacggcacgaaggtcacggccgtcatgcccggcatgggatattatcgcctgctcggctagggcacgctatactgtgtggaaagggtcggcgcgcgttttccggttctctgtccgaacgacgcgcgtcgacccttctttgtcaccggttgttgttggcgtacgggttttgcgtattgcctgatgttacgggcggttgggccgcctgctgtggaggcgcgtattggcctgcgtccggcggcgggatcatgccattgccggtaccgggcacctgaggcggatacgggttcaccggaggcaacggcccccgcgcccgcgcggcggacggtgtccgggtcggaaggatggcccgtatggcgtgttcccgtagtggtttttgtccggtcaagccgcatcctcccgtccgcatgcgggtcccagggggccggcgggcagcacgatcatgaccttgcggccccgatcgtccgccagggcggcccgcatgccccgccgtctcgcctcatgcaggacggacaacgcgagcatgtccggatccgatccgtgcaggacggtgcgttcgccgccgatgatgagcatcgccatcgcgcgtgtctccttcgccttcagtcgatgttgccgagcagtcgggcggcgagccggtagcggcggtccatcccgcgcgccgccgtccccggatccgcctcctcgcccatatgcgcgtccgtgtcctccaaaaggatccgctcccgttccggatcgagcccgtagcggccggcgagcgcacgggaatactgtcccacgccgtcccctccgcgatgcgttcgcccaacgcgtcccattccttctcgtccgccagggcgagcatgttgtcgcgccggacctgctcgttgagctggcgggctttggcgagcatgtaggcggccgcctccctggtgccggagatctccttgccgcgtttctcctcataggcgcggatctcgtccggatgcctccgtcgatgccgttcgaacgcgtcgatcgcgtccacatgcttcttcgacggtttcggctcctgcctcaaccgttcgatctccgcgtccacccaccggtcgagttcgccgaattcgggatcccgttcgcgttgcaggtcgcggcgggcgagcatgaacgcggccgcctcccggtccgacgagatcgggtcgcggcgtcgggcgacgaaagcgcccgcctcgtccgcatgccccgcccgccatcggtcgaacgcggcggcccaccggcgggtcgtgcggtgtctgacgtcccgttcctccagttcgagcagccgaccgtaatgcccctccatgagggagacgaaccgggcgtgcccatcgtccgtcacgggcgtgggcgcggcgacgtcatccggggccgcgcccgtgtttttcgcctcgtatcggccgccttcgggcgtgcccttcggcttgtggctcctgttgttcctgtccacggtcaagacgccgttcccctttccttactggttcttcccggccacacagccggcgaggtaggtgacggtctgctgtttctccctcggagtcatcgtcagaccgtatttcgttttgatgctgacgcgtttcgccatgtagtcgcaccggtacgccttgttgtccggcatccagatgtcgggcgcgcccgtatgctgcgtcaggtatccggatcgtccgttcacgtcgatgccgctccccttcgccatgttcgccggcccgtccgaggcgaggagcacgtccggatcgttcgcgtattcgacgcgtttcgcctgatcccagtcgcgggcgccggacgcccaagcgtcgtacagggacaccacatggtcgatctgcacgtcggcgctcgtcttcacgccccgtctgaacccgatggtcccgcccgtgtacgggtcgcgcagcgtgcccgacacgacccggcatgaggagtccttcctcacgccggtcatgtcacgggcgaggatcgtgtccctcgtggtcgccttcccgcagccggacgaagcccagccgccgaaccgcgtctcacggtcgtagccgcccggcctggcgtccgccgtgcctatccggccggccgcgtccaactgggcccgccatgcggccgcatcccccgtcggggccgtgtccggggttctccccgtgcccttcgcccccgcgtccgtctccccgcccgtatggacgccgaacagggagagcaggcccgacaggcttttggcatccgggttgcgtcccgcatcccccttcttcgattcggccaatgcggccgtggacgcgtccgggttcccgacgcccagcgtctcggacacggtccgccagcctcccgaggagacgagcacgacgacaagcacgcccaccatgaccagggtcgcgatcatggacagcagctgccggaacgggcctccccatcgccacgtcgcatggtcacgcctccgggatgtagacgggggcctgcacctgttcgagcagccagttgatcgcgggcgtcaatccggtcatgttcaggccgagcacgccgagcacgcccatgatcatgatcgcggacaggagcaatgcgaggacgcgcaggcccatggagagcgcggactgggcgcggttgaacgcgaagcccacgaggagcgcgatcatgaggacgatgaagtacacgccgaacgcgcccggcgcggtgacgctcgaccagaatgcgcgccagccggtgacgccgatatcaacaatgctcatggcctccccctatgccccaaaggggcccgtcgtacgggacgacggcccccggggggcgagggacatgatggcggatgccgatggacgggatcggcccgtgacgggcgtggaacgagaggctgcgggcgtgttcgacgaaaacgcgcgcctgcgcggacccgacccgcgggccgcggccggcgatgcatcatgccccgttgcgcacgcatagcctccgcacgcaacgggaaccggaacgggcggaggaaacggcgtaatgaccgtggacaggaacaacaggagccacaagccgaagggcacgcccgaaggcggccgatacgagacgaaaggcggcgccacgggcccggatgacgtgaggccgcccaccacggccgaaaacgcgtccgacatcctcgaccgggcacgggaacgcggcctcgactgggatctgctcgccggacgaagcgagaacgggcgcagcatcaacctggacgcgcggggtcacggcgaccggcgcgtccacgcggaacccgacgggcacggcggctgggacctcgtctaccgggaatggaggaaacccacattacgcgaatacaacgggcccggcatccacccgttcggcgtattcggctggatgtccgaccggatcaacgggaacgcggagacatggatccccatccgtcgcgggcacgccgccaatgacgaccagctgctcgacgccgccgccgactggtgcgggaccgactgaaacgggaagccggccgacggcacgcatagccatcccgcatgagcaaagacacgcacggccggacgcaccggcccgccggactgccgaaaggcgtggccggcacctacgacaggaatcccggcacgaacggcgacgacatcgccccgcccatgcccgtccacgacgatccggacatactgcgccgcgaactggcatccatcccccagcgggacggtccggaatacgacgggctgcgcaccaggctcgcccgcgccgaactgaggcaaatggaatcgaaagagaagcatgccaccgccgccgacatgttccgctcactcagcgaaacaggaggcgggacatggagtccgcgaaacgacgccactcccgttgtcgggttctgccattcaccataccccgaacggagcagggtcgtggcaatgccctccaccaccgatgatttcgcacgactgtccatggaatatctcatggacaatcgcgatctgctgtcgaaagacggcaactatctgggattatggcgcaacccggccgacgacagattatatgtcgacgtctccgtctgcgacatggacgcgcatgacgtccgggacgcatgtgccaaacatgatcagatagccttctgggacatccaattgggtgaagaggtcatcgtgaatccagacgcgcgatcaggacaataaacaaggagaacgacaatggcacgacagcttgaaggcctatacgatccgaagaccggagccgtaggcatggcaaagttcagcgtcatgatgatgcgtaaactcaacgggcacatcaccagccgtcaggaaatcctggacatgcaggacacgctgggccgcgaatggacggaagaggagataaaggagatcctcaaggcgaacgggacgtccgccgacgatccgtcgcagacagccttacgcgcatcgacatgcgggggcacgcatagccgtcccgcatgagcagagacatgcacggccgcggccggaccgccggatagaggacggccgtcctgtccgcgatcgcgcatgcgcccccgcgcgcccgggacgcatagccggaaccatcatgaacgataagcctctcttcgaaatccggcagggcacgacgcccatgctcgtccacacaccacacgcgggccggctcgtccccgacggattcgaccgcacccgcctgacggacgcggaagcattcgaccagacatgcgaacaggtacgagaccggcacgcggacacgctcggcctcatgatcgccgcccggctccacgcaaccatcatgctcgaccacacgacccgcatgtggtgcgacccggaacgataccccgacgaccgggaggagatgaacacggccggcatgggcgccatccccacacgcgacatcgacgggcatcccctctacaagcccggacaggcacccggcatgagggaacgcggacaacggttccgcctcctgtacacgccatggcaccgcatgctgcaagcccaatgccggaccatgctcgacacgtacggacgatgcacgatcatcgacgtccacacccaccccagagaaccacgcccgttcgaaccgcacgccgaccagccgcgcacccagaccatcatcggccacaacaacgatcccgcatcccgggcgatcggggcacgcgccgccgcgctcctcatgggccgcggcctcaccgtcggcgtcaacaccgcacaccggggcgccatcacccccgacggcatacacgacatacggctcgccagcatcatggtcgaaaccagatgggacacggccgccgaccccatggcgcgccatgacatcgccgacgcgatcgcacgcgccctggagggacgcgcatgaaaccacgcatgcaataccggagccgacgcgtccacggcatcctgttcgaacccgaccatgcgagcatgatcatccgcaacaagcccggccgccactacctgatccacggcgacgacacccgtctcatcaccgggttcgacaccccgctggacgcgcccgacaccatgggctacggcatctaccacgaagccgaccggccgaacaccatgtggatacgcgaccggaccggcctacgccgcatccaaggcacgcccgccacgccgctcgaacgcgacgcgccctggaaccgcgtcgccacccgcatccccaaccatcccatccccagcccatacgcataggcgcaccgcatgagcacagacaggaacaaccggagccacaggccgaaaggcctgcccccacgcgtggccggaacattcgaaccggaagcatgcggcggccacgagaccggcatacgaccgcccgaaccacccgaccgcatcgaactcatggaactcgaacgcctcgcccgcaccatgcccgcaccacggcccggcgacatcgcatggcgtttcggcacgcacaccatcccccagcaggccatcgacatgcgctacgggcgcgacgacatacgcctccaacggctcgtcatcctcacccacgcggacgaggacacgcgccgcatgctcgccgcacgcatgcacgaccacgattggattcgcagccacgccacacccctgttcaaagaccgcgcatgcatcatcatccccgaaccggacccctgggatgaacccggacacgaacccggccggccggacacacgccccgtctggccgcaccccatcgacacgcgcatgatcgccgaagactgcgccgcccacctcgacatccgacgctcatacacgcccacgcgcgtcagccgcacggggaacgaaacccacgtcgaatgcgtggacgacacgacccacacgtcccgctcctaccggaccggaacgaacatcgcgcatctccccgacggagcctgcatcgaacatgcggccgacggacgatggcatgtcatccacgacgatccgccgctccccccacgccccgccgacaggccgcacgcacgcgaagacacgcgcccgcacgacccccgacccgacacggaaccggaaccggaaccaaacccggatccgcccgggcgatccgacgaagcggacaggccgcgacgcccggcctccgacccgcgcatgcgccaagcctggatccggttcctcaccggactgttccagggcgtgtccagcatcatccgcgaatccaggcgcgcccactgacagggggcgccatgcgcgccgtccggcgcacgccgcggacgaaaacgaaaaaaaggagacaaagaaaaggaaaaagagaaaaagagcaaaagaggaaaacacgatacgacaccatcccatcagccatcggaaaagaaaaaagacaggacaccgacacccaggaacacacgcgacggacatcacaccacaaaacagcatcacatcaaggggagggaccgttttcccttgcaaaaaaccgggtttcggcatggtttccatgcccggacgccgggatttccccttcatgagggacgcatacccgatccgcaagggacgatggaaggggaaggcgtatgatcaccgtcagtttcgacgacacgacggccgggccggacgacctgccgttgcttcggatcgcggacgcggcgaaccggatccatggcatggacgcgcggcggctgcccggcctgctggaatcatcctggctggactgggcgccgccctcctcgcgtctgcccgacgtgggcatgccgtcgccgcccggccgggacgattggctgtgggcgcgcgggcatgcggggctgctggggttcgacgtgtccgcctacgggtcgggcatgatgttcgcgtccatgctggcgaagcgcgtgggcgtgcgccgggcgggctggtgcgcgctggcgttggcctggtgcgcgcgcatggcccggttggatgcgcgcgcatggacgctggccctgctggagcatgatccggcgcgcgtgcgggccgattcgcttcggcttgtgccggtgggcccgttgtcggggttgtggagcgtgtgggcgtcgcccgcgttcatgccgggcgtgacgggcgtggatgtggcgtgcgcgttgatggattgcgcgcgtgcgggacgctaccggtcggatcatgtggtcgcgccggacggccggacggtccgaatcccggatatggtgtgggatcgcgtggattcgatgggattggcttccgtgttcgccgacacggggttctagaacaggggcgtcatcgtcccctcgtccggcgtgctgttttcccgtctgcatgcgcgggcggcgtggatcatgcgtcccgcgtccgtctgacgagcagccgcttgtacagtcggcgtccgttgaccgtcggatcgtcgagcttgccgagcagcatgaacccgttgcctggcgcccaatgttcgaggaagttcaacgggacgcccatcggcccgtcatgatcgtcgggcatcatgcgcatggagtccacgttgatcgcgtcgtaggcatcatattccggatattcgtcctcatgtccccggtacgtgtgtcccgtgggaggctgggtcttgtcggcgcgtgcggcggcgaggctggtgagccatcggatgctgttgacgccgaccgtgccgtcgggccggatcatgcttcccgtcttcggccggtcgtcgggcagtcggaagaacatgctgcccgagtggatgctcaggccgacgaggcagcgtcccccttgaccatggggaatacgtcgttggcggtggcgaggttcaggttggcgacgatcaggaaatcggtgtccggatgccggcggagcatgcgcatgaaccggatggccttgctgaacggcgggttggtgacgacgatcgcgccgggccggtcgagcaggcgttcgcattcgggcgagtcgaacgagccgtcgccgtccaatgggcgggcggccaggtccgcgatcgaatatcttccctcgcggccgtcgttgtccacatgccattgcatggcgggcgtcccgtcgtcgaacagggtgtcatggtcgggttggaagctcgtgcaggtgagggacgcgatcccgtattcgctcatgtggtcgagcgtccatcggacgaacatgctcatgccgggccggtcattgcagtcgcagatcacatgccggccggccaggtcatggcggtaatgggacagttccctgtcgatcgcgtcgtacgtggtgtagaattcgtcggccttcgccttgcgcgcgccggtcaggtaccggtgatgcttgtgtgttcccatgccccgtcgtatgcgtcaggggcacggttttccggtcggctgtcagacggcgggaccgttgcagtctcacccccggatgccggtcggcggcatgtcatgcggggacgaatacggtttcgacgtgaaccagccgtgcacgccatgacccgtcctgcgctccgatacggacggggccattccaggggtccgcaaaggcgcgggctccggggcggccccttttcctttccgtcctacctctgcgcgcccttgcgcaggttgcagtcacggcacagcatctggcagttgtccggcacggtgtgcccgccacggctccacgggacgatgtggtccgcatgcatgtccgccaggccgaactcgccgccgcacacggcgcaccggtgcccttgggcttcataggcggcgcgctgggtgcgtttgtcgaacgcccggatgctgagtctccgctcgtcgccgtcgagcagataccggtagacgccgctcttgcgggtcacgtcctcgtcggccatcagctcttggacgcgggcctcaagcgcgttcgggtccaggtcggtacggtcccggttcgcatcgtacatgggaccccatggcaggcccttcatctcccgccggtagacggggaacacggcctgcgcccagtcgagcacgctgcggaagtagctccacagcgcctgcgcggtcgggtcgtgctggtgtgtgcccatgtagtcctcgacgctcgcgccgtgccgtgcggccgcccagccgagcacggtggccagatagtcctgccggatggccgagcccttcagccagtcgccgcccacctggaccgcggggccgcccggcttgctgaagcgggcgcgggcgtccgcgacccatgggcccgcgtatacggcgttcagcagctcctggtcgttcagctggacgccggcgatgttgacgatgcggaaccagtcgagcttctccgactcggtgccggagcatacgtacacggtcagcgggtagccgaggatacgctccttgacgtcgcggggcaggttgaagaagaaccgcccgtcgaggctgtactgtccggccacgtatgagcagacgctgatggtgcgctgctggccgtccatgacctcgtagcgtggccgcgcgtcgggtccccggtccacccagtacatgacgttcagcgggagccccttgagtatggtgcgcaccacctcgtcgcgccggtcgtcccggtagacgaactcgcgctggtagggcgggcgcacgtccaggtcgccgccgtaggcggtcacgcccccgaccgcattgtccgtgtagccttggctcaggtcgcgcaccgcgacggtgatgggttcgacgttcaattggatgcctccttgcggcggatgaggattcgcctgtatgtctcctggccgtgtatgcgcccgttcatcagaccgggcgcacggcgggtcatgttcggatagtcgcggtctatcggctcggtctgcggcgtatggtgatgcgggcgtacttcgatttgccgttgaccatcgtgtccttcggattgttgaacagcccggctatcgccgtcgccggacgagtatgcgaaagtacggttgtactctctctctctttctcgggtgaagaccaggtcgcgtccgtcatcgcccttgcggaacgcgacgatgtcgaattggtccgggttgtacttgtccatgaacgtgatgggcacgcccatcacgccgtagtaatcctcggggatgtcggccaccttcgacacctcgatggcgtcgtggttgtcgtacttcgggtagtcggtctcatggcccttgtaccggcgatagagcagcaggtcctcgtggcgctttttgatgtccaggttggtgtaccaacggcacaggccgttgacttgtttggtggtcccctcgccggggatggtgaagtcggacggcgaggtgaagcccaaccagaccttgtcatcgcgtaggagcggaaagatctccttgtaggtaatggcgttcttgttgcccagtaccacgaatttcttgccatgttccacgagcgtcgccacatactcgcggaacaggctgaacggcggattggtcacgacgatgtcggcctcgtcgagcagttcgaggcattcacggctgcggaagtccccggctccgtattcgccgtccccgtggagctcggccacctcgttgcccggggcgttcaacagcactttgacgtcctccatgtcgaagccgccgtcaccggtcgtatcctccacgtgggtgacgatggccttgtaggcgtgacgcgacggcgcgtccggttcgtcgccgaacagcgacggctggtactcggccccggcgataggcgagccgcagtagctcgtcgccatcagcttcttcagtcccagatggttgaagttcagggcgaagtacctgaagaagttcgactcgtaggggtcgtcgcagttgcaaagcacggtcctgcctttgaaatgctccgagtaatgccttagctcgttctcgatgtccggcattcgtgtgtagaactcgtcgttcttggccttcttggcggctgatagttggttgttgcccataccgggcgctatgcgtcgcggcgaaaggaaaggtgccgccgaagcctttggcggcacggcccgtcctgggcggatacgccgacgggccgccgccaataagccggaagtcccgcaccgtttgccgaacatgacaggaggccgcctcatgggataatcccgtggggcggcctccttacgactattcgacgcgttccaccttatcgtcgaacagatggaacccatggcgtgcggcggcgacgccctgcggtgtcctgtcggccaaacggcgtaggtcgctgtcgtcgtacgctttgatggtcagcgtgcaatggtagcctccctcgcccttggtcaggtccaggtcggggtcggcgagaagcccctcgcggtcgggcttgcttccttggggatagcacagtttgaaacggacggtccaatcggcgggctcgccgatctcatactcgtccgactttgcgccgggaatcctcgcggtgatgtccgcagcctgacggttcgcccgttcgatgcggtccgccttgccctgatgacggtcgagccaaagattcaccgcatgggacacgtccgccccttcggatcgggtgcagtcgcagtcgacgtggacgcgaagcgcatcctcatccccgtcatatccggccgtgacgatcacagccttgtggcagatgggacattcgcgccctgcatataggtcgcggaaccgctcgaacgattcgacgcaacgattccacctccaggcgcgcccgtacaacaattcctcatcgtatccatgcaggccggaacatgcggtcccgccccgtatagcaggcagcagccggaacaggatccggtattcgtggaacggagacgaccatgacggcagacaggaacaacaggagccacaggccgaagggcctgccccagggggtggcgggcacgttcgacacgacggccgtgacggcggggatcgacgacgtcgtcccgccgtcggccggcggacgtcggctggacgatgcgatgctcacagccgaaacatacatcatcatggatccggatgtagccgactgcgcgggatacgccgccagacgattgggtgagctcatcgcccgtccggcgaaaccgggcgaaaccgatgacatgccgttgatcattgaaaacctgcgatacgatccgcaggccccgggcggctcccatgccgactatatcgccgaccatatagaggccgcctatgacggcataccggtcaaagcgcctgaccgtacgcaattggaacaggaaacccgacagcatatcctcgagaccgcgttggatccgaaccgggagctccgcaagctcggattggagcccgtacggccagacgaacacacgaacgcatacgcgggaccgcagccggaggattgggtaagcgactacgacgaggagaccgccgaacgccgccacgaagccgcatggaaaggcacccggaccaaacaggcccgatatgccgcggcgacggagaaacacctgtcaccgttgaacgatgacatgcgcgacctgtacaagacgaacgtcgaccgtggactgatcaacggcagcgcgttcgatgacaggatggcgttcgccgacacgctgcacgaattgcaggaggatggctggaacccgcaggcggggcgcgaataccggaaatccaaggagttcaggaaactggagaaacaactgctggacgggcggaaaccgacccgacgataccggcagctgcgcgacgcgttgtgcgacgacgaacacgggtaccgggcgttcatggccgcggatcctgacgtgttcgacccggacgagagaatcgtgaagccgttcgccggactcggccccgacgtcggccaggccgccatgctgcgcctggccgccaaacaccggggcgtcaccggggcgctcgccctggcacgctgggatccgggcatcgaatacgtgacggcggacgcgaagacccacacgttccgcatggagcatgaccggccgggaatcgggtattacagcgacggctccacctatccgatcgggcacacggtcatcacggcgaacgggatcaaacccgcgagcgtgatgagctggatacacaacgagaagccgggcacgccggaatgggaggcgcggacccgcacccggttcgaggagtcgaacggcggcgaatggaagcccgccgaaaccgacgtaatctaatggggacgcatgcggaatgccgtaggattggaatcgaaggaggacgtgatggaagaagaatccgttcggctcgctatccggctcaaagatgattcggtgtggaagatttccaatctttccggcaccgtcataccctacaaggcagccgccggcatcgtccaccacggaaagggtcttgcaggccgtcccgtcgaggagacggtgttgttgtaccgtctgtcgaacgcattggagacgaccatcgccaatgcagatcatccacttgatgaagacctgttcgattgcttcaaggagcagttgggggcttcgaaggacattcccctgccggatcacaccaatccgacggaggaaaacgccacggacatgtttatggagctttggaatcaggataggatcctcgccgccgtgtgcgcgaaccatcttctcgtcgaaggcggcatcggcctgttcggaacctaccccgaccagcttccggcattggaatccgccataggggattccaaggaagccgccatctcctatattcacgacaatgcggtagagcttcttcccggaggcctcacccggaacaggatgccacaatgaccatggatgcgaacaaccggagtcatcgtcccgccggactgccacaaggcgtggccggcacgttcgatacgaccgtatccggagtggatgatgccgatgtcgcccctcccatgggggcgggaaccgtttccaatgcggaggcatgcgtcaatctggcgaaacgccgcaccatcgacctgctgtggaagaccgcgagcatcgaggtcaggggtctcacgttccccgatacgcgcgacgtgttcaagggcatcacgcccggggatgcgagggccagggatgtgatggtgctgaacaatctgaagcacgcctggcagttccttttcgacaacacggattggccggtcgactggcagtatctttccgaatacaaccggcttgtaggtgacgggctggagccctccccggcaggctgaggaacgacatggtcaccatcggaggcaccagatatgttccccctgttccctcgtatgatggggtcagggatcaaatcggaaaggatctcgggcttgacgatccggaggatagggcgttgaacctgttcgcatccatcagccggggccaatggttcagcaacggcaacaagcggacttcggcgatggccgccaaccattgcctcatccatgacggggtcggcatattcgcattgcctccggaacggatggatgacgagttcagggacaggctcatcggcttttacgaaagcgatgatcgcggaccgttcatcgactggctgaaataccatgcggtcggacgtctggtggacaatgggctgacttcggcgcagaaaaacggggatgatccgatccacgacgatatgtgatattcgacaatgacggggacgcatgcgggatgccataaaggatttctccgcatgcaaggagcccgtcatggccgaaagaatcaccacactgttacaggatcgtctcccggtggattcggaccgtcgtctgaaggtgccggccatccggccggaggacgacatggtcgccgtccgccgccgtctgggccgctacctgtacgattcattggagaaggacacggaccgcaaggcggtggccaaggccaccgcgaacgcgatctggccgggctgcacgcccatcgaccgcgacacggacgcggaggtcgcgcgcgacctgaggcgcacggaatcaaagaccggcagccccgcgatcgcattgcggcatccggcggggcggattctcatcatcgggctcggcccgcacaaacccatgctggcgagaatcgactacaggtaccgtctctcgaagcgcaccgtggacacggtgagcctgccgagcctgctggccgcccgcatgatcatggagcatatggcgaacccggatccggaggggccgatccgcgacctgctgaccgacgaccggcacacatggcagtatttccgtacgaacatggatcgccggttcgaaggcgtggacgggctcgtcgtctcctgcaacacccgcggcgtgagcctccccgacccgcccgaggcgggcgatgcgaaggcgttgctggcatggacggtcggggcgggactgatcggattggactgcgatgacgaacgcgcgaaaaggctgctggcggaacgcctcgaatgggtgcggtggacggcggagctgcggcttgcggccgagaccatcctgcgcgtcgaatcggattggcgcatgaaccgggatctcgcccgccgcacggaggccggagtatcggcgaccgtgttcgaggacaagaaacaccgtgatccgaagcacgacaaggccgggcaggccagcccgttcgccatggacttcgaccggatcgaggtcgaggacgacgtggacctcgccctgttcgcccgactgggagccgaatgggaggcgttgaagcccgccgtccccatgtccgggacgcgcgccgcattgcgcttccgctacacgggacgccaccgggcggacggcgtctaccacaccggtttgcgcgcgatcgcgatagacccgcgccaccccgaatcgttcggccacgagctcatgcatcacctcgaccacacgtggggcggaaccgacctgagcctcgacccgctgttccgccccctgctcgaccactatcgtgagaccgtggacacggcgcgcatgaagggcgcgaacccggaccggtggctcgcccccgcggaggcgttcgcaagggcgggcgagatttggctgcacatgcgactcgacggcgccgaaaacagtctgctctccgacggcgggcattacgaaacggattgggcgtacgccccctaccggggccggtggaatgagatcgggaccgtgttcgaccggctgttcgcctagaacacggcgtcgcgtatccgccatacgccgcccgtcgcatacgcgacatcccgggtgacgcacgtgacgccggccggcaccggaccgcaacggtcggccggccggcgttccgcatggcccggaccgtgaccgcgcaaaaaacgtcggacggcgcgcactccaggatttcacgccctcccgtaagcgtccgggcccggcatagccggcacgcatgatcagattcgaatacgaataccccgtccgcgtgaagacccaggcaggcgacagcgtcgaattcgacccggcgaacaacggcggccaccgggcgctcctcgaccggcagatagcgaaatggcaggccgggtatccggaggccaaggccgcccgcctcgaattcatcgaccgggaccggcatgtcgccgtcctcgtcgaccggcagtcgtccagcgtcgacatgcgcgacgattccagcctcgaagtcaatctgagcgccgaacattcgaaacccagcaagggcgccgaggtgcaggccgtatacgagacgaaataccccggataccggctcaccgtgttccacccgtacgaaggcaaggcgctcctcgaacggctcacggacgcgcaggccacggcccgcgcccagatcgccaccgaactcggcctgcacgactgggatctcagggtcacgcctttggaggacggcggatggaaggtcctcctcgacgagggcatcacctaccagccgtccaaaatggacacgcgcatggagaaggcctgcctgaccgtcggccggctcggctggtggtttgacgccgaccccgacaccggcgtcatcgagatccatcccggcgagccgcccaccttccccaaactcgtccccttcccgttcgaccggatcggcgacccgaccgtccgcgacaagaccccgttcggcatccgactggcccgccccggcgagaccggcgaacccgcgttcgtcgactggacccaatccctcggcctccttatagccggattgtcaggtggcggcaaggctcttcccttggatgcgcgtatccccgtgcccgtctccgaacgcttccccgccggctgggctaggaaccgggacctcaaagaaggcgatccggtgtacgggcgcgacgggcggatcatccccatcaaggacttcagcgacgtggaggagctgcccatctaccgtctgaccctgtccgatggccagattctggaatgcgcggacaaccatctgtggaccgtatcggattccgtcatgcgccaggccatgtccgacgaacgaggccgggagcgacgcgaacagaccatccggctcgtgaatcgtttgcgtgacgaagcggccacggtcggggatggcgtgagagccaaccgacgccatatcgccatcgaccacgggctgccccctaatgtgacccagaactgcgcggaacggcatgatctggtcgggtcggatggcctgtgcgacgaggcggaactgctgcacgccatcgccgacgaacgcgaatcctacgtcatgcccggcggcgtatgggcgaacaccgtcgaaacgatcctcactgcacgcgagatatcggagaatccgaaacctcacggcaaatgctggggtatccgccttgccaatcccatcgagaatccggacgccaacctgccgctcggcccgtatttcctcggcacctggcttggcgacggcatctcccgtgccggggccatctgtctcaacgatgacgacgaaccgcatatgcaacccgacattctctccagtctgggtggttcgatccgtcgcggaaaagttgaacacggggcgcatacctggttctatgacatggatgacgggcgcatcctcgtaaccgaactcaaaaggctcggcctgtacatggacaagcacatccccgccgtctatctgcgcgcctccaagagccagcgcctcgccctgctccaggggctcatggatacggacggttcggtttccagtcgcggatcatgcgaactgtgcttcaccaatcagcggcttgccgaaaccgcattggagctcatccgctccctgggcatcgccgccggcatgcactccggacgggcgggctatacaaaagacggcgaacgtgtggaggccggcatccggtatcggatccgtttcaccacctccaaacccgtgttccgcttgccccgcaaactggcacggctcaagaccgacacccgttccacgcaggattggctgtacatcacgtcctgcgagccgacggggcgcacggagccggtccgctgcctgaacgtggcgaccgacgaccacctgttcctcatgggcgggttcgtgcccacgcataacagcgtcaccatcaatgacgtgaccacgttgggcatcggcacgggcgcggaactgtacgtgatcgaccattccacgaaggccaccgactactactggtgccggccgtggatcgcggaccggggctggggcgcggattcgctgctccagaccgccggactgttgaaatggctgctcgacgacatcgaggacggcggcgagcgcgccagggcgtggaagagccacggctggcagaactggtacgacgacctgtcagacgaggacaagagacgatacccgtaccggctgatcgtcgtggacgagctgtcccagctgacggtcggcgcgaaggatgcgaccagcctgccgaagaacccgctgccgccggtcatggagaagatgttcgaacagcaggtgaaggcgctcatcctgtccaccctgatccgcatccttcagatcggccgagcctatggctaccgggtggtggtcgccacccagatcgcgtcgtcgacgacgggcatgccgcccgcgttgcgcggcaacctgggcaacaaggtcatcatgggcgcgaaggtcaacgacgcgcagaagaacctgatcttcaacatcgcgaaggacgtgcccgacattccggcgaacgtgatcgacgagggcgtgtccaagggcgcgggcctgagcgagatggaggggcagccgccctacgatttcaagagctcgttccccatgcttgggcatcatgcgggcgtggcggcgctcggcaaggctttggccgaacggatcggcctgcccgacgggatcggcatggacgaatacctcgactccctggacaaggacacgccttcgaacccggagttcgaacaacgggtcatggaacgcatccggttccccgaggcggaatcatatctgcgtttcccgttcctgcaggccatcaaggacaagtgggatgaaagcctcgacgagtacgggggcggcccggccgatgccggatccgggggaacggggatgacggcaccgcacccgccggccgaccggtcgcaccggccgcctccggcccggaaccgtccggcccgctcatggacgcggccgaactggcgcgcatcatgcgccggggctgatccggatcccggtctccgggcccatcctgttccaatcggccagccaaacgacgatccgatcatcatcatgcatgtaccaggccggccgttcagaagcgcaaaccgaccgtatcgcactgatacgggactcccatgcctcaggcatgggaggacgtcaacgtatcggcttccgatgctagcgcatgcgccttgtccccggccggtggtcatccatgcgccggataagcgtcccgtggcgtcccgtcgtcggcgatgctcgcccaatggtatccgtaggcgacgtgatccgggtcgcccgccacatgcccgatgttggtggccgacccggcgggcagtcccaatgcgactgcggcggcgcgcaacgacgggtatatggttcccgtctccacgcagcggatggcgtgccggttgcctttcggcgcggatcccgccctcagccgggccaggagcgccggatcagccgaggccagccgggccagccattccgggctcgcccaatggaagccgccggcgcggcgatccggattgtctcgcacatggttgatcaggtcgcgcatgccgggcgtgttccttgtccggcccgtcagggccagggtttcggcggcgcgcatcgcgtccccgtattcgacgcccgtctccacgcatacgaccgggccgcgcagcatggtctcgcgcatcgtcctgcgccaggcggcgagcaggccgggatgccggcggcgtatccgcccgtacgtgacgccgtcgacccagtggacgcccccgttccgcctgtccagccggttgcgcttctgcaaccgggatacgggcatgccatgcgcttcggcggccagcgtcatcgtgtcgtacgcctcccccgtttcggcgcacacccacagtcccctgagccgctccccctccacaagcccccgcagccggcggcggccttgttcgcccagcgcatcccagcgtccggcggaaatccagtgcgcgccgccggcgctgcgacgccatggctgcgcgcttctggccgccacgctgatcctgcccacggccgccccggtctcatcatgggcggccttcagcgtgtcgaaccgtctgccgtcctcgatgcgcaccacgccggacaaccgtcgcggctcgaactcgaatcccgcggcctccagacgacgggtctgccccgcgtcgagccggccatgccgccacgcgtcgcggatccgcgccgcatacgcctggtatcgtctggcttcaacgcttgtcgccacggcgttcccccaatcgtcggatcacgtattcgatcttcccgtccatgctcatgcccagcatgtcctccagacgggaggcgaggatgcggatgtcggccgtctcgtccacgatccgcatgcccgccagcgggtttccggcatccatatccgcgccgccggccgcatccgcggggttccatgggcgagcagccatcccagccccgaataattgtccgatatgtcgaacacgaggggcgtccggttgcccgtcgcgtccaggacgcgccccaactgctggaggtacacgtgcgggcttgtggtggcgcgcagcatgacgatcgcgtccacgccgtccagatgcacgccctcgttgagcatgtccacgcagtacaggatcttccgccccggcgccgaatccgcctcgaacgcgcggatcgcgccgtcgggccgcccgtaccggctgtggatcgcgtaatccctcgcatccgggccgaaccattcgcgggcatgggcgcgcgccccctccagccgggtcaggtcggtgcagaacacgatgacgtgcgcgtccggcggcaggcggcgggcgaacatggcgtcgacgcctgccatgcccgtcacggcgcggcgcagccgttcgaacaggcggcgcgcgtccggcgtcccgcaccgttccacgcggggcggacgcgtccgatgagcgcatccccctcgtatccggcgatgacgtattcggggacgggcagtatccgtcgcgcccatgcctcgctcaatgtcatgcgggaggcgacccgcccgtcgaacagctcgtcggtcatgtccctggccccgtccccgtaccgtctgggcgtggccgacagtccgacgatcctcgccccggggttcgcgtccaggagacggcgcacccccgcgccccaatggcgggccccgcaatgatggtattcgtcgaggatgatcaggtccgcatgcggcatggggttcccgcggcgcgtgccgatcatcagcttcgcgtaggtgaggaccgtcacccggtcggcccggaagcccgggatgtcccgttccaggcatggcagccggccgtcggtgatggtccttgacggagtgcaccagatgacgtcccatgacgggcgggcggcgatgagcgcggcggcgacgtaggatttgccggtcccggtcggctggatgacggccgccctgtccgtcatgtcgagcatggcctccagtccgcgcaatgcggtccgattatgcgggagcagtccgttcatgccgtcgggtatgcgttcccctcgcgtttctcgaacgtttcgagcatggcgggcacgccttccatggggaacgtggccgtcgtgccgaggatgacgcccttcaacaggttcgcggccacatgctccgcctcccggacggctttcgtgttcgaggcgggacgccggtgcgcggccgcgtactcgcgcatgacgggcagttggcgcgccagctcgtcgtcatgcatgccgtgcgcgcggatgcgccgcaattccgcgaggtcgtcgtccggcaggcggcacggccatggggcggacgggtccgcgcagacgaggccggcggcgagcatgagccgcatcgattccgcctgcattttccgccgccgccgggcgtccatgtcccgttccagcagatgcaggttcgaggcgacgttgcccaacgccatgtccacggtccgccgtgtcgccagaccggccgccaggggcttcagaccgtccggcagccccgcgtcgaggagcaggcacccgtccggcagggacagggcctcgagcatgttcggggatcccttggcgacgcctttcaggaacgcgacgggcgtcatgatggtgatgtcgggatcgtgcagcccgatcgtcgcgtccgcgcgatccaggaggatgtcctccggatccggcgcgatgacgatcctcaggtcgatgtcgctgtccggacgggcgagcccgtgcgcgtggctgccgcccacccatgcggcgagcacgcgacgggccatgtggggtgcgagcgcctgttcgaaacggttcatcgttcgattcccaacgattcgaggtagtcgtcgccgagccgggcggcctgccggccttcgcggctgtggttgatgcggtcggccacgtcgcacgcctcgcggacgagaccggcgaacaggcgggcgtcgccggcgtcgcgggcgccgatgccggtccatgcgatgcgggccttgccgtattccatgcggatggtcacgcaggccggttcgccgaggcgcgtggcgtccgtcccgttgtcgatccggtatgggcgttccgggtcgtcgagacggtggacggtgaagtgttctgtggagaatgcgatgcgatcgttcatggagggatgcatgcgtccccgcggacgggttccgtcgggctttacattattgtaaagccccggccccggactttacaatattgtatagttttccggcccgttttgtatgcgtgtatgcatctgtatgcatccggggatgcatacagaaaaagcccggaaaaagcccgaaaacccttatatataaagggaaaaacagaattcctttctcttgtatgcattgtatgcatcaatataaggggtttcttccctttttcccgaatcccctataagggaacgatgcatacaatgcatacacgcccccggaccatccccggaacgtcggaaacaagccgaaacgggaagagaagatgtatgcatccccggatgcatacggatgcatacacgcgccccggaatgcatacacggcccggggccggcgaccgccggccaccgttttgccgtgagggtgccccgcctttaggcgtggggaggacgtcaagcgatcctccgatccgtttcgccgggctccccgggggttcgcgatgctgtggagccgcatgcgcgggaccgtgtatgcattccggttcgcgtgtatgcatttgtatgcatccggggatgcatacagaaaaagcccggaaaaagcccgaaaacccttatatataaagggaaaaacagaattcctttctcttgtatgcattgtatgcatcaatataaggggtttccttcctttttctcgaatcctctataagggaatgatgcatacaatgcatacacgcccccggaccatccccggaacgttggaaccaagccgaaacgggaagagaagatgtatgcatccccggatgcatacggatgcatacaggccggccggaatgcatacacggcccggggccggcgaccgccggccaccgttttgccgtgagggtgccccgcctttaggcgtggggaggacgtcaagcgatcctccgatccgtttcgccgggctccccgggggttcgcgatgctgtggagccgcatgcgcgggaccgtgtatgcattccggttcgcgtgtatgcatttgtatgcatccggggatgcatacagaaaaagcccggaaaaagcccgaaaacccttatatataaagggaaaaacagaattcctttctcttgtatgcattgtatgcatcaatataaggggtttcttccctttttcccgaatcctctataagggaatgatgcatacaatgcatacacgcccccggaccatccccggaacgtcggaaacaagccgaaacggaaagaaaagatgtatgcatcccctgatgcatacggatgcatacagcccgcccggaatgcatacgcgccccggggccggcatagccgcgccgcatgaacggcttgagaccatacgcggtccggttcacggtgtccgcctccctgtggatgacgaccaccggcgacgaggtgtgttttagcaagttggcgtccgctttgtgagcggtgtttttccgcagtgtaggcagcgggttttccgcagggtgtgcggtatcggccgctgcctgtctgcgttgtgttggttatttggtcatgagggcgtgttcgcttcggtaggagcggccctcgaatctgatgagccgtccgtggtggacggtgcggtcgatgagggcggcggccatgttcttgtcgccgagcacgcgtccccatccgctgaattcgatgttggtggtgtagatgatgctccttgtctcgtaggaatcggaaatgatctggaagaggagcctgctgccctcctcgtctatgggcaggtagccgaactcgtcgatgatgagaagtcgggccttgccgatgctcgcgagttcccggtcgagccggttctcctgctgggcgcggcgcagacgcatgagcagtccggtcgcggtgaagaagcgcaccgggacgccccgctcgcaggcgagccgtccgatcgcgatggccaggtggctcttgccggtgccgacgggcccgtagagcacgaggtcctcgcatccggcgacgaagtcgaggttctcgagctgcgcgcgcccccagtcggcgggcatcttcaggttggtccagtcatagccgtcgagggtcttgtcggcggggaagccggcctgtttgagcaggcgcaggcgtttggatcgctcgcgcgagtcgagttcggccgtgaaccatcgttcgatgaagtcgagctggttgggcgtggcctcggcgagcgtgcccgcgagcacgctgcgtgtcagggtcaggctgcggctcatcttcaggatcctctcgctcttctcggtcgtggacgcgcgacggcggcgggtctccgggatcaccggatcgggtctgacgctcaccgttcttcccctccgtcgtccgtgccggtgatgaaccggtcgtagccgctcaggtcgggctcctcgatcccgccggggtattcccactcgccgtcgcgcatgcgcaacgcgataggggtgagcgagtccgcgtgcaggcccatgtccctgttcgagcgcaggatctcgccgcacgcctgcatcgcgggatcgaacccggccgcccggcacgcgtccccgatcgctttgaggctctccctcaacgtcttttcgtccatggaatcaagccacgcgcgtatatcgtcgggcacgtccgggcggatcgagctttcccgccacgcgcggggtttgaccgcgagccggggaagcacgagcgcgggatcctccacattgcgcgaccgtccgtactgtctgggatactccgcgaagagctcgccggtggcgggcgaggtgagcgtgaccgtgtcccaccggatcgcggccaataccctggaacgcgccgaatcggggccggcgaggtaccggttcgagtcgatgtcgaccagcccgtacttgtcggccgtccggctttcccagcgaaccgggtcgaacgccgtggacggcaacggcatcaacgcggccctctcctcgtcgaacacctcggccacgggcacgtccagcaacctcgggcaatacgagtccctggcgagcccgtcgcaccgctccagcaggagacggctcaactgcccatacgattccgcgcgcatgggcggcaccatgagattgcgccgcaaaaacccgaccgcgttctccacgctgcccttctcgttgcccgaatacgggttgcagaaccggacctcgagccggtaatgcgccacgaacgcggagaacaccccggtcaacgcgacctcgcccttcgcgttgcgccggccggcaccggtcgcgttgtccatcacgatcacgggaggaacacccccgatatgctcgaacacgagcatcaggccatggcacagacactccgcgttctcgcccggcaacgccacgcacaaccgcatgttcgaatacggcaacgagaccaccaggcaatgcacgtccgccatctcgccagcgatccgggcccgggccacgccgaaatcgacctgcatgctgcccgccgcccactcgagccgcacgtacccctcgcgatccggcacgccgcggttcgcctcgcgccaccggtgcacgtaacgcatcgtggtcgaatactcgccgtcgtaatccgtctccgccagcagacggtcgtgcacgcgcctgatcgtgtgccgctgcttcctgggcagcagacgatcggcctccagccactcgtccaccagatgcgcgtacgggtcgatcttcgacccgtacctgcgatccgccttcggcttgggcgagcaatcctccatatccgcgtacttcgcgaccgtcccgcgatccacgtgaagacgccgcgctatctgcgcgcgcgacattccctgccggtcgagtctcctgatatcttgcacaatgggcatcggtatcgccatgttcctttccttcccgagcgccggccggcggcaaccggccgaatcaaaaccgattggcaactcgggaatatacaggcggcggcaccgatgcctatcacatcaccgggaaacgatgacgacaccggggaaaaccatcagcccacactacggaaaaacactgccgaacctgtcgaacaaacattgaagcaaaacaacgaggacgtgatcgaacggaaacggcggcggggacgcctgcgcgcctacggacggcaggtgtggcgggaggcgaagaccgcgggcgcgccccgggtcaaccggtacatgatgctcgtcaccgtgggggacgcccggaaagccccgtgctcgccgccgagaccctgaagcccctgatcgacgcgggcacggacgaggccctgtggccggacgacgacccgtaccatcgcgtgatgacctgctatctgagggatccccgccccctgccgggcggccgggcggaactgttcatctgggtgatcccattggcccccggcgtcgacccgctggcccggctgctggcccgcgtgcccggctccaaagcgaccctggcgcgcgccacgttcggcgaggattcgtggctgaccagcaacatgcgcatgacggcccgggagcgcaaggcgatgcagacgcgtgccatgcgcgcctgccaaggcgcatggcacgcgagcccgggcgcctgctgcggcgtcgtctgccaggtccgctacccggatccgagacgcgaatacaagggcgatccggacaacgtggcggagacggcgaccgccatgtggggcgtcggcgtcatgcagggcctcctgcccgccagcccgggcgtcttctgcttcatgctcgccgacggggaatccgaaccgaagcaccatgatctcgacatgctcgcgttcaccgtgccgtccgacgcggactggccccgcctgctgctcggggacgcataggagcatggcgaaaacgcaaccgaccggagggaggccgtcatggtcatggacaggcataacaggagccacaagccgaagggcacgcccgacggcggccgatacgaggcgaaaaacggttcggccgggtcggatgacgtggccgaaccgtcgggggcggacccgtcggcccgcatcatcggctcgcacgaacccctcaccggggatgacatcgagtacattcgcaccgtctccggccccgacacgatcggcctgatggccgcccaccggcccgaggtggacgcgtgcctcgcgtcgaatccgaacctcacggaggatgacgtggacaggctcgtattccggcagaagtcgaattcggcacgcgcggacacggtgtccggcgcctgcatgcgccccgtcatgtcggacgcgttccgcgaccgctgcgtgggctggatgcgcgaccagaccccgcgtatcaggcacgcggccatcgacgcgataggctccaacccgcacgcggctcccgaactcgtcaaggaaagcctgtgggccgacccgtgcatgcggcaggccgtccgcgtggccgcgaacccggcggcggacgattcgacgctcgccctcgccgtcaacatccacccgcgcgacagcagcgtgttcgcgggcaaggtgctccgccatccgcattgcggccccgacgcgctgcacgccatcgacgagaggaccacggacccgtggatccgagaacgcgtgtggagccatccgcgcatggacatggcgacgctcgccgactggaagagccacgtgtcctacgaccggtacgaggccgcgttcggcgcggccatgagcccgaagctcgacttcgcgctcgcctcaagccttgcatccttgaacaatccggatgtggacaggcggctcgcctacaatccgaggacgccgtcggagctgctgggctcgttcgccggacgcggcgaccgtcagaccgacctgaacctggccggcaatccgagcctgccgttggcgagcctcaaggtgctgcgcgaccggtatccggacgattccgacatgcatgccatactggccggcaatccggtcctgagcggcctgcgctgaaaaggaaaggaaaaccatcatggtcatggacaggaacaacaggagccacaggccgaagggaacgcccgacggcggccggtacgagccgaagaacgccgccggcgtatcgggggatgtggccgcgccccggaacacgccggacccgcatgatctggccgcgatcttcgaccggccggacctggcccgccaaatcgacttcacgctcgcggacggcagccatgtcaacgggtacgcgatggactgcgaacgcctcccccgcgagcatgtgcccgccgggtggcatgtgtacgcgatcatggaaagcgaatccgacgacgacgatctggacatcatgaccatcagggagaacacgtgggtgaatcatcgcatggatttcgccaccgaccgggacctgaccggcgtcatcgacgatccctcgttggagaacgtggcggactgggggttcaccgaccggacgcttgccgacgatctcgcctgatgtcaacgaccgcaatgacgagcattgcggcttgtccctgtccggtagtgccaatggaaaccgcgacggccccgcattccggaagggaggcggggccgtcgcgcatgcattgcggccgtgaagacgcgccccggactatccgacctcatcccccatgatcatgtcgaagaacgcgtccggatcgtccacgacccacacgtggaagccgcgtgtttcgagtttcgcgaacatggcgctctggctggccctgggctttcctcccggccgtttcagttccacgagatacagcctgccgccgggcatgaacaggagacggtcgggcacgcccaaccgtccgggcgacacccatttcagggacagtcccccatgccgtctcgccagcatgttgaaccggcgttccaccgtgttctccctcaccgccgccatccgaaccccctccgcgcgtccggcccgtccggctcgacggggagcatgcggatcaggcgcgcccgttccgggaagccggccgcctccaggacgcgcgcatccaagtccgtgccgagcacgcgcagcgtctccgcgtccagatcggtccgggtcgcgagcacgcggcgcacgcgcgcatcccggtcatgggcgagcgtggacatcagcgccgcgtccaggccgggccgggcggccacgcgggcgcgcacgcaggccgccggatcatccgccagacgttccacgacacggtcgggcagcggcatgcccgccgcatgcgcgcgcaccaccggattcgggtcgaacgcggcccgacgcgcgtcccccgacccgtccagcagggccaggaccctgtcatgccaatcatccatgccccatcgtatgcgttgcgcggttgcgcatagacgcattccgacgcgtgcggggccggttccaggcccgcacgacgattcggaaaaggagaaccatggacaaacgaatcagcaggaccctggccgcgacgctcgccgcggccaccctggccggcgggacggccgcacccgtctgggccgaccagccgacggcgggcggggcggcgacccgcaccggacagcgcgcgcccatcgccggcctggccggcgtgacggcccggtggagggacgcgcaaggcggcaccggccccgtcacgggattcgatccggccaacgggaggggaggcgacgtgcccgccggcacgaccgcggtcacccttgacggcctgcccgacggatggacccaatccgtctccaaggacgatccgctgaccgtcaccctcgccgcgcccgatcaggcccagtcccgcacctacacgttccgcgccgtgtccgccgccgaccggttcagggaatcattgaagaaggccgaaacgatccgcgacgacagggacgcgacggacgcgtacgaccgggcgagcctcgacgcgctcggcaaggcgatcggcgacgcggggaaactggacgcggacaccgccggcgaccagatgctcgccaaggccgcggacggcctcgaccaggcggtcgcgggcctgcgcgtcgtcaactggacgttccacggccagaccctcgcctacgacgtcgcgtcgaagacgtggacgcccgccaccccgttgggccaggcgcccggcacggacgagaagatcacgggcggcagcacgtccaaccggatcgaagtgtcgaccacggcctccgcacccgacgtcaggaacacgctggccggcgtcaccgaaacggatcaggtcctgaccgcgtcccacggcggcgaatcgttccgcatccccatacgcatcgtccagggcacggagatcacgttgaaggacgggacccgtttcaccggttcggagaacggctccgaatggaccgtcaccgacaccggccaccggctcgacaaggacaacatgcccgacacggacaaggtggaactgtccgacggatcgacgctccccgtcgcctggggcaaggccacgctcgacccgtcgggcgcggccggccccgtatggaccatgagcgggaaggccacgcgcacgctcgacaacgggcagacgctcacggtgaacctgaccgccagccgcgcctgggacgcgaaactcagcatcggcgtggagcatcggaccgccgacgggaacacgaccctcatccccggcgtcgacctggaggacgcgaccgccgcggacaccccgttggacgtgaccctgcccacgctcccctacgccgcggccggcgaccagtacgcgcccgccgtgaccggcggcgacgacgcgacggtcacgttgaaacccaccgggctcggcgatgacgggatgcgcgtgttcaccggcaccgtcaaggcgaccaggacggacggcaccatcgtgacccgcaggttcacgatccgccagccgttcgacaagccgtccaggaccgtcggcgcgccggacgccgcactggacgggctgctcgtcaacggccagcccatccaagggtgggatcccgacatcctcgaatacacgatcaccgcgggcgaggacgacaaggtcacggtcagtcccagggcgaaggccgggcagacggtgaaggcgtccgacacgaccctgaccgcgcacagcaccgtccagcattggacggtgaccgggccggacggcgggaaccgtacgtacacggtcacgctcgtccgcgaccacaggacccccaccgcggacgaggcgttcaaaccctccgatccgaaggacacgggcggcacccgggaggctcccggcccggacacggccacgctgaaaagcgtcggctggacgaaggacggcacgtaccacgcggagaagggcgacgaatacctgatcccggagggcggctcgttcgcctacgaatcgtacctgggccagatcgtgaagatcacgccgggccgcgaccacggcatgacgtggaaataccggatcggggtgctcgcccccgacggcgtcacctaccggacgcgtaccgtcacggtcacctacctgacggaggcgacccacagggcgggcctgaccgggttgagtgtcgacgggcgcgacgtggacgggttctcgccggacaggctcgaatacacggtcggggtcgccaacccggaacgctacgtggtcaccccgtcgtgggacaagcagacgggcatgagcgtcaccaagcatgtggacggcgcggacacgacgctcaccgtgaccagcgccgacgggctgacgtccgtcgtctacagggtgcacgtcgaatacgatgcggggctcgccgccaccggcgcgggcgtgacgggcgtgatcatgatcgccgtcgccgccgtcctggcggccgccggcacatggttcgcgtcccggcataagccgcatgatccggacggggacacggacgcgaccatgtgatccggatacccatacgcgcgggaaggccggatgcgggggcgcgtgttctccccgcatccggccttcccgcgcgtatgttcacactgttggtcaaacagggcggtatccgttatgaggtgacaccgggtggtcagaaggtatacgatccgcatgagatcgaccggtacatggccgaacgtcaaggcaagccgatccccgaggggaagctcgtgttctatgtgcgtgacagtgaggggaacatcgttcgcatgaacacgcaggtggaacggttgacggtcgcatacggcaagccggtgaggggccggcatccttccactcccaaggactaccaggagtggcgacggcgactatccggaataaaaggaagcagacaaccaccgtcacactacgggccagcgttgccatgcagttatggcaggaaccacaactacctcatcccgaataaccctaggcggccgggtcgagggccgcggcccgcctggtggcgagcatgcccgcacggcacatgatcgacgcctgggcgggcgtcaggccgccgccgaaccgtcccatgagacggaacgcgtcctccattagaatccggtccgttccgggcagtgtttccaggcatctggcggcgcgggcgaacacttccgcatcatgctccagcatggcgtacgcgtccatcatgcgcgtcccgccctcacggctgatgctctccgccgcgcgatcccaatccattccggtcatgcccccgtatatgcgttccggccacccgcctgtcgctcagccatgccaatgcccgcgcatgcgctccggcagccgccatgaggcggcgttcggcaggccgaacacgcggccgagcctgtccatgtcatgtcccgtccacccgtccagggggacgggaatgccgggtgagggcgtccacccgtccgtcatgaaaccgccggccatgacggacgccgcgtcgcccgcatgctggcgggagcgtgccgcgcacaagccgtccaaccgttccaggatccccgtgttcccgtcgccgcggccggccgacagccacaggacatgcgtgttccggcaggccggatggtcgagcaccctgtcccaccggcggaacttcgtctccaatgactgtccggtggacgcggtcagttccacgcatacgagcaggccctcgccgatgagcgccagatcggggccgccatggcccatgatcggatcatcgcagatccggtcgaaccggcaccacgcctcccccgcggtcagccacccgtcgcgccgggcgcggatggcgagccccgtgcagatcaggttgtgccggtcgtactggcgttgcccgcgcaaagggcccggcccgatgtccgcgatctcgacgggcgtgaggcccagccggcgcagttccgggtcgatcgcgtggtggacgggcaggcggacggccatgaagcccgcgcttttcggcccccatccgccgcgcccgttcacgttgatggggaagcccaggtcgatgaggcgcatgccggcgagcatcatccacagcgtggaccgcgggtcggcgggcagccgcgggtcgagctcgtggagttggcttgtctcgcaggtcctgtgcgagcggatgagcgcgagcgccgcccccgtgacgggggcatgccgttccagccatgcgagcgccctctcccggtcggggagccatgcgggagggtcggccacgcggctgtcccaccagttgagggccgatcccgccgaccaccatgattcgtcgaaagcgtcgaacatgacggccggctatgcgggtcgtccgcgtacggcgtgtcgccttgcgccggccgggatgcggggtggtggcgaaacgcatggtatgtgtcccgggacgcatacgcgcccgcatgtcagacgataacctcgcatgcactcccgcgcaatgggagcggatcatcagccgatacgccgacccggcccggtcgaactcgccggcgggccgggtcgccgccctgctgcgcgacgacgcgcgcgcctccgacctggtgcgcgaatgggtcgaggaccaggccatgcgatgcatggcgaaggggcagacggtcacgcccacgctgctgaccatgatctgcaaacggtgcagcaaggaggcgatcctccacagggagctgggcgtgagcgtcaaactgctgcgcgccggcgccgcctatgagaaacgtctcgccgaataccgtaacgatcatgcgtccgcccacccctcccggccggtcagggaacgcctgtgggacgaggcggtggacgcgcatatccatggtcagatggagcgcggcgtgagcagcatggtgttcctgccctaccatgacgggcgcaactcgcatccgggctcgtcgaacctgctcgcatgcggcggcctgccggaatgggaggcgctgttcggatcgaagcggcgtcgtttcgccccgttggaggatgtggacgaggatcatgatccggcgctcatggaccatacgggcggcatgccgttcgaggtgaccgcggaatggctcgaacggcatgggatcacgcccgccatgctgaaccgtctgaccgacacggatctggccgtattgggcgtggacgtcaggtccgcgcgcctcgaatccgcgggcggcgtcctggacggggtggcgggccgcctcgacctcatattggacgatccgcgggcgagccaggccctggcggccggccggccgatgctgggggccgtggagatcctccactcgctgggcatggatgtgggcatgatccgggcgggcatgcggctcggccgctggtcgcgggccggggacgtgcacgatccgggcatgctgcgcgccgcatgggaccggatcccgggccgtgggggcacgtacgacgagtatctgcgcgccgtgtccgacattctcgacaaggcccacgccctcgcatagcgaggcgatgaacgttgttttcccgagggaaaggagaccggtcatgaccgttgacgcgcatgggagaagccacaggccgtccggactgccccaagggtatgcgggcacgtatgacgggggcacgggcgcgtccgggggcatggacgtgacgccgccctcctcctattacgacgggcgcatgggcgaggcggaacgcgccgaccggccgaccggcacgtgccagcgtccaccctccgaaacctcgcatgcaggacaattgcgccgtcttctgggcgacgatccggtcgagggaagcgtttcgagcgtcgccggatcgtacccgggcccgaacgcgcgcctgtacgctgacttcgtgcgtcatccgcgccgccgcacctacacgctggagggcgagaccatgacccgctcccaggcccgcgactacgcgcgcggcatgctcgtcgaatcggcgcgcaacgatgccggggcgtggggcgacgggtatgatccggacgccatggccgaacaggcaggcgactggttcgacaggacatatcccatgccgaaacgacgttgacggagatccatgacggagggaaacggtatcatgggcgaccgtgaccggattcatactgatctttgccctactgttccttctcggcatgatcgccctgccgttcatccccgtcatcgcgatcatcctccagcgtcggcataacaggaaacgcgcgcaaggaggcgtgttcgtctcgcatcggagcgaatacgcgaacatggagccttcgcccgcggacgtggcgcacgtcgccgcacgatacgggataatgcccgatgcgcgtggatggatgggatggcggtgcgtgacgcatgatgcgggcggcatgggggacaacatccgcggggtcgccgcgaccgtggatctgaacggcttggcgacatatgggcttgtgcgcggcgtgcccggctcgggtctggaagactcctcgttcaccgcggatcagataggcgcgggcatatggggggaaagcctgctggcccgcgcgatcatggccggccggccgcgagtcttgtcatggtggagcctgtacggtttcgacgaatgcctgcgcctgtcggacagtgacatcgactgcgtgctggtcgggattcgtcccgacggcaggcctgtcgcatggttcgtcgacgcgaaacggtacaagggcggttcggacacgagttacgtgaatgtggatgcgtggcatctggcgcgcgtcagccgggcgagacgcgcgttcgtgcttgactccgcgggccgcgcgtggacatcgatgagcccgaacatgtgggagcagcgggaacggtggcagggtctgctggcccgatacggcgtcgtatcgtattgggtggtgtgcgtgaccccgccgggcgggcatgggacccccgatatgaccactgccgtatggccgggtggcgtgacctgcatggacataccatcgcttcgcgcgatgatcgattccgtgtgtgttccggacatgttcgccgcgatcccgcccggactggtctccctgcttgattcgcatatcaaatattaacgcccgccgtctctccttccaatgcgtccatgaccgcctcgtgcagcatcatgcggccggtcaatacgtcgagcttgcgacggtccacggtgttcgactccaataaccggtggacgcgcaccgtccttttctgcccctgacggtgtaatcggtcgcatgcctgacggtagtcgtcgaacgaccagggcaggctggtccacacgatctcgtgtcccccgtcctggatgttcagcccgtatttcgcggcctgggggtgggcggccaggagcgggacgcggccgttgcgccattcctccagcacgccttgctcatgcacctcgcgcatgccggggaagcgtgcgcgcatgcgctccaattcgtcggtgaactggtagaacacgagcaccgggccgtccgccgctgatatgatgtccgccaacgcgtcgagcttcacgtcgtccacgtgccggatcgtcccttccggatcgtccgcgtccgggtacaggcagccgcacgtcagttgggccagcttcgcggtcaggacgcccgcgttggcgacggtgacggtcgtcccgtcatccaggtcggcgaccatctgccgacgcagccggtcgtacgtgtcccgggtcggtttcggcatgtcgagccaatggtcggtctcgatcagggacgggagtccgggcagtttgtcgcttgccttcatggagaggcagaacggttcgatgaggtcgaggatctcctgttgggcgccgtcgcggggcgtgtagtcgatgggctgccggcggccgcccatgtcgatgtaccgggtgggcgtgaaccagcgttcccggtagcgggtcatggaccgttccaacgtttcggaccggtcgatgaccgcgatttcgccccacaggtccaataggtttttggtggcgggcgtgccggtcagtccgagcgcccaacgggccttcctcgcatgacggcgcaatacgagcccccggttggagcggggcgtcttgtagccggacagttcgtccacgacgaggcccgtccacggccagtcccccaccttcccgtccagccatttgaggttgtcctgcccgatgacggtcacgtccgcgccggcgtccagcgcctgcgaccgttgccgcggcgtgccgacggcgaccgcccaggtcagggagtgcatgcccttccagcgttcgagctcgtcgggccacgagttgcgggccaccaatgcgggcgctatgacgaggaaccgggcgtgcgggtcggccgcgtgcatgatgtccatgacggcgatgctggtcagcgtcttgccgagcccgggttcgaggaacaggccgcatccgcgggacggggaggcgaacgccttcagggcgaaccggatggcctgtttctggtagtcgtgcaatggggtttccatgcacgcgcgtatgcgtcagaaccgggacgcatatgacgggttcggtggaggacgtccggaaaggggttccgtcatgtttgattccgtcgtggcctggtatggcatgctgcccgtcggggcgaggggcgcggtcacgctggccgtgggcctgctcgtcgcctggatcgcgttcagggtggcggtcaggctggtgaagggcctggtccgttcgatcgtggccgcggtgctcgcgttcctgctggcgaccgtgccgggcaatctcatcctgcatgacgcgtacgcgcagctgagggagagggcgtccatgtcggccgtcatgtgacgtatggcgtccgtccgcctccggacgcgggtcccggacgtcctttgcgggaaacgcatatccatgggtgtccatcgtgtttcccgtcgtaaggagcctgacatggccgacaagccgttcgtccccgtcgagcatcgtctcgcgctgaccgtccccgaggcggcggccctgtgcggcattccggagaaggtggtgcgcgccgcggtcgtgcacggcgatctgaggcatttcgagaaggggtccacgaccgccaggatccgcaggtcggatctggaggattgggtggccttgctgtgagtccgacacggataggcacacttaggcacacatgccgtgtatgatgttctccagatgcgcgtgattccgccattccgtggtgccggctgacttagtgtacgttatgtcagattagttatccttgacaaggattcggtcgcctgtatcaactagtccacgcataccaaggccgacagccaaaggagcaccggagcataccaggccgacagccaaaggagcaccggagcgaccaccgcaattgcaagaatcgccgtgcctttcagccaatccttgtcatctcgtttccagtggaatgctcgccaaatgaaccatatcagcatgggaatctcatacagcgacagcaatggcaaaccgatgaaaaccaggtcgaagcccgcggcgcaggctccatcgcatcccatcatgaagaagtcctcgccgttgtgtttcagtgtgtttggaaataacggtttacggcttcttcgatctgctcgggcttctcgatgatttcgtaggcaccgtgttcttccatctcaccggccggagcgtagccccagcggcagccaatggcgtccagattgcaggcgtgggcgccgtcgatgtcggtgtagcggtcgccgatcatcacggccttgtcccccgctgcagcatcaaaaccgattttgtcgaagcagtaccgaatcacctgatccttgtccaaacgagagttatccctggatgcgccatagatgccgtccaacagctcggtcagatggaaatgctcacagatcggaacgcattggtactcgggcttgcagctggccaacgccagataatagccgtcggcacgcagcttgagcagctgttcgcggataccgggaaacacgacgttcaccaagcggccgggaactttgttgccgggctcgttcggatcatcgaacacggcgcgatccgcatagtagctgcggtagatggtgaccgcccggtcaagctcatcctccggcacatggttgcgtcgcagcgattcgatgatggccggaccaatgaaacgatgcagctcggcatcgtcgggaaccgggcgacccaattcctcgaacgtcttgacgacggaggcgatgatgccgccgtcggacttggtaagcgtgccgtcgaggtccaacaggaccactttcatcggatgctgtgccattgagattccactcccctttgttcatgtcgactgctttgaatggtcgtcaaacgatatgcgacttgttccaacaatgattatgcccagtcgggatgactgggcatcaagttcacgtgttgttcagtaggagatcactcgtagtcaggaatccaaccgtcacggtgcatttgcaggcgcttttcgagtagggtggccagttcctcttcgctacggcgttccagcagcatgtcccagtgggtgcgggtgggtttgctgatctcgtcgccctcacggtcggcgtcgccctcacggtgggccacggaaccacaacggcactcccactcgtccgggatttcggcaccctcggcaaacggcaggatggtgcggtggcccttcgggcatacatacgccacatcgtttcgtgcggcgaaatcgacgttgtcgtcggactccagcgatttcgctccgatgctcatgcccctgaggctacgttctgccatatcggcatcctccttgaaagatctttaaccctactaatttacgcaacagttcggacttggccgctattccaagcttccgacgtcggctgacaaactcccatcaaacggccccccgtcagtccacgccggagtaggccaccacgccacgattgacccggtcggccgcttcgtgggcgaggcctgccagccgctctcccccgtcgaacggcagcggctgggcgacagcgatctgctgcagcacgtcagccagtcgtttggcagtgcgcacgaagtcgccgccggtcatgtcggtgccgtacaggcacgatcccagcgaaccgccatccgcccattcatacatgatgtcgagaatgccgaagtccggccgctgcatctcgtccagaccgtgatcctcgcacaggatatcgatgtcttcacagatgcccttgagcttggacgaagcgattgcgatgggcccggagatgccgcccgggtagtgcctcggttcgccgtctcccccgcgtctggcctcgtataccagtgaagagagcacagcggccagtccgttggcgtcgagcttgtcgaacgtgccggcgagcagcgcctcgcacagttccaggtcatgttcactgtagatgcggcgcagcagcgagcctttttcggtcaacgtcatgtcaatgtggccggccgcattgacatgacgttcgaggtaaccaagcccggtgagaatatcgcagatgcgatcgaactgacgggccacggacccggtacgggagtcgtagcgatcggtgacgcgctgcagttcgcgggtctcgcgggcccagcggtggccccacttgaggtgttgctggaggtccgggcagttgcggcatggatgctcgtgctccgccttgcgcaaatcgcgaatgcgctggtcaaggttctggaaggcgcgtgaacgctcctgatcggtcaggaacacttcgtgcttcagtttgcggcggccttccttttcgatgtcgctcagctccatacgcagggtcatgaactgtttgaagtcgccgtgttcgcatgcgaacgcctgttcgtatccggccagcgcgttcttcagtgtgttgatctgcgattccagctgccaggccgattcgttggcctcccactgggcaaacgactggtccagggtaacgtgcgcggtctcgtagtcgctggagttgagcaggttcacggccatgttgaacgtgggtcggaagctcgagtgcagcgggtagacacgcttggatgacagcgcggcggccgtggcgggcacaaaaccgtgatggtcaaccacgatggcgtggccgatggtgtcgatgccgcgccgaccggcacgaccggtgagctgcgtgaattcgccgggcgtcaggcccacatgaccggtaccgtcgaacttctcgagtttctctaccaccacgcagcgggccggcatattgatgcccaaggccagtgtttccgtggcgaacaccattttgaccagaccttcttcgaacaatcgttcgactatctggcggaacagggcaatcatgccggcatgatgcgaagcgaagccttcttccaacgcaaagcggaacttggagaactgcagggctttcaggtcttcctgagtgagttgcccctccaccatctcatccacgatgcggcgaatcttggtcacttcctcatcggtggtgagctccagtccagcgttgatacactgttccacggcctggtcacaaccgttgcgcgagaagatgaagtagatgccgggcaacattcccagaaagttaagctcgtccaccacggcccagcggcgcggggtgtggcgttccgctttcggggcatggcccttggcgcctttgccgccgcggcctctgccgaagcccttgcgcttatcggggcgttcctcgccgcgccggcgtgcggccttgcggtccaactggtcgagccggttgatgagttcggcgttgagcttggtggtctgctcgccgttgccgtcgcggcgatagagatccagcacctcaggctcggtgtgttcgtccgcctgcacgatgacgtgctgttccaaaggcacggggcggtgttcgctgatcaccagtttggtgtcgcctcgcaccgaggcaatccagttggagaaatcctccacgttggacacggtagcggacaggccgacgatcttgaccgtcttgggcaggtggatgatgacttcctcccacacgggcccgcggaaccggtcggccagatagtgcacttcgtcgagaatcacgtagcgcagtgcgttcagcgtggtggaacgctcgtagagcatgttgcgcagcacttcggtggtcatgaccacgatgtccgcctcggagttgatcgaggtgtcgccggtgagcaggcctaccttgtccgggccgtacacgtcgaccagatcatggtatttctgattgctcagcgctttgatcggtgtggtatagaaggctttgacgttgcgttcctgggcgagataaatggcaaaatccgccactacggttttgccggcaccggttggggccgcgaccagtacgttgctgccggcttcgagcgcgtcattggcttcggtctggaagtcgtccagttcgaagggcagggattcggcgaatcgcgctgctgcggacgcccgatggcgctggactttttggaatgatgcgtaccgctgcgaagggctcagcgtctgggaatcggcattgcccttatggtgttggtgacgtgccattgctgctttccgttagttgttgaatcgcttccagcgggcccatgcctgggtgtggcgttcgcgcttggcggccttgctgcgaatcacgtccgcatgggcctcggcataacgattctgtgccacgctgagcggctgagtgaacagaggcggctcgctggtgtcggcagaggtgccagactcccccatcgcggccacgcgttcaccgagttggccgccgatgtcggacatgtctttcaaggcacggattccatgaagggctgcatagatgagtccggcaacaatcatggccagcatgaacagggccagaatcagccatatccaccaaggcatgaaaggctccttacttgttctcgctgatgctcagttcgcgttcggcgcgtgccacgatcatggtgcgcaacgtttccggggcgaccgccgtgatatgacgcgcgtgtgcgatgcagaaggccacgaaccaggagtcggaggaaacggtcagatgcaccttttcaccggcaccgcattgttcgacggtagcgcccggcaatgtcttgatgaatgccagatcgcgctgatcggtgatgaacaccgcgtcggtaccgttgtcgaaactccacttgcgcagttcgctcaccggcatgttcgggatgttgatctgcttggtgggcttgaccagttccgccttttcgatacgggccaagcgcagcacctgccagatgcgcggcttgccgttcgccttgtcgatggtcttgtctttggagacgtaggccttcttgtccttaggggcggcggaaccgacatccgtgtagacggcggcataatacacgccttcgtcgatgaaaatcttggcgggggccaccagcttgcgacgggtactaccggtaccgtcggagtactccatgtccaacagcgaatcggtgttgatcgcgcgcttgacgatggagaagcttcggggctccagctcatagccggtcaggctcagccacggggtctggcccgggctgacatggcggcgcaaacgctcatacagggattcggcctgcccacgctgcttgtccggcagtaacggcgaatgcgccaagtagctgaccgaggcggtgagcatgctgaggtattgcggcgaaatgccggcaagacgttcaaggcccaacgaattggtggcggaaacaataccctcggcatccagcagcggccagtcgatatcgaagaactggctgccagccatctcaccatcgtcggaaacggtggtcagggtgttgatgtccttatgaatgatgttaacgaatttcttgagctcgtcgtcgttcttcggtttgccgataaagcgctcggccagctcgctcatcgagaattcctcacccaggtgagcggagaggaacagcatcagacgcaggcgacgatccacctcgctgcccgtttggaaagcggggccgttcttcttgttctgggccttgatcgactcgggatcacccggctcacgaacatcgcgactaatcgacggggaaaccaccgaggcgcttacagggctggcggattcgtcagccagagtgaatcggctggcggcgtgcaggcggcgatgataggcgtccacagcctcctgcgggctgacaatcgtggcacccggatgctccagcacaaacatggccaaatcgtcggaatcggtgtaggccacgttcaggtgttcgccgtccacatcaacggtggcggcaaagcgacgcgaatcgataaccttgaccagcgagtccggaatgggctgcgtgcccaagccaggcgcaatcgaatccaaaccgagaccgggaataggggtctgcggcacacgcggcgtggtgcgcgacgcatgttgggcgagctgggactgatccggctcggaggaaatcgacatcgaacgagccagatagttggcggcggcaagcaccggcatatcttccggctcgaacatcagacggatgcgcggttcgtcgcccaactgcagacggtaggacgcgaagtcctggccttccgacttggacgaatactcaggctgccgtgattcgatggcgatgcccatagcggcgagcttggcgcgatcacgctggaactgcttggcgaacgcggccttggcggcctgatctgccagctctccatacgagtcggcgtaagccttgacgcgctgcgcaatttggcgggatgtgagccattgcgggaacgcggatgacaacacagccagtacgtccagctcgtgcttgccccatttgtcggaaaaacgccgacgtccgcttgtgccctctgccattagtcctcacgtatagttattgtttcgttataagtgcgtatgagtttcctcacactcactctatcttagaggctttttccgcacttgagcgccatttcacaaaaataatatcttttttatcgttcgaccgtgttgtaaatcacacccaatcgtccggttcgatgccttgcggaccaacgtattcgccgttcggcacatagcttggctcgcctttatcttcaagtttggcgtcggcgaacatcatgacgtcacgtccgaatgtccagtcgccctgaatggaaaccgagttggctgcggccaaagatggcacggcgtaggggaaccgttcgtcgaaatcgcggatgttcttgtagtatcgcggatcaagttcgacgttcgggaagatgtaattgccgtcttccatctcatacgtgtccgtcaggtggaagcgatcggaacgcataatgaacaaatcattggtggttttcaccggaaggaagcgcatacgatccacttggacgcagatggaaccgttgaacagaccgattgcggcacccatggcggtttccagctgaatcacctgttcggagttcgggtccgtgggattcacggtctttttgttacgaatcaccggcaacggcaacacaccatcgcattcggcgagcttgtctttcaaagcgtcgatgcgaatccagatcgagttggtgttgaagtaaggatgcttggcgatgtcttgggccgcttccttatcatccggatggacctggctcatttcacgcaggatcaggcgaccagtggccttgtctcgcacgatatggcctcccttgcgatcggccttggtgcggatggccacttcagccataaacggggcacctgtgttttcgaagtgctgggccaacgtacgcgaggggcgtgcaccgagattgtcggaattggagatgaacaggtacttgaagccgcgctcctccaatacgtcaagcaggccggactcccagatggtggagaacaggtcgccgtggccgggcgggcaccattccagctccgggttcatggggtagctcaccggttcgccggtggcggccacgagtttgggttcctgatgctggatgatttccatcggcacgtcatgctggctgaacttgcgatgatgcttgagcgccttcatcgtgtccgccgaagtgtggaaggagttcatgaacgtcagcggcagttcgacgttcaggcgggtgcgagcggtaagcacctgaccgatgatgatgtcgatgaagcgcatctgcttggccttgtgcctacgcaccggcaacagcgacttggccttgtctaatcccatggaggtgcccagaccgccattgagcttgaggaatgcggtcttggcgaaggcgtccacggccttgtcgtggttgatggtctcatagacgtcgtggaagctgggcacgtggccaagcggctcgatgtcgtcctcacgaatccagctggaggcttcttcatggcgccatacgtcatacaaatggtggaactggttgatggcggtttcgctcatgccgtgctcgcgcatcttggcggccgaaagctcgaaagtctcatccacttcggggtgtttacggtttcttcggggtgtccgaggtgacggcgtcggtgtcgtcagcggcggcgatatccagttgggccttatcgtttatttcggtcaattcgggtccctttcgtcaaatcaataggaaccagtctagcccctgtttggggcaaacgcatacgacgggggtgcggaggcggtgaattgtcggtgataattcattacgaatggcttacaaaggtaagtccgtcgtcatgttgtctcatattgtctgaaaacggaaaaaccccggaagacaaccactcaaaagtggcagaattccggggctaatcggtcgggccggcgggatttgaacccgcgaccccttgacccccagtcaagtgcgctaccaaactgcgctacggcccgatggtgcaaaagcaccgagtagataatttaccagatatttgaaatctggcaaattacgcgcgtgtcacttccgcttcttcttctcgcggatgttcacggagatctgaatcggcgtgccttcgaagccgaattcctcgcgcagggaacgctcgatgtagcggcggtagccgtgctcgaggaagccggtggcgaagatcacgaaacgcggcgggcgcgtggatgcctgcgtggcgaagaggattcgcggctgcttgccaccacgcaacgggtgcgggtgggcggcctgaattttgccgaggaaggcgttgagcttgcctgtaggaatacgctgatcccaggattccaaggccttatccatggctcgcgtcagacggttggtgtgccagccggtcttggcggacagattcacacgctcggcccacatcacacggtcgaattcggtgttccacaggcgttcgagacgctgcttgtcgaactcgtccatcgcatcccacttattgaacacgagcacgatcgcacggcccgcatccacggctgtggacatgaccttcaaatcctgatcggataccggctgcgaagcatcaaacaggatcagcgccaattcacagcgctcgatggcggcctgcgtgcgcagagaggaataatattccgcgcctgtgagcttgtgctggcgtcgcttgatgccggccgtgtcgatgaacagccagtcctcgccatcgatgttgacgatttcgtcgacggggtcgcgcgtagtgccggccaaatcgttgaccacggcacgttcttcgcgcgccagctgattgagcagagacgacttgcccacgttcgggcggcccaccagagccacgcggcgcaggccggaaggcgtgaggtagccggaagtcttctcggcctgcttgagcttgtcgagcgcgacgtccagcaggtcgcccactcccctgccgtgcatggcggaaatcgagtatggttcgccgaggccgagcttccagaattcggcggcaagatattcgctggcctggtcgtcgatcttgttgacggccagcacgaccggcttgccggcggcacgcagcatcttgacgatgcgctcatcggtggtggtcatgcccacttgaccatcgacaacgaataccacagcatcggccaaggtcacggcaacctgtgcctgtgaggcgatggcggattcaatgccttccacgtcggcttcccagccgcccgtgtccaccagcttgaagtcagtgccggcccattccgcgtcatagctcacacggtctcgcgtaacgcccggcgtgtcttccacaacggcggcacggcggccgaggatacggttgaccagggatgatttgcccacgttcggacggcctacaacagccagcacacccaccggcttggggccggccttgcgcgcgccttccgtgaaaccgcggccggaaatcagatcctcatcgccttcgtccagctcatagccttcgagattggcggcatactgctcgtactcctggttctcgatggcgtcctcgaccagaccgatgagcagatcgagcgtgtgggcgaagtccaaatcggaattgtcgatggtagtaacgccatcggcggcggtcaggaagctggtgaccttggaatcggccttgtcgcgcgcagccacatcctcagcacccacgcccttgacggcttggccggtgcgacgggcctgacggacctcctcacgggcggtcagcagcacgcgcacctcggcgtccggggacaccacggtggtgatatcgcggccctcggccacgatgcccaaacccccggagaaggagtcggccgacgcttcgcgggcgatgtaggcgcgctgggcggcgatgagcacgttgcgcaccgggatgacgttcgacaccttggagacatggctggagacttcggaggaacgaatggcctcggagatgtcctcgtcgtcggcgaatacgcgggggttgtccgggtccacggagatatcgaaatggtcgccggtgaagaactcgcccaccgcttcggtgatgacacgctcatccacggtttcggcgtccagatcgatgtcctgcttcagacaccaccaagcgcaggcacgatacatcgcgcccgtgtcaaggtaagcgtatccgaaatacttggccagcgccttggacgtggacgacttgcccacgccggcggggccgtcgatggcaacgcgaatcacagaccaacctccttggacagcgaacggacttccgtctgggacagcacgcggtaggaaccgggcttcaaatcaccgagcttgatcgggccgatctgggtgcgcaccaagcgcttgaccgggaagccgattgagccgaagatacgtcgcacgatgcggttcttgccggagtgcagcacgaccttgaccatcgtgtggtcacgcgaggagtcgatgatcgcgcagtggtcgagcttgatccagccgtcgtcgagctgcacgccggtggtcacgagtcgacggcacacggtgccggagatcttgccttccagcgtagcgacgtaggtcttctcgacctcgtacttggggtgcatgacgtgctgcgagagctcgccgtcgttcgtcatgaggataagaccctcggaatcgtagtcgagacggcccatgtggaagatgcgctcgtacttgtcgcccacgatgtcgcgcagcgtgtagcggcccttcgggtcgtccatggcggagagcaccttgcggggcttgttcagcgccagagtgacgtggttcggattgacgcgtacgcgcgaaccgtctacgcgcacctgctgcttatgagggtcaacgcgagttccgagctcggtgaccagttcaccgtcgacctcgacacggccttcggtgatcatgtcctcgcacttgcggcgggaaccgaatcccgcttgggcaagcagcttctggagtcgaatggaattggaatcgtcttgcgctttcgcagcgcgggaatatgcgtttggcatcgttctcccaacgtggccggacagattctgtcatcgcagagactgtcgatttgtatacatacttcagagttggcggactggaatcccagtcaattccaacctatatatcataccgcaacgtaggactgctgctagactggcaaccgtttgtgcgggttcgcccgtcttccaacagatgaaaaggaatgaacaatcatggaagaaaccaagcaacagccgctggctctgcgcgtgtgcgccgaattggccggcagcttcctgctgtgctttgccatttacgccttctccacatggggttcggccgtgtatggcatcaatatcgtgttcttcgcgttggctaccggcttggcatatgccgcagtcaccgccatcttctcccgcgtgtccggtggccagctgaatccggccatcaccgtagcctccgtgctggtttccaagacgaaaatcctggatggcatcctctatgtgatcgctcaggtcatcggtgccatcgccgccggcttcgccgtggtcaagctgctgcccacatccgagcaggtagctgccaaagtgtggctgactccggccgttaacggtttcgaaaacggctccgtgtcttactcgctgctgacccagtatggcattacgttctcgattacgctggcgattgtcgtcgaggtcgttgcctctctgattgtcgttgccaccgccatgtcttctctgggtgatcacggcgagtcctcggaccgtcatgtcattgccatgggtcttgcctatggtctggccaccgccatcagctacccggttaccggtgccggtctcaatcccgcccgttccaccggcatcgcactggccgcgatgaatgagggtcttacgcaaaatccgctgcagcagctgtgggtattctggattagcccggtcttggccgccgctgtggtggcgttggtcatgatcatcgcgcagatgatgaccactcccaaagtgccggctgccgccgatcttccgcagacggatgccgatgcaaacgcggacacgctcgacgatggcgaattcttcgatcaggccgcctcgtctgatggcgattcagcggaaaaagatgttgccgaagagtccaaagaagctgaagtaggtaatcagcaggccgattcccaaggcgatgccgatgaaggagtcgaacgccactgagcgcactttccatgggcttctgtcctgaagaatcaggcgaacaagcccggtgatgatggccgtcacggcaagtatgaccgtggcggccatcgtatatccgaaagcaaccagcagtgtgatgacggcgacgacgccgagtacgcaccattcaaaccatggcttgccctcatgtgcttcggatacatagggatggttgtgcatgttgcgattccttctgtcgaacggttacgtgaccacaatagcaggcgaatagcaaaggtgggattccgcttggacccgttgacgggtcaggcggaatcccacctttgtgcgttttggctgagctgctcccctcagagagtcccgatcagtggaagaagtggcgggtgccggtgaggtacatggtcacgccggccttcttggccgcttcgatgacctcctcatcgcggatggagccgccaggctgcacgatggccttgacgcccgcgtcgataagcacctgggcaccatcggcgaacgggaagaacgcatcggatgccgcgaccgcaccggtggcgcgatcggcaccatcggccagcgtgttggcgcgctcgacggccaaatggcaggagtccacgcggttgacttggcccatgccgatgccaaccgtggcctggtcgtgggccagcaggatggcgttggacttcacgcagcggattgcacgccatgcgaacacgaggtccttcagcgtgtcagcgtcggcggcctcgccggccacgagcttccaggcgtccggatcgtcgccgacggcgttgatcagatcagtgtcctgcacaagcaggccgccatcgatctggcggatggcctcgtggcccttcggcggctcggccacctcgaggatgcgcaggttcttcttcttggtctgcagcagttcgagcgcggccggctcatagtcgggggcgacgatgacttcggtgaaaatcgggcgcacgctttcggccatctcaagggtgaccttggagttgcaggcgatcacaccgccgtaggcgctcatcgggtcgcaggcgtgagccttcttgtgggcctcggccgcggtcgcgccgatggccagaccgcacggattgttgtgcttgactacggccacggcaatggcgggagccatatcccatacggtgcgccaggcggcgtccgcgtccacgtagttgttgtagctcatcggcttgccgccgagctgctcggcgtgggcgaaaccggtctggttgagcgggtcgatgtagagggcggcctgctggtgggagttctcgccgtagcgcagggtgtgcgcacgatcccaggtgcgggtgaactgggccgggaacttggcggaatcgacttcagtgccctgatcgtccttgtccacctcgacggcgtccagagaggccggcttgggccagtgcttggcggtccactcgttgatggtggcgtcataggcggcggtgtgcgcgaaggccttggcggcaagccacttgcgctcgtccaaggagaagccggtgccgtcggccacgcgggaggcgaccagtgcataatcggccgggtcggtgacgatggccacggtggcgtggttcttggccgcgccgcgcaccatggaggggccgccgatgtcgatcttctcgatggtatcggcctcgttggcgccggagcgcacggtgtcggcgaacgggtacaggttgacgaccaccaagtcgaacggcttgatgccgaactcctcgagctgcttggcatgctcggggttggtcatatcagccagaataccggcgtgaatgtacgggtgcagcgtcttgacgcggccgtcgaggcattcggggaatccggtgacatcggacacctcggctactttgacgcccagttcggcaagcttcttggcggtcgaaccagtggaaacgacttcggtgccggccttcacgaacgcttccgcgagtacttcgatgccttccttatgaaagaccgagaccagtgctcgacgtatcggtcggttcgtgtttgtcatcctgttcctccttggattcttgtggttgtgacgctaggaaccgcgcctgatgaacggtggcggtcttcgatgtcgcggcggtggtgcgggaatccttgattctctcaaccaaccagactatcggaaaaacgagcgctgtgccaatcagcgcgagcagccatgccgcggtaagtcccagtgcggtcgaatgaccgacgactctggtggaggccatgacgtcgacgcctatgtgagcaagacgatgatcgccaagcgatccattggacagagcgaacagcaatgtggatgccagtgagatcagcatcgcgctcaggcagaatgccccggcggagtagatcagcgaaaccagtaccgggccgcgggtggacgtatcccgtacattcaacggtctgcaggcgaatccttgcggtaggaatacagccagcaggcccacgagcgcagcgatggcgagaggcgcgttcaaggcaacggtacgccatagttcgctgctgaccggttcgggcagaataccgaataccggaattgcaggaagctctttggattggccgagccataatgtgaaactggccaaatcaccgatggcgaatccgccgccgaagagccaggaaacagcccagagcatgacgttgggtagccagatcagcatggcgacggtggtgagaattcgtgaacctgtttccatcccggacaattcgaacaacgatacgacagcggcatggttgcgtaccgaccatacgatgacggtaatcaatccaattgccagatatatgctcagtatcgcgacggccaaggcgacgccgattttcaggcagtggcgtatgtccgccggcacctgcttgcgagtccagtccctgaatgctcgcattttggctgattccggtacggctgcgcataggaaaccgatcgagaatacgatggctgctttcagcaacaccagccactggtcatcgacaagacctaggtgcacggattgccggaatgcctcgttcaacccgagccaaacaatcaatccggcaacatacgcatgcggcccgtatgccttgattcgcatggtgagtgcattgatcagccatatcagcagtatggtcaacagcaatggcgtgatggtgagggtgaacgaatcggttctaaagcccgatccctcactcagaagcacaacggcctgtgtcagcgaggttgtgccgacggtgagattgtcgccgccctcttccatagagacgaccaataacatcagcgctgtatagcagcctaatgcaacggcatagatggccatggatgcgagggcgactatggctccccgcacccattggcgaatcacggctttcatcacgattggttggaaccgatcagtcgatgttggccttggcgagtacgtcacgcatgatttcggcggcctggcccggggtcttgcccacggggatgcccgccgcctcgagcgcgttcttcttgtcctgggcggtgcccttgcctccggagacgatggcgccggcgtggcccatctgcttgccttcggggcggtgaaaccggcgatgtaggcgacaaccggcttggtcatgtgctccttggcccatgcggcggcgtcctgttcggcgaagccgccgatttcgccgatcatcatgacagccttggtgtcggggtcggcttcgaatgcctgcagggcttccagcagcgtcgtgccgacgatcgggtcgccgccggcgccgagacaggcggtgaagccgatatcggacaattcgcccatgagctggtaggtgagggtgccggatttggagaccagtccgagcgggccgcggccgacgatgccgtcggggatgatgcccagattgacgccggggttgccgagcgtgatgagaccagggcagttcggtccgatgatgcgcacgcccttcttgagcgccagttcgacgaagtatgcggaatcggccaccggaatgccttcagtgatgaccacgatgagttcgatgccggcttcgacggcttcgaccacggcggacttggcgaacttcggcggcacgaacaccacgctggccttggcgccggtggcttcacgtgcttcgccgcaggtggcgaacacggggatgtccgcgtcggcaccgttcttggcaccggggaaggtgacggatgtgccggccttgcgcgggttcacgccgccgacgatattggtgccggccttgagcatgcgagccgtatgggtcatgccctgatggccggtcatgccctggacgataacgggagcgccgtcttcgatgaacagcatcagcgaacctccttggactgggtcgcctcaccggcgagctgcgcggccttggctgccgcgccttccatggtttcggacacatggatattcgggttattggcggaggcgaggatatgcaggccctcggcggcggcgttgccatcgaagcgcacaacgatcggcttggaaccgccgagcttggcgaccgcttcgaggatgccgttggcgacttccacgcaggaggtgatgccgccatagacattgatgaacacggattcgacctgagggtcggacagtacgatctccaggctttcggccatgacggctgcggaggcgccgccgccgatgtccaggaagttggcgggcttgatgttggtgccctgttcctcgccagcgccggagacggcatccagggaactcatgacgagtcctgcaccgttgccgatcacaccgacctcgccgtgcaggtgcacgtagtgcaggccgtgttcgcgggcgcgctgttcgaaggggtcgggaacgatgggatccacgaaacgcgcccagccgtcatggcggaaggaggcgttgtcatccaaggagatcttggcgtccaaggcgctcagctgcttggtggattcgtcatccgggtcgccgatcttggcgagcggattgatttccacgagcgtggcgtcgttgtctttgaagcagcgccacatcttgagcagaatctgtgcggcctgatcgacgtccgcgtggtagaagccgatgctctgtgccatttcggtggcagcggccaggtcgaagtcaccgagcgcatcgatgtgcaggcgcttgacggcctccggatgttccttggcgatttcctcgacttcggtgccgccgttagcggtggccagcacgtcgaagtcgcgcgaggtgcggtccacggagatggacacgtagtattcgtgcaggatgttcttggcttcggctacaagcacgccggaaaccttgtgcccgtggatggtcatcggcaggatggactcggattcaagaatcgcctcgtcgcggttatgggcgatcttgacgccgccggcctgaccacgatgaccgatcttgacctgcgccttgattacgcagggatagccgattttgtccgccgcttctgcgacttcatgggagttctgggcaaagatggcgtccggggtgggaatgtcctgttcctcgagcagctgacgcgcctggtattcgtaaagatccatcgatccttccctgactatgtaattggtccggcatgtaactgtacacagtacatgccggaccttgaaaactgactgtacgttgggtgagacgaaatctcaggccggcatcgcgatcagcgagctgctgggcttgccgtcgagcttatccagaccgtcgaggccatcgagccgcatcacgaaactgaagcccaccacggtgccaccggccttttcgataaggtcggtggcggctttggcggtgccgcccgtggcgatgaggtcatcgacgatgagcactcgcttccctgcctgtacggcgtcggtttcgatttcgacactggccgtgccgtattcgaggtcataggattcaccgatggtttcaggcggcaacttgccggccttacgcacggcgatgaaacccttgcccaaatgggcggccatggccgggccgaacaggaacccgcgcgattcgagaccggcaatggagtcgaattcgctcggggacaccggcagggcctcttcaagtgctttgagcagaatcttcaagcccttggggtcggcgagcactggcatgaaatcacggaagatgatgccttccttgggaaaccccggtacggaacgcaccaaggacaccagatattcggcgtcctgttgccctaccttgctcaatgcgtcgatggtgatgtccgactgtgccatagtgctcgccccttttatgcctttgcgatgcgatacgcggatggtgctaccgaatcgaacagcttacttcgtcttggtttcgttgtcgtcaccggtctcgtcagcggtgtcttcctcggacacgacggacgcctcgatcggaacctgaccagcctcatcgttagccggagcctcggtgtcttcgtcgggcagcgggttgccgttctcgtcgacctcatcatcggacacataggccgggcgggtgtactcacgggcgatggcgttgaagccgaaacgcagcttggagccttcggagtcgatgacgatctcctcatactgctcgtcgacttcgacgaccttgccgatcacctggccgatggtgatgacctcggtgccgggctgcaggttgcgacggaagtcctgcttctcctgctgttgctgcttggccttcttggactgccaccacatcatgccgccgaacacgacgacgatcacgatgagcataatgtactgttgttccacgaaacaactccttcaaacgagcgacattgacgaaacgccgccaagtgtgcaaacaggagaaagtctagaagagcttgctgacatcatctttgggcgtaattcccaaatgctgccatgccttctcggtagccacgcggcctttgggcgtgcgaatcataaaaccttcgcgcacgagatacggctcgcacacggtttccacggtttccgattcctcgcccaccatggccgccagattgttcaggcccacgggtccaccgttgaagttgcgcacgatggcattgagcacggcgatgtccagccggtcgaggccttcggagtcgatctggtacagggccagcgcctccttgacgtcgtccggccgcaccacgatcaggtcgtggacgatggcccagtcgcgtacacggcgtagcaatcggttggcgatacgcggcgtgccgcgcgaacgcaacgcaagctcatgagcggaacccgcatcaaggtttacgcccagtacgttggccgaacgttcgatgagcttttccaactcctcatgcggatagaagtcgagatgtgcggtgaagccaaagcgtgcgcgcaacgggcttggcagcataccttcgcgcgtggtggcaccgatgacggtgaatcgcggcagggtcagcgggatggagcttgcgcccgggcctttgccgaccatcacatcgacgcggaagtcctccatcgcgatatacagcagctcttcggcggcgcgcggcagacgatggatctcgtcgatgaacagcacttcgccgacgtcgagggagctcagaatcgaagcaagatcaccggcatgttgaaccgcagggccggaagtcacgcgaatcggcacttcaagctcattggcaacgatcatggccaacgtggttttgcccaagccaggagggccggcaagcagaatatggtccggtggcacatcgcgtttgcgggccgcgtccaggaacagttgcagctgggccttgagccgtggctgtccgataaagccttcgagaacatgggggcgcagctcctcgtcgctgaccggctcgttgccgatcggctgggaggagaccatgcgcaacgactcttcgttggcaccggtgttggaggctccgtaatccgttgtctcgctcatcagcggcccctatccatcagcgccaaagccagacgtagcacacgcggcacatcgtcggtggcaagcggcgtgggaatatcgttttcggcgcaagcctcggcaacggcctgttgggcgtcctgctgacgccagccaagtgaaatcagtccttcgacaacctgttccgtaccggtatccaccggagacttggatattgccgcctgagcggaagcaccctcgatctgactcaaatcaatagagcccttaagctcgaggatgattttctgtgcgcccttcttgcccagccccggagccttggccagcgcggtggcgtcgttgtcggcgatggcgtgggccagctgactcggcgtcagtgtggagagtaacgattgggccactttaggtccaatgccggagaccttgatgagttgcagaaaggttttcttggcgtcccgatccaggaatccatgcagggtaatggcatcctgagagaggttcatataggtgaagacgcgggtgtcttgcccggcgtgcagacggctcaggtcggtggcggacatgcgcacttcgtagcccactcccccaacatcaatcaatgcggtatcggtttcgaccgattcaacccgcccggtcagcatgccgatcatacaggtactccttcagggctccaggattcaagactcgaacaactgttcgaaagtatactacatgcctcggtcgtggttgatgcggcggcgcgtggatttctgtgcggcctcagcccactggcgttgcgcggcggtcagatgttgttcgcgttcgccgccctgcaatgcgcctgccgggcgcagcgcatggcaaatggccaaagccaaggcatcggcggcatcggcgggagtcggcattttggtgaggttcaaaatacgtgtcaccatacgctccacctgaatcttctgcgcctgcccgttaccggtgatagccagcttggcttcggtaggcgtatgcaacgccacgggaatattgcgttgcgcggcggcgagcatggcgaggccggcggcctgtgcggtaccgagtacggtgttgcggttggattgtgcgaacactcgttcgatggatacggcatcgggtgcgaagcgatccattttctcggacaggccgttgtagatggccagtagacgcagatcctgggtgatatccggtgaggaccgcaccacgtccacgtgaataaacgaaagccggcggtgctcgccggcttcgatcacgccgaccccgcaacgtgtgagcccggggtcgacgccaaggataatcacgaggattactcctcgtcgagctgggccatcacctcgtcggaagcggtccagttggagtagatgttctgcacatcgtcgaggtcatcgaggttgtcgatgagcttggacaccttgcgggcatcctcaaggctcaactcgacctcgttcttcggctgcatgacctggtcggcggaatcgtagtcgaagccggcttcctgcagagccttgcgcacggtgaacaggtcggacggaccggtcacaacggtgaacacttcaccgtcatcggtaacgtcctcggcaccggcttcggcggcggtttcgaacagcttgtcgaagtccacgccctcggacggcaccacgatctggcccttgcgctcgaagttgaaggacacggagccggaggtggccagagagccgttgcccttggtcagggtggaacggacttcggcggccgcacggttgcggttgtcggtcaggcattcgatgatgaggccaacgccggcaggagcgtagccctcgtagacgatgtcttcgtagttggcggcaccatcttcagcaccggcaccacgcttgacggcgcgagcgatgttgtcggccggcatggaggccttcttggccttgtagatggcatcgtacagggacgggttgccgtccgggtcgccgccgccgaggcgggcggcgatttcgatgttcttgatgagcttggcgaagagcttgccgcgcttggcgtcgatggcggccttcttgtgcttggtggtcgcccacttggaatgacctgacataatgctcctagcaattattgaaacggatgatgtcaaacgaaacgattgtaggccgttaatcagacatacccgtaatgtttccgatgattgtcttattgcgcgtaccgataaaaccggttgcgcgggtgccgcacccggtcaggcaagcggcaaatgatactgcggggccagctgttcgaatgcctgggcataggcgtctcgctggtcggacagcagaatcggcatggtacgcgtctgggcgacgatgggcatgaagttcgcatcgccattccaacgcggcaccacatgctggtgcaggtgcgcggcgactccggcacccgcgacctcgccctgattgatgccgatgttgtatccgtccggacgggagacggtctccatcaccttcatggcgagggtggtggccttctcgaattcgaacagttcggcatcgtcgagttcggtgatgaatccgacgtgacggtacgggcaaatcatgagatgcccgacattgtatgggtagaggttcatgatggcgaacacgtgcgtgccacgccaggcgatgaggccgtcttcgtcggattttttgggtccggcgcagaacgggcattccttcgtcttgggcttggttgggcgatcctcgctgttgcgcagcacataggtcatgcgctgcggagtccacagtcgttcgaccgtgtcctcctgaggcggaaagtccgccggattatcgacacgcacgtcagtcattttcgcaccctttcttggctcccctcagagaggggagccagtaccattcacatcactcagccacagcagcgttgaagtcgtcggcggagttcacctggacgcgcttcttgatgacggtgagaatctgctcgcgagcagtgtccaccggcacaccgttgagctggctaccgtcgcggaagcggaagctgaccgcgttgttgttcatgtcttcctcaccgacgatgaggatgaacggcaccttggacttggaggcgttgcgaatcttcttgccgaagcgatcgtcggagtagtcgatctcgcaacggaccatctcatcttcaagggacttgacgaagccggccagatgcggggcaaactcgtcggcaaccggcacgccgagcacctgcacgggggccagccacgccgggaaggcacctgcgtagtgctcgagcagcacggcgaagaagcgttcgatggagccgaacagggcgcggtgaatcatcaccgggcgctggtgggtgccgtccttcgcgatgtactcgagctggaagcgctccggcaggttgaagtcgagctggatggtcgagacctgccaggtgcggccgatggcgtcgcgggcctgcacggagatcttcgggccgtagaaggcggcgccgcacggatcgtcgacgagctcgaggttggattccttggcgacctcggcgagcgtgttggtggcctcctcccagatctcgtcggagccgacgtacttgttcgggtccttggtggacagctcgaggtagaagtcggtcaggccaaagtccttgagcaggttcagcacgaaggtgagcaggctggtgagctcgtccttcatctgctcgcgggtgcagtagatgtgggagtcgtcctgggtgaggccgcgcacacgggtcaggccgtggacctcgccggacttctcgtagcggtacacggtgccgaactcgaagaggcgcagcggcagctcgcggtaggagcgctggcgcgacttgaagatgaggttgtgcatcgggcagttcatcggcttgaggtagtagtcggcgcccggcttggtgatgttgccgtccacgtccttctcctcgtcgaggtgcatgggcgggtacatgccgtccttgtaccagtgcaggtggccggaggtctcgtacaggccgcccttggtgatgtgcggggtctgcacgaagctgtagtggtgcttgcggtgcatctcacgggagtagtcctccatagcgttgatcacggcggcacccttcgggtggaacacggccaggccggggccaatttcatccgggaaggagaacaggtccatctcggcgccgagcttgcggtgatcgcgcttggcggcttcttccaggcgggtctggtaggccttgaggtcttccttggtggcccatgcggtgccgtagacgcgctgcatggtcgggttcttctcggaaccacgccagtaggcggcggcggaacgctcgatcttgaaggccttgatgtagcgggtgttcggcaggtgcgggccgcggcacaggtccttccaaaccacattgccatcacggtctacgttgtcgtagaagctgagctccttttcggagatctcggtggcggcggccgggtcgaggtgtgcttccttgtcttcgatcagttcgatcttaaagggctggtcggcctcttccttcagagcctcttcctcggtcacggaacggcggcggaaggactgggaggacttgatgatgcgctgcatgcgcttctcgatgtccttgaggtcgttcggggtgaagggctggtcgacctggaagtcgtagtagaagccgtccttgatgacggggccgacgccgagcttggcgttcgggtagacttcctgcacggcctgggccatgacgtgggtggccgagtgacgcatgattgcgaggccgtcttcggagtcgagggcgatggggtcgacggtgtcgccatcgttcagcggcgtgtacaggtcacggttctcgccgttgatcttgaccgcgatgatgttcttgtcttccgcgaacagttctacgccggtggtggttgcttccacctccttcgcttcgccgttgacggttatggagatggtagcttgcgccatgatttgtcctttgctatcggggcccgcggtactaatgtgcaggcctggactggttaatcaacgtaggacacgataggttgggcgtgcgacaaataccaccagcatctgaaccaatacgaaaaaacctcgccgaagcgaggttccgttgtggagcggacaacgggactcgaacccgcggtctcaaccttggcaaggttgcgctttaccaactaagctatgtccgcaaaggaatccgccgtgagaagcggaatccagtgggcgatgtaggaatcgaacctacgaccccttcggtgtgaacgaagtgcgctagccgctgcgccaatcgcccgaatattcggttctttagttatatccagtcgaattgcttcgactttcgtgggcgatacaagattcgaacttgtgaccccttccgtgtcagggaagtgcgctaccactgcgccaaccgcccgggtcatatttcattccattgaattgcttcgctggtctgagaggtgggtacgagagtcgaactcgtctatacggctttgcaggccgctgcctaaccgcttggctaacccaccgtaaggtctgtcaactcacggacctagagcggacaacgggactcgaacccgcggtctcaaccttggcaaggttgcgctttaccaactaagctatgtccgcgtgtgtttccttggcgaggtctccctgccgaagcacgagtgtttactatacacacatgcgtgtagttcgtccagctgcggcgtgtcgcctgtaattgcatactctcgcttatggctaaagcgtgcgcttcgggcaatgaactccagttactctagaggtatgagtgaagcagcgaaggacaccggcgcagtattgatcgccgcattcgagggatggaatgatgcctgtcaggcggcgacgaacgcggtgcgccatctggtcaagcgatatgagtcccgcgagattcgtcatattagatgtgatgatttctatgactatcaggttgcccgtcctatgctgtgccatgtttcgggacgcaccaatcttatctggccgcagaccacgttctacgacatcacgttggacgcaggcaagcatatctatgcgcagatcgcccccgaaccgaactatcggtggaaggaatactgtagccagagtctggccattgccgatgagctggatgtcaatcggatcattacgttaggttcgatgttctccgattgcccgcatacccgtccgttgcccatcgccgtcagcgacggagactgtcaatgcgaaggagaccggtcgtataacggcccggtaggcattcctaccgttttggatgtggccgccgcgcagcaaggttttgctcattcctcgatgtgggtgtccatcccccaatatttgggcagcgacgaatgttctgccggcactatgcgattgctggatgcgttgggcaagcatatcggcttcaccttcgatacggcagatctgaagcagaaagccgaacagtggaaggcgcaagcctcgatactggttcgttgtaatgaccagcttcacgattacgtggagcatttggagcacgactacgacttgcagcagaaagccgaggcggaggcttccttgggagcgccccaggccgaacaactagtcaaagaagcagaagcgtttctgcgccagatgggcaattagcccatatatggtgtgctcccgctggatgaacagccctgtgggctgttcatagcagtgcaccatgtgcacgtcgcacaaaatgtcgggagctggctcgcgtagcgagactgagggtggttctgctggcatattccagtgaccacccccagtcagcttcgctgacggctcccgccagcgggagcaccattatattggagtcgtctatcgacccgtcttatgccgcagccgccacggagggatcgatggccggcagcacgcccacaatcagcagcaaggcgacgaccacagccaaaccgatgcggtagatggcgaaggccttataggagaagttcgatacgaacttcaggaatccgatgatcacgatgtagccgagtacgaagctgatgaccatggctacgagggtcggcccccagccggggaacatcgcatcggttttgtagttcttcacggccttgatggcttcgagcaaacctgagccgaacaccgcggggatggccatcaggaagctcagacgtacagcggcctcacgcgtgtagcccagtgcgcgaccgacggtgatggtgccgccggagcgggacacaccaggaatcagcgccatggactggcccaaaccgaagaggaacgcatcacgatacgtcatatcattcatggttttgttctggcgagccttggcatccaccatccacagcagaatgccgaataccaacagcacggttaccgtaatccacaggttgcgcaacgaggtctcgatgacgttctgcagagtgaagccgaggatgataatcggaatcgagccgacgataatgttccagccgagtgtggcgtaattgtcgccgcggcccatgcgggccttccaatccttgccgttcttgccgaacaggcagctgaaccagtgagtaaggatattgatgatgtcgtgacggaaatacagaatcaccgcaagttcggtgccgatttggatgatggcggtaaacgccgcaccgggatcagagcccagcatcaaatcgccgaaaatacggatatgcgcgctggaggataccgggagatactcggtcagcgcctgaacgatgccgagaatgatcgcttggaaaaaattcatgacccctcgtgatttctaagtatttgatgtgttatgacgatgaacaccctatccaaggggtgtagaacaacactaagaatcggtaacatccacggcttctacaatgaaagtggatatagtacgtaagcgacgaagggagcattatggccacgtatcgcaaaagcagggcattcgcaccggaaggattcttcgaatgcgagggtcgaggactcgaatggttgggagcggctcatgcgcagggcggcccgcgcgtggtgcaggtatacggctggggcaaggattatctggatatcgaacgtgtgggcagcgcgtcccccacgcctcaggcggcacgagcttttggtgcggctctggcccatatgcatgatgtgggtgccgaatatttcgggtctgcgcctgacggatataacggcacatgctatttcggaccattgcaggacccagtgaaaatggataccggcgagtggaccgacccgatcagctatttcgctgatggacgtctgcgcccgatggtcaaccttggtgtgaggcgtggcgagctggataagcgcgatgtcgaactgaccgagcgcgtgattgaagcgttgccggatctgatgggccgagccgcgtccgacaagccggcgcgcatccacggtgatctgtggagcggcaatgtgatgtggaccgccgattccgggcagcccgaggctgtgctcatcgacccggcggcacatggcggtcatcgcgaggaggatctggctatgctgcacctgttcggcatgagctatctgagcgaaatcaccgagggctaccagtccgtgcatccgttgaaggccggatggcaggagcgtatcacgctctggcagctctaccccatcgccggccactgtgtcttcttcggcggcggctacgtcaacgaataccgctccatgtgccgctccatgctgaagtaacagacttggctcccctctctgaggggagccaagaacgcatccactctcagctcagcgcgtccttcaacttgctgaagaagcctttcttttggccagcctgtggacgggatgcctgggagacgtgcgtggcgcctgaatcgtgcgaggcggcgaactgttcgatgaggccgcgctcggtttcgttgagcttggtgggaatcagcacattgacgtgggcgatgaggttgccgcgctcgtccttgttgcggatgttcgtgacgcccagtcccttaagcgtcacagtgtcctcaggctggcagccggccgggatggacacggtcttctcaccatcgaacgtgtcaatggacagatcgtggccgagcacggcccagctcatcggcacctgaatccagcagtgcaggtcgtcgccatcgcgggtgaactgcttatccgccttgatgcgaatgtcgatgtacaggtcgccggcagcgccgccgccctcacccacttcgccctggttggccaaacgtagacgcgcgttgtcgttgatgccggcgggcacggtgacgcccacggtacgtgtggtacgcacacggccgtggcccatgcagctggggcacgggttcttgatgatggtaccgtggccctcgcaacgttcgcagggggcggaggtcatcatctggccgagcatggtgcgcacgaccttctgcatgaatccctggccgtggcagtcggggcaggtgaccggctgtgcgccgccctgggcgccggagccgccgcactcctggcacagggagaacgtgctgatcttgacgtgcgcggtgccgccgaacacggcggtcttcaggtcgatggacgcggaggccagggcgtcgcggccgggctgggtacgcggcaccgggccctgtgagccaccaccgaacgcggaaccgaagaacgtggagaacacgtcgctcatatcgccgaagcccgccccggagaagccgccggcaccggcgttcggatcgttcgggtcgacgcccgaatcatacatacggcgcttgtccggattggacagcacatcgtaggcgttgttcacttccttgaacttgtcctcgaattcagggcccgcgatgtcggggtggtacttacggctgagcttgcggtatgccttcttgatctcgtcgtcactggcgccgcgttccacacccagcgtctcgtaataatctgccacttgattgatcctttgtgttcgtttggtctgcgggtcattgtgccacagacggcggtcagtcttgggtccggccctcggagaggaaggcggtcaaatatctggctacggccctgacggcggccatagtggccgcatagtccatgtgggtcggccctatggagccgacgaaggcgatgggttccgtgtcgttcgtctggctctccgtctcggattcggtttcgggttcgcctacgggatcgttccccgccggttcgcccgccgcaccgctgcgcccatagccactgctgaccacggaggcatgcagtaggccgggagtgtgcatttcggagccgatggccacgcccacgccggatgcattcgtctcctcactcaggttgctcatgagcttcatcagcacgacctgttcttccagcgcgtcgaagagcggggccagatcggccagggaccgggagtgggccaggtgcgaggtgccggacatgtacagttcgtccgcgcgttcgtccaatgccatcgattcgaaggcgtcggccagcgcgtcggccacgccgcgcaccgactcgtagccggcgctggcggcgatggatcgcacggtctccgcggatttcgatagggacagtccgacacattgttcgttgacggtgttggagagccggttgatctcgtccacggcgggcatggatgcgatggtcaggccgtgctgggccacgcggccggtgtcagtaatcaccaccgcgagcaacgtggtcatggcaacgggcaccatctccacgtgccgcaatgtggccttggccagcgatggcgaggtgactatggccacttgaccggtgatttcggacaacagtcgtgccgaacgctgcagcgcgtccttgagactcaccgatccggacaggaagctgttgatgccgcggcgctgcgcctcgctgagcggcaccacggtagcaagtcggtccacaaagtatcgatagcccttttcggtgggcacacgaccggccgaagtgtgcggctgaatcagatatccttcatcctccagagcggacatgtcgttacggatggtggccgaactgacgccgagatcatggtcgcgcgtcagcgaagtggagcccacgggctcctgagaacggatgtaatcctccaccacggcgcgcagcaccagcatgcgtcttgattgcgtcatgcgcgcctccttatatatgcatacatattcatatcagtcacggttcactcagggcgtaccccgacggtcggttcgccacgccgcgacacgcgggaacccagaaatattgcctctttcttggctccgccacgtgcaggtggcgcacttcaccttagaacattgtattagcactccttaggcttgagtgctaatgcgttcgtttgcagcgtagcaatgttcactgtgaacgctaacagaacacaaactaccaaaacacgccaaaattgcaccgcaacgtcgcaaaccgacgctagcatggtaatcgcaatgtgagggcgtcaagcgcccggcacaagccggatacgcggcccgaccaattggaaggaaagtaatccatgaccgaattcaaggagaccgagctcgacgagcgcgccatcaagatggcgaaggtcctttcggctgacgcggttgagaaggcaggctccggccaccccggctcccccgtctccctggcgcccgtcgcctacacgctgtaccagcacttcatcaagcacgatccgaatgatcccaactgggaaggccgcgatcgcttcatcctttccggtggccatgcctccctcacccagtacgtccagctgtacttctccggctacggcgtgaccctggacgaccttaagaacttccgtggcggcgctgccacccgcaccccgggccacccggagtacggcctgaccccgggcatcgaaatgaccaccggccctctgggccagggcttcgcctccgccatcggctttgcctacggcgagcgtttccagcgcggtctgcttgacccggagaccccgaaggaagattccccgttctaccacaagatttgggccatctgtggtgaaggcgacatcgaggagggcatctccggcgaggccgcttccctggccgccaaccagaagctcggcaacctgaccgtgatcttcgacgccaaccgcatccagatcgaaggcgacaccaacctggtgctggccgaggacgtgctcaagcgcttccaggcctacggctggtacaccgacgagttcagcttcatccagcccgacggctcctacaaggaggacatcgagggtctggccgacgtcatcgccaaggccgaagccgccgccccggaccagccgaagctcatcaaggtccactccctgatcgcctggccgaccccgggcaagaccaacgacccgtcctcccacggctccaagctgggcgccgaggccgtcgccggcctcaagaaactcctcggctacgatccggaggagtccttccacgtcgacgaagaagccctggcccacgcccgcaaggtcgccgatcgcggcctggaggcccacaaggcctgggacgagaagttcgacgcctggcgcaaggccaacccggacaaggccgccctgtacgaccgtctgaaggccggtgaactgccggaaggcttcgacaaggcccttgacgaccttgaggccaccttcgaagtcggcaagggtgtcgccactcgtggcgcctccggctccgtgctcaacgccatcgccgccgtcatgccggaactctggggcggctccgccgacctcggtggctccaacaagaccgacctcaagggcgctgccaccttcgccccggccgagtgcgccaccaagcagtggccgaactgcaacgagttcggtcgccagctgcacttcggcgtgcgcgagttcaccatgggctgcatcaccaacggcatcctgctgggttcccacacccgtccgttcggcggcaccttcttcatgttctccgactacgagcgttccgccgttcgtctggccgccctcatgcagatcccgaacctgtacatctggtcccacgactccgtcgccgtcggcgaggacggcccgacccaccagccggttgagcaccttgcttccttccgcgcgattcctcagcttgaggtcattcgcccggccgatgccttcgagaccgccgaggcttaccgttacttcttcgagaagaagaacaccctgcctggcgccatggttctgacccgtcagggtgtcccggttcttgccgagaccgctgccaaggccaaggacggtgtcaagaagggcgcttacatcctggtcgacaccgagggtactccggacgtcatcctcatggcttccggttccgaggtccagtgggctgtggctgccgccaagaccctggccggcgagggcgtcaaggctcgcgtcgtgtccgtgccgtccatggaatggttcgaggagcaggacgccgagtacaaggaggctgtgcttccggccgctgtcaaggctcgtgtctccgtcgaggccggcgttgccatgccgtggtacaagtacctcggttcctacggcaagcctgtctccatcgagcagttcggcctgcagggtgacggcgctcagaacatgatcgacctcggcatcaccgccgagcacgtggtggaagccgccaaggcctccatcgccgaagtcgaagccgccaagtgagcaactaagcaataattcaataattgttggctcccctccctgaggggagctgtcaggcgaaagcttgactgaggggagcaatgcttgagcccactcccctcagtccgcgttgcggacagctcccctctcccaggagaggggagcctagggcttgaatccaaggagaaaataaatgactgaagcaactcagcgtacgtctgacaacggcgtttccatctggctggacgacctgtcccgctcccgcatcgagtccggctccctgcaggacctcatcgccaacaagaacgtcgtcggcgttaccaccaacccgtccatcttccagaaggccctgagccaggtcggcccgtacgacgctcagctcaaggagctcggcaaggttgacgttgagaccgctgtccgcgagctcaccaccaccgacgtgcgcaacgccaccgacatcttccgcgagatcgctgaggctaccgacttcgtcgacggccgcgtctccatcgaggtcgacccgcgtctggcccacgacaccgagaacaccgccaagcaggctgtggaactctgggagaaggtcaaccgtccgaacgccatgatcaagattccggcaaccctcgaaggcctgccggccatcaccgccaccctggccaagggtatctccgtcaacgtcaccctgatcttctcgctcgagcgctacgagcaggtcatcgacgcttacatcgagggcatcgctcaggctgccgccaacggccacgacctgaagcacatcggctccgtcgcttccttcttcgtgtcccgcgtggacagcgctgtcgacaagctgctggaagccaacggctccgacgaggccaaggctctggagggcaaggccgctgtggccaacgctcgcctggcttacgaactcttcgagaagaagttcgccgaggatccgcgttgggccgacctggctgccaagggcgccaaggttcagcgtccgctgtgggcttccaccggcaccaagaacgccgcctactccgactgcaagtacgttgacgagctcgttgccaagcacatcgtcaacaccatgccggagaagaccctgaacgctctggccgaccacggcaacggcgctccgtccatcgagggcacctacgaagagtcccacgccatcatcaacaagctggctgagctcggcatcaacctcaaggacgtcaccgacaagctggaggccgacggtgtcgctgccttcatcaagtcctgggattccgtgctggctgacgtccagtccggcatcgaccgcgtgaacgcctgagatttgacgactgatgcgtgtttagcgcactagttgattagatcacagaagccccgaccccaaccggtcggggcttctttcgtttgttgctacagtggtacgagcatatgagagaaaggccgaaccgtaatgaacaaacttgtcgcacgccagcggttggtgatgaccttcaccttcttttcgatgttcttcggagcgggcaatctgatttttccgccgttcgtcggcgctcaggccggttccgcgaccataccggcggccatcggtttcatcgtctccgcagtcggcctgccgattctcggcgtgctggcggtcaccttcgccggcggtttcgacaaactcgccagccgggtctcccccaaattcgccttgttcctcggcgtggcgatcatgctcaccatcggcccgtgctttgcgattccacgtacggcgaccacctcattcgaaatgatggtggctcctttcgtaccgtcctcctatggctggctggcccaactcatctactcgctcgtgttcttcacactggcgttcctgttcgcccagcatcccgagaaactctccaaagtgctcggccgattcatggggccgttgctgctggtgctcattgctgtcctgttcatcgcctgcctgatccacggcatcggcatcccggccaacccgatgggcgactactccacaaaccagatcgcacgcggcttcctcgacggctaccagaccatggacctgctcgccgcgctctacttcggcatcgtgatctccgcgaatatccgcgcccaacaagtcgatgacgaatcgcaagtgcagaaggagaccgcgtatgccgggctcggcaccggcgtactgctgatcgtgatctacggcgcgctaagctacgtgggcgtggtgtccggagccatcgccaccatcgaccccaccaaagacacgggcgcgaccgtgctcaccaacctcacctcctccctgttcggcacgttcggtaccgcgttccttggcgtcgtgttcgtcatcgcctgcctcaacgtatgcaccggactgatcggcacctgcgccacctacttccatactcggttccggaccgtcgccggccgaacgttgagctaccgcacctggcaggtcatcttcaccgtgttcagtttcatcgtgtccaatgccgggctgagcgcgatcatcaaggtttccgtgccggtgttgtccgcactgtatccgatcgccatcgtgctggtactgctgacgctgacccacaagtcgctcggcgcgcgattcccgcgcgtctatttctggactgtgctgctggtgggcatcgcatccttcgccacctgcatctccagtttggtcgccgtcttcggcggttccatcggctggctggacgcggcgctggctatgctgcctttgcagcaataccagctcggctgggtggtcccggctatcctcggtgttgccattggtatcgccgatgctccgcgacggtagttttcccggtctgtgccggagtctggcggtcggtcggtgatggcggctgccgcagtatccctcctataaagcggcatacagaattcctgtatgccgctggtctccgcccatctgccatagttatactggcatcatcgacgacggcgataacagcataaggtggggcgagtcatggacaccagtgatagacaggtagcggaaaccggccggaatcgcgagcttgggctgattccggccatggtgatggcggttgttgcgacgctcagtggtgccggtgtatcgttcgcgccattatatgagcgcatttggggcggcatgatgttgcatccgaattgtccggcgattggcagaatgacctactatctctcgggccaagcaactgacgattatggagcctgcgtcacctcaccactgtggtttatgacggtgactgcgctgagtgttgtcgcgattctctgtctgactgttgcgggagtacagggcttttcgcgccatcggctctgttcggtgtttagtgttcttattgcggcagtggctgttgcaatcatattggtgttgagtgcgaataccaagattgtaacgttgtgggcgatgtatgcggtgacgtggctggtgcacgccatagtcacctcatatctgagcaacggttggatacgaatcgcgcgactgttgttcgtatggcagattggcgtgatgccggtattcgtcaccgaatattcagtatccgacgaggtcaacttcagcggcggcgcaaccatcgcttgcggacttggacttgcggcatatgcgctggtgcaatacgcctctcttaccatcgactcgcaaaacaacagtaatcgaatcacgccagaacgcagtggtatacgggctacctccttgcacgacctgttccacaccatcagcatcaacgcatccgccatacgcaattgctctgttcccgttgccctgttctggtcaggtatcacgttctttacctacagctacaacactggtagacacaccgatttctgcccagcgctatcggcaactgacaatgcaggtcttgtcgcttattgcatcggccatgaagctttgggactgctgaccgtcgtgttgtgcgtgctgccattgttctccctgctttcggcgattacggccatcacgttggctgcacgcaacgcaaataacggcggtaacgctgccaatgccgatggctctcgaaattcagccgccgtgtgctatctgctcctggcaaccgcactgtccgccacggccttcgtcatcgccttcaccttggcatagcgcggaccaccatgccgcagttcgcgcgatcgctgggatacagcgcttcctgcgcacgacgcgacaccaccggcataagatctcctttatatcacgaaacaatcgagcgtgttcgtttgcgccaaggatcagctctgccagtagtagctgaagaagtcggagatctccccatggtttcgcgcagcatgcccatgcgcggcaggtacaccacgcggaagtggtcggggcgatgccagttgaacgcgccgccgtggctgatgaggatgtgcttgtcatgcagcaggtcgagcgcgaactgctcgtccgagtggatgttgaagcgtttgacgtcgatcttcgggaagatgtagaacgcggccttcggcttgacggcggtgatgccggggatctggttgagcatgtcgtagacgaggtcgcgctggtcgtgcacgcggccgcccggcacgatgtagtcgttgacgctctggtggccgccgagcgcggtctgcaccacggactgggcgggcacgttcgaacacatgcgcatgttggcgagcatgttgaggccctcgatgtagtccttggcaatgcgcttgttgccggacaggatcatccagccgatgcggtagccggcgatcatgtgcgatttcgacaggccggagaaggtcacgcagaacaggtccggggccatcgaggcgatggagatgtgctgcaggccgtccatgacgaggcgatcgtagatttcgtcggagaagatgatgagctggtgttcgcgcgcgatgtcgacgatctgctggagcacttcctttgggtaaagtgcgccggtggggttgttcgggttgatgatgacaatcgccttggtgttgctggtgatcttggagcggatgtcgtcgatgtccggataccattcggactgttcgtcgcacaggtagtgcacggcggtgccgccggccaggttcacgcaggcggtccacagcgggtagtccggggatggcacgagcacttcgtcgccggtgtcgagtagcgcggacatggacaggttgatgagctcgctgacgccgttgccggtgtagatgtcgtcgatggtgacgttcgggatgttcttcagctgcgcgtactgcatgatggccttgcgcgcggagaacaggcccttggacggcgagtagccttcggtgtcggtgagctggtgggccatgtcgtagacgacttcgtccggcgtgcggaagccgaagggtgccgggttgccgatgttcaatttcaggatgtgggtgccgttggcctccatgcgcatcgcctcgtcggcgaccgggccgcgcacgtcgtagagcacgttgtcgagcttgtgcgatttgccgaaggtgcggcggcggcccacgggaatctcgctgtccgtctggggcttggaggcacccgtggcaagcggtgtggcggcgtgttcgccgtccgtgacgctgttggaggcgtccgagttcaattgcgtggtggattcctctccgcgcagccagttcatgtcgacgtccagttcgctggccaggaattcgagcacgtcctcgcggggcatggtcttgccggccacgtattggctgatgtggctcttgcccatctttacaccacgatgttcggcggcgtgcaccaaatcgacctgcttcagtcccctgctgttcatcgcattgcgcagacgttccgcaaacaccgatacgctcatatccttatgcctccaaccgggagttcaatttatcttttgaacaacggttcaaagcatacccccggttcaacacaagttcaattttggcgtgttctcgagtctcgaccggttcagcccaactgcgcttcaatccattgggcgacgccgtcctcgttgttggacgggcagatctcgtcggcgatggacaacaccttggggttcgcgttggccacggccacgccccggccggattcgctcatcatgttgatatcgatgaggtcgtcgccgaaggcggctgtctgttcaagcggcacgtccagtcgctcgcacagcaggtgcagcgcgtgctccttgttggcctgcgggttcatgagcatccacatcacgccttcgctgatggagatgtcgaagtccggcggaatcagcgcacgcagctcgttccactgttcaggctcggggaagatggtgatcttgtccgccacgccttcgggcacgtcgtggaagttcgtgtattggaaggcctgagttttccaatacacgcgcacatcgaagttggtgtagcgcacgtcgttcatcacgatgccgagcttcaggccgggcatgcgatcgagcaggaacagacagacttcgcaggcacgccgtgaggagaagccaatcttgatcaaatggttctcatcggccggcgtggcacctgaggtgagcaggtcgaagtcggagtgggccgggtcgaaatcgatgagggcgccgttcagatagattacggcgtccaccggcagtttttcggcgaactggagaccggtactcaccggccgcgcggtggcgatggcgaattgcattccggcatcgtgcgcgcggttgatggtgtcgatgctgcgctgggtgatgaaccggtcctcgaatacctcggcgtcgtgcagcaacgtgccgtcgaggtcggcgaccagcagtcggggttgtttcggcgtgatggcgtcgagaatcacagcagcccctcgcagtgttcacgcacgagttcggcggaatggtgcagtttggcccgctcgtcctcgctcagatcgagttcgacgatctcgttggcaccattggcgcgcagttcagtggggacgccgaggaacacgtcatgttcgccgtattcgccgtccaacagggtggagacgggcacgatgcggcgttcgtcccacaggatggtctgtacgatgccggccacggtggaggcgatgccgaagttggtgccgcccttggccgcgacgatctcattgccacgggtgcgggtcttctcttcgatttcggtggtggacacagaggcgaaacggtcttggttgtcggccaggaagcgggcgaatggcttgccgccgagcgagacggtggaccatgcggtgaactgggagtcgccgtgctcgcccatcacgaagccgcccacgttgcgcgggtcgaggccggtctcttcgccgatgatggtcttgagacgcgaggtgtcgagcgcggtgccggtaccgagcacctgggtgcgaggcagaccggaacgtttccaggcataccaagccatcacgtcgaccgggttggagaccatgacgatcacgccgtcaaaaccggaggccatgacgttgtcgaccacttcgcccacaagacccacggtgaagccgagttcggccatgcggttggagttggccggcggcttgcggcccacggtgatgacgacgatgtccgcatccttgcagtcggcgtagtcgccggcgcgcaccttgacgtggcggtcctggaattcgctgccatcatcgaggtcgcgggcctcccccagggccttggcggcggaacagtcgatgagcacaagctcattgcacaggccgtgcgtgacgatgccgaaggcggcggtggcaccgacctggccggtgccgacgataacgactttgttgcggttcatagtgaccatggtgatgtcctttcgtaatactcgatagaacgcatacgacccatgaccgacggtaacggtcatgggtcgcgagcgacaagtctatatggcgtgcaagccgatcagccgaggttgaacttggtcatcatgtcgaggccgataatcaaggccacccacaccagagcgatgataacggtccaacggttcaggttcttttcggcgacaccggaagtaccggcgttctgggtcagaccgccgccgaacatgtcggacaaaccgccgcccttgcccttgtgcataaggatgagcagggtcagcacgaagctgagcagcacgacgatgacttgcagcgtgatcttaagagcggtcacagggtacctccggattgattggactgttgaccagcatagcgcacacacgggaaaaccgtggtattagttccgtgatttcgtggatttcagtgccagtcgagcgattttggcgagttcctcaacgtccagggccgcccctccgatcaggaagccgtcaacgtcgggctgggaaatgagttccgccgcatttttcgaggtgaccgatccgccgtacaggatacgtatgctatcggataccttcgtgccaaaagtggtcttcaaatcgttgcggatggcgtttgcggcatcctgggcggattgcggagtggccaccatgccggtgccaatggcccagacaggttcgtaggccacgatgagtttggcggcttgttcttcgttgagatcgcgggtgacgtctcgtacctggcccacggcgaaatcgagttcaatgccttgacgtcgttcctcgaagctttcgccgacgcacaaaatcggctgcatgccggcggcgagcacggcacgtacctgatcgacgatattggcgtcatcttcaggatggtatttgcggcgttcggagtggccgacgatgacgtatgagcagccgagatgggcgatcatgtccgcggacacatcgccggtgaaggcaccttgggtggtcacggaaacggattgtgcgccgtaggcgacatggagcttgtcggcttcgaccagcacctgcacgctgcgcaatgacgtgaacgaggggaaaagcgcgacttcgcagcgtttaaagtcgaagtgagcgtcacgcaacagccataccagcttctgcacgaagtaagtggcttcaagatggtcgaaattcatcttccagttgccggccaccaacggaatgcgtttggacgccatatgtttcccttctaaaaaacgtagctcccctcaaggaggggagctagaaaatggattactcaagcaccttcaggccagggagctccttgccttcgaggaactcgagggaagcgccaccaccggtggagatgtgggagaagccgtcctccgggaagccgaggttgcgcacggcggaggcggagtcgccgccaccgacgatggtgaacgcaccggctgcggtggcgtcgaccagaccctgggccacggccttggtgccggcggcgaactcaggaacctcgaacacgcccatcgggccgttccacacgacggtcttggagtcgacgatcttgtcgtggaagagcttctgggactccgggccgatgtccagacccatcttgtcggccgggatggcgtcggcggcaacgacttccggagcaaccggggtgtcaccggccgggaagccggcgttcacgacgacgtcggtcggcagcacgagctcaacgccgttcttctcggcggtctcgatgtagcccttgaccttctcaagctggtcctcttcaagcagggaggtgccgacctcgtagcccttggccttgaggaaggtgaacaccatgccgccgccgatgaccagacggttggccttgtcgagcaggttctcgatgacgccgagcttgtcggagaccttggaaccgccgagcaccacggtgaacggacgctccgggttctcggtggccttggacagggccttgacttccttctcgaccagcaggcctgcggcggccgacagatcggcggcaacgtcgtagttggagccctgagcgcggtggaccacgccgaagccatcggaaacgaaggcctcgccgagggcggcgatcttcttggcgtaagcggcgcgttcgtcggcgtccttagaggtctcctccgggttgaaacgaacgttctcaagcagcacaacgtcgccatcgttcatggcggcgaccttggcctgagcgtcctcgccgtaggtgtccttggccagcggcacgttggtgccgagcagctcgccgaggcgggcggcaaccggggccaggctcagctcaggaacgaccttgcctttcgggcggccaaggtgggccatgaggatgaccttggcgccttcttcgcgcagggtcttgatggtcggcagagcagccttgattcgaccgtcatcggtgatggtggtgccgtccagcggaacattgaaatcagcgcgaaccagaacgcgcttgcccttgagatctccaaggtccttgagtgtcttcatgaatatcctttccttgacgaatcgcacgtcaaagtggccaattttgccactttgcatattacaggcattccggaacaaaacaccgcattcgtctactgactgaatgcggtgttttgtcacatcgttgtcgcgttttgccgaataggcacggcaaatcggattgtcgggttacttgccttcggctgcgcgagccttctccgtcttctcggcaagttgaagcagtcggcgaattcggccggcaatcgcatccttggtgatttgcggttcggcgatcttgccgagctcctcgaggctcttgtccacgtgatcgatgcgcagctggccggcctgacggaggttgtccggaatgttatcgccgagtacttcgaaagcatgctgcactttttcgctggcttcggcggcggccttggcggaacggcgcatattggcgtcatcgaagttggccagacggttggccttgccgcgggcctcgccgtcggagcgcttgccggtccattcgcgggccgaacgggtggcgcccatgagcttgagcatgcgttcgatggcgtcgggatccttgagtgtcacgcgctcggagctacgcagcgtgcgatgcttggcctggatgcctagacgacgggccacgccacacagggccatggcggcctcttccgtggggcaagcgatttccaggaagctggccttaccgggatcggacaggaagccacgggccatgaaggcgccgcgccatgccgctttgatttgggcgatggatccgttgaccacttcagacggcagtccacggacctgctgcttgcggcggtcgaccagtccggtctgcaaagccaaggccactacgttgcgggtgacgagcaccacataggtctcgacagggccgttcggggtctgacgtgtgaggtgattgacctcggcttcgtgcccgaacgtgttcctcaacgtgttcttcagccattctgcaacgtcaagcgaggtgaatacggcttggataacgtatgtattctgtaccggtcgaagaccgccgccaaaacggatcatggccgcagcttgggccttgatcgcggctggcgaatcgccttcaaaggctgccaactcgcttttgacatcgtccagaagagccaagatctacctcctacagtcccgttcttctcaatgcttcaggcgcttcgtgccgttatctgctgtcacacggtcggaagccatcggctttctgtgatacctaatctggtggacaagcgaacccgtttgatacgtattatgggctctgctttctcgcagtgtggtcaccgaacgcttgcccgatgaccgctcgacgcctgcttacgatgagtgacgcttgtgctgttctctcgcggaaacggttacgttgagcccatgtgcgcgtaagcggcgagccagctcttcgctcatcgccaccgaccggtgctgaccaccggtgcagccgacggcgatggttacgtagtgcttgtcttcctgggcgtatccttccaacgcaatctcgatagctttctcataagcgtcgagaaattccttggctcccttgctggaaagcacgtagtcggcgaccggcttgtcgtgcccggtaagctcgcgcaggctgggcacccagaacgggttgggcagaaaacgcacgtcggccacgaaatcggcgtcgatgggcataccgtatttgaagccgaagctgaagatgtgtactgccacggtggtggggccggagccgagcatcgcctcgtagagtttggtggacagctggtggatgctcagggagctggtgtcgatgacccagtcggctcgttccttgaggtcttccagcaggtgacgttcctcaaggatgccgtcgaccagtcggttgccgtgctgcagcgggtgcgggcggcgcacggattcgtagcgcttgatgagcacttcgttgctggcgtcgaggaacagaatacgggttttgacgccgagatcatccagatggccgagcacggcggccagctcgtcgaaatagctggagcgcacgtcgatgacggcggcaagcttgtggacgcctgactccgatccggaaccggaggtggtcatcatgtcgacaagcgggataagcagtttgggaggcaggttgtcgaccacataccatcccatgtcttccacgcagtcagcggcatgagagcggcctgcgccggacataccggtgatgagcagcacttcgaaggcatcaagcggggtcggctggttgtccggagtcgatgtggatgtcgcggaattcgccggcgcattcgtggcggccgcctcgccggtatcgcggttcgttgtctgttgattcattacagcgcctcctcaagagctttgcgcatcgcgatctccagctggtcgtcttcggtggtggtgtcctgcagacgctggtcggcatcgctgggcgggtcgtcatcccagataccggtcatcagcaatacctgtacgagagcttggtacagcagcatttcttcgccgccgatggcgtgaccgccatgagcgcgccaggcttccatgagcttggtggggcgtggatcgtagatcacgtccaacagcagtccggagaatggctcggttccggcatcggcgagggcatccgcgacgttgtcggccgcgtgtccgggaatcgtgttgatgacataggtggcgttgcgggctgcctcgagcagggcctgatcgtcgcctaattcgatttcgttgtacgggttatgcacgttgacgaacttttcggccactggtttaagcccggtgttttttccggggtggcgggcggcgacgacgatatggccgatttcgggcatcatgcagcatgcggccaacgccgaagtggcggtgttgccattgccgatgatcagcgcggtgccgcttctcgacgcggtgtggtgttcgccgagttcgcgattggcatggtcgaaggcgagttggatgccgatgacatcggtgttgtatagcttgatgcccggcttgccgttcggccaagcgggatcatcggcagccacgctccagtcgaataccgcggtattcgccaccttcagttccttggcccacaaattttccggaacaccgtacggttggatggtcttcttcaacggcatggtcaggctcaggccagcccacgtcgagtcaaggcctttgaggaaagcgtcgaggtcgtcttcccccacctcgtgcttgtcgtacagccaatcgtcgagtttcagcgaacggtaggccgcgttgtggagcacgggtgacaatgagtgtgcgacgggtttgccgagtacagcgcaacgatgattggccatatcccctccttgatgtctgttcccatgctagccgacactttgcttcgaatatgtcaaccacaggccccgcaaccgaaaatttactctgggctgctggaccgggccggctcactgctcgtgcagcgcggtgtacagcgcttcggctttggcgtggccgatgcctttgaccttctcgaagtcctcgacactggcttcgcgcatggctttgaccgagccgaagtggttgagcagccgcttctggtagctttcgccgatgccgggaatctcgtcgagcgcgctgcgcagggcgcctttgcgccgctgctggcggtggtaggtgatggcgaagcggtgggattcgtcgcgcacacgctgcagcagatacatgccttcggactggcgtttgaggatgatcggatagtcgtcgtccggcacccacacctcttccaagcgtttggccagtccgcagacggccacgtcgttcacgccacagtcctcaagcgccttggcggcggccatgacctgcggcttgccgccatcgaccaccaccaggttcggcttgtaggcaaagtgatgccggtttgtgttctgctggacgatgtcgggcggggactcccgcgcatcgttctgcactccgaccggcaccgcgtgccccttgccactgatgccggaaccgccctcaccattgtcgttaccgttcgcagcgattgtctccgccgccacggcagtggtcatcttgccggcggccgaggccacacgctgttccgcgtcgatgctttcgccggagtcgccggcgatgttgccgtgcttgaagcggcgggtgagcgtctcgtaaagcgcggacagatcatccaccgcgcctttgccgtccttgcctcggatggcgaagcgtcggtattcggatttcttggcgatcgcgtcttcgaacaccaccatggaggccacctggaaggcaccgcccacagtgttcgaaatgtcgtagcattcgatgcgcagcggggcttccgcgagtcccaatgccttggccacatcgttcatggcctgggtgcgtgcgcccatgtcggagatgcggctcatcttgctgcgttgcagtgcttggctggcgttctcgttggcgcggtccataagctgcttcttgtcgcctcgcgaggccacacggatggtcaccgctccccgcgcagattggtcagccagccttcgagttcctcacggcgggccggttcgacgggcacgatgatttcgcgcggtaccggtgcgatgggtgccagcaggtccgcgcgcccggtggtctcctgacgggtgttgcgttctcgggtggcctgggcgcgtgccacagcgtccgtggccgtgatggtttgcgtggagccgatggcctcgcgattagtggagatggtcgcggccgactgggggtgattgtccccggcggcgtccgaatacacctgcaccagaaggtcggccatcaagtcggcgtcatcgatgtcctcaactcgttcgacgctccagttgcgttcgccgcgaatcgagccggcgcgcacataaaaagcgtgcacggaggcttcgagctcgtcgctggcgaagccgaacacgtccgcgtccacatcctggtcgaagacgacggcgttctgttgcaccacggtttccagcatttggatctggtcgcgcagtcgggcggctttctcgaattcgagttcggcgctggcctctttcatgtcgcgggtcaactgggcgatgtatggccgtccgagtcgtccggtcatcacaccgaccagctgttcgcacagcctccggtgttcgtccgcttcaatgcggttcacgcagggtgcggagcatttgccgatggaagcgaacaggcatggccgtccggtcagttgcgccttatggaacacgttggtggtgcaggtgcgtaccgggaacgtgcgcagcaaccggtcaagactgtgccgcaattcccacactttggcataggggccgaaataccgggtatcccgccgtttgcgcgaccgcgtgacccacacgcgcggaattcgctcccccgtgctgaccgcgagatacggataggtcttgtcgtcgcggaactgcacgttgaaccgtgggtcgaattccttgatccacgtgtattccaacgtcagtgattccagttcggtggcgacgaccgtccactccaggctgcgtgcggtcagcaccatggtctgcgtgcgcggatgcagcagatacagcggctggaaataattggtgagcctgttgcgcaggttctttgccttgcccacataaatgacgcgcccttccccgtcgcgccatttgtacacaccgggtttggcgggaatatccgaggtcttgggtcggaacaggtcgcgagaatcccccagcaaaggtgccccattcgcattcaccttcgccgtcgtttccccggcacccacagctatgctttccgacattaacgccgccgcagtcttccgccactcatccggactatgccgctcaatatcgttcgtcataatcctcctcgctattaagcaaaaccaatcatcagggattgggtgggttggggtgtgtgttgctggaccgtaaagacttgacctgagcggcccggagcatgtccagcaacaaacaccccaacccacccgaggtcagctgcaatggaaggctaaagcatgggtttcaggaacttgccggtccatgaggcttcgcattcggcaacctgttcgggcgtgccctgcgtgacgatggtgccgcctccgtcgccgccctccggaccgagatcgatcagccagtcggcctccttgatcacatccagattatgttcgatgacgatgaccgtattgcccttgtccaccagggactgcagcaccttgagcagcttgttcacgtcttcgaagtgcaggccggtggtcggctcgtcgaggatgtacacggttttgccgtcggatcggcgctgcagctcggtggcaagcttgacgcgctgcgattcaccgccggacagggtgggtgcgggctggccgagtcggatgtagccgaggccgacgtccacgagggtcttcaggtatcgggagatgccggtgtacgccttgaagaagtcggcggcctcctcgatgggcatgttgaggatgtcggccacggtcttgccgttgtacgtgacttcgagggtctcgcggttgtatcgtttgccgtggcagacctcgcagtccacgtagacgtcgggcaggaagttcatttcgatcttcagcgtgccgtcaccgtggcaggcctcacatcggccgcctttgacgttgaaactgaagcggccggggccgtagccgcgcacctgggcttcgggagtcttggcgaacagggtgcggatcttgtcccacacaccggtgtaggtggcggggttggatcgcggcgtgcggccgatcgggttctggtcgacgtggatcaccttgcgcacctggtccacgccttccacgcgcgtgtggcggccgggtacgatgcgtgcaccgttgagcttgtcggcgagcaccgggtagaggatcgtgttgaccagcgaggatttgccggagccggagacgccggtgaccacggtgagcacgccgagcgggaagctcacgtcgatgttcttgaggttgttctcgcgggcacccacgactttgagcacctgggtcttgtggatcttgcggcgcttggcgggcacggcgatctctcgccggtgggcgatgtagtcgccggtgatggagcgcttggcttctatgaggtgcttggcggggccggagtagatgacttcgccgccgtgttcgccggcgccggggccgatgtcgaccacccagtcggcgcggcgtatcgtgtcctcgtcgtgttcgacgacaatcagcgtgttgccgagatcgcgcaggtggtgcagggtttcgatgaggcgttcgttgtcacgctggtgcaggccgatggacggctcgtcgagcacgtacatgacgccgaccagaccggagccgatctgcgtggcgagtcggatgcgctgcgcttctccgccggacagggtggcggccgcgcgcgagagggtcaggtagtcgaggccgacgtcgttcaggaagccgagtcgggccttgatctccttgagcacttcgccggcgatcagctgtgccgagccttcgagttccaggccgttgatccaggcgagttcgcgtacgacgggcatgtcgcacacgtcgaagatggattttccgtccacagtgacagcgagcacttcgggcttcagacggcgtccgtggcagacctggcagggcacttcgcgcatgtacgactcgtagtattcgcgcatggactgcgaatcggtttcgtcgtggcgtcgcatgagcgtgcggatcacgccttcgaagccggtggagtattcgcgcaggcgtccccagcgattgcggtaggagacgttgaccttgaagtcgtggccgtagaggatgtcgtgcttgacgtcgtccggcaggcccttccaaggggtcttcatggagaagcccatttccttggccagaccttcgaggatgtggccgtagtactgggaggtcatcttggtgccgctccacggttcgatgacgccgtcggccagtgacttgtccgggtcggagatgatgaggtccgggtcgatttccagtttgaagccgagaccggtgcaggcggggcaggcaccgtagggggcgttgaaggagaaggtgcgcggctcgacctcgtcgagttcgagcgtgtgcccgttcgggcagctgcggtgttcggagaacggctggcggcgggccgggctgccttcctcctcgtccacgaagtcgatgacgatgctgccgttggcgagcttgagggcggtttccaccgagtcggtcaggcgttggcggatgccgtccttgaccacgagtcggtcgaccacgacctcgatggtgtgcttcttctgcttggtgagtttgatgtcgtcggacagctgcgtcatctcgccgtcgatgagcgcgcgggcgtagccgtcggagcgcagcagctcgatcatatccacgaactcgcccttgcggcccttgaccacgggcgcgagaatctggaatcgcgtgcgctccgggtagccgagcagtgtgtcgacgatctgctgcggggtctgggaggcgacgggctcgccgcattcagggcagtgagggatgccggtgcgggcgaagagcagtcgcaggtaatcgtagatttcggtgatggtgccgacggtagaacgcgggttgcggttggtggtcttctggtcgatggagacggccgggctcaggccctcgatgaagtcaacgtcgggcttgtccatctgacccaggaactggcgggcgtaggcggatagggattcgacgtagcgtcgctggccttcggcgaacagggtgtcaaacgcgagcgaggatttgcccgaaccggacaggcctgtgaacacgaccatgcgattgcgcggaatcgccaggtcgacgttcttgaggttgtgttcgcgcgcaccctgaatcgtgatcttgagatcgttcgggatgtgcgagatatcagctaccagcgaaccatcgtgttcaatcagcggcgcctttttgatctcccggctcaggaaggagtcgctggtcatcaccttttcgacgatgacctcaccgttcttgcccttgccggttttcgcgcccgttgcgcttgttgcgcgccttgcgccagtctgcattgccgccacagccacaccccaccttccatctcaccgttcccgcgcgcacggtcatgcgcgcgccaaatctgtcccaaggatacccgaacacacgaccaaattcgaacgcttgttcgatggcgtgtcaggccggaaaactgaaccagagtatgcaaaattccggaccatcagtggaccgaaacgcaagagccggcccccaagatactcggggcgtccggctctcacttccatttccccagcggggttggcttaccatgaagtatacacggttttaggacatcaatcactgtcgatgaacactgttcgaacatggccgaggaattcatcgtatcttccagtaccggcctgggcatcaccgtacgctcctagcagctgatcagggagccatagccttgcatcagtctcccctgcacagagttcgacacgaattggcccgataaatctgcggcttctcaatccatcgatgaaacggatatcgttcctgtcctgtgaaatctcgcgccgttcaagcacaagcgtgtccacgttgtattctgtttccagcagaggcagaagacgttccaaacatttacggcgagcgcgttcggcggtattccactggctcattggtaccgcagccacaatgacatgatcaatgtccattgcagccatggcatcaacgactttgccacgcaatgatggccgcatgtctcgccagtgcaatttccttgctcctttgggcttaagcaacgccaatctttgccttgtttcggtttccgtatcatcacatacgcatgcgcccatcaagtacataggcgagggaactccggttttccgcacactctcgtcaccccaagcggttgccatgtttgtcccttctcgcgcaacgcaaaacaacagttcgatagtatcggatagcagtgccggaccttgcagctatgcaatgccgttgcattattaatcggaaggcataatgtgagacgagaaaaagctaagccgttctagctcttggcaacatccccaatcactcagcctaaatcggcaaatcctgattttcaatggactccacggggatgccaagcttgcgtaattcgtcaactgcatcacgcatgggaatgcgttcctgttcgatgcgccgataagcgatggttttgtcagcacacagtcgttcataaagacgtcgctccgccgattgaaggccgggcgtcggcttaggctcccgcatagcaatcttcgcgctgcgttcagtacgatcggtaccaaatctgtggtaccgatcgtatgcatcgcaatccatcaggatggagtcgcattcgatacctgattcacgtaatgtcgaaagtatttccagtccatccgcatccatatcaccccaatacacgatacgcatgtcacgcagtgcaggaaccgcaggtacagcatcgcttacagcgcgaccagaaccccatatgcagatgccctgcgcaatcggcggcatagtctgatacgtgtctttgttctcaacgatgacagcatatttaatgccggataacgcttcgccttcccacggacaccatatgatgcgttcgagctcagcatcgtcgcggaccggatcgagataacggaaccgcagttcggtcggccgttttgacagacccaacgtttcgacaccgagcagtcggcaaatggccttacgacgattggtttttgactcattcagccatttgccgctgaatcctgtcagtggaatctgtcgcggcgtcataccggtcacgtcatgatgcctgaaatatcgaactgcgctgacaagcagatcgaagtcgtcaggctgttcatggcctgtcatgcgagcggccgattcgattgtttccggagcaacgtcacaagcagcaaccagacatgctatgcggcggcgcgcttcgcgacattccgccgccagcgtacgaccaaccacacgcatggctattgattcgtcaggaacgacgactttggagatcagctcgacagaggtgcctatggtgcgatgcttggttatgatttcgcaaccattcttgcttgcccattgccgtatctcattgttgttgtcatgcaccgcaatcgcattggtttccaaaaatgcttggtccggcaatcccaccggcacgggaaatggccatgccggttcgatgtcgtacatatgtgaacgcatatgtttcttcacgcatgtggtgatcgcagcgatgtctttcatgccggccatagttcccatcacctgctttcgaacatcgtcgagtcgaaccgaatcgtcttaataccggcgacgccaggactgctcattcggcaaccccgtcatccttcaatatatccgacgatgattcatcgtccatgtcattctgatgcagcacggcctcgcgcagggaggtgaggccggtgtcggggtccttgtaggtcacgtaggccttggtggagacctcgaggatttcgccggtcttgctttccggggcggagacgatgacctggaatccgaggcgcggcagcaccgtgagggcgcgctgcgtgtaacggccgtcggccttgatgagcgcctcgtcgaggaacagcgtggtgtacgagggctcgctggtcaggccgccgccgagcaggtagatgagcgccgcgccgtatacgaatgaggtaagctcctgcaaggcgccgcccgaacggccgccggtggaggtgatgcgttcatccgggccgtcggcatgatgcacgatggcgtagaaggacgagcggcaacgcgggtcgaggttgcgggcgccgtagcttttcacgccgttcgcgtccttgacctgcgcgagttcggcgcgcagcagcccgaccatcggcgcgcaggccgcgaaagccttgcgcgaggcgtcggaatcgttgacgtcggcggatttccaatcgttcagggtgccgatgacgcggatgaactgcgcccagaaggtgcgctcgggacggcgcacgtccgcgtgcagggacaggctgccgtgcttgggaccgaactgctggcctttgagcatggcgttgatgcggtcaagctggtcgtggatgtcgctggcatccgtgtcgatggcgcgtttgatggtcaggaagctcctgagcagctgttcgaggcagcgccggtattcggcgtcggtggcggcaaccgcggccagctgggtgaggctggcgagttcgtcgagatagtaccggtagtcctccacgctggcggtcagcgaatcatcgtcggccgcgtagagcgcgatgtaggtgctcattttcgattcgacgccggtgcgtgcggcatcggcctggccgttcagcaggttgatgcgggaggccatgtccttgccgatgccggcgatggtgcgttcggggaagctctcccccggagcctgcgttcctgccgcgcccgcgccgatgatcatgtgcgcgcgcatggcggcgtccgccagtccggcgaatcggttgtcgtaggattcggcgagcgccgccgtgacttcgtccggcagcgggccggacgcggcgtcatcgtcattgtcggcggtggcaccggcggcgtccgtcgtgccggtgtcggcatggtcgcgcagccagatgagcgccgcttcgacggcgctgccggcgcgggccgcggcctggtcggattcgatgcgctggcgttccacacggtcgagttcggcgttcagttcgtcgcgctgtttggcgagttcggcgagcttgggatcgtttttgatggatgcgatggcgtcctgcgtgtccgtgatggtccgttgcgcgccggcgatgtcgatgcgctcccaggacgtgtaggcgagctggttggccagttcgagttcgcggtggaggttatcggactgtgttttggcggccgtgtagtcggtgtcggcttggctgagcgcgttgcgggcggcgtcgacctgcgctgcgagcgcgttgaggtaggtttcgttgacgaatccgatgacctgggcgcggtctttggtgccgtgctggccgcgtgcgccggatttgatctgaccgtcggcctgcacctgacggttggtgcggtcggtgtcgtcgatggcggtgacgcatagggcgtcgaatcgttcgtcctgggtctgcgagcgcagccagtcggcgaagggcgagtcgtcgcggtagcgcagtttgccggacagccagtcgccgtcctgttctccggtgagtatgttcgcgtgcgcgccggtgtcgtcgtagtggcgtgcggtgtccacgaactgccaggtgcgtcggggcatggtgcgcgggtcgatggtgctgactttggcggcgaagccctgttcgtggcgcttgtcgacgaggatggtctgggcgatgggcgcgtaggcgacgttcatggcgagacgccagtcttcctcgtgttcgttcacgtccatgagttcggccacgtacggcagttcggcgggggtgagtccggtggcgcgacagagcatggcgcgggtttcgtccatctgctgggagatgcgggtgcgctgggagcgttgccggtcgaagtcgcgttgcagtcgttcgaggtcgccgcgtgcgccggcccgcgcgttgatggcggcggtgagggcttcctcgcattcgccgtctcgtttgttgtattcgcgtttgaagttcacggcgttgatgcggcgttcgttccaggcctgttcgtcgccgggcagcgtctcgccgatggatgcgaacgtttgttcgattcgtgttcggttggcttgcacgtcttcgagggtgcggcgggcctggtcgagttcgagttcgagtcgggtcaggtcgccgccgtccagaccctgcatctggcctcggatcatgtcgagacgggtgcgcaggtcttcggttcggcggcgcagcagcttggcttccgcctcgctgttctgttgttcggcgcgatcggcgggcagttggacggcgacttcgccgcgcatgcgggccaatgcccagtcgcgcagcacggccggcaccgtgccgtcgacggccggcttgaccggttcgaaggcgcgggccttgccgcgtgcggcggcgtattcgccgtaggcctgttggatgccgcgcagcgtgtccatgcggcgggtcttctcgtccatggcgtggaagttctcgtcgtaacgttcgtagtcctcgaccgtggtgcgggccaggtccagggcttcgggcacgccgagcacgccttgtttgaagatgtcgtcgagccgggagggcgcgtcggcggactggatcttgtgcagcagtcggcaggcggcctcgctcaggcccattgcgctccagatgtgtgtgtggaacgcttcggcgctggggaatgtgaggcagtcggggtaggtggctttgagctgggccggcgtgaacggggcgtcacggtattggtccatgcgcctggggtccacgggcttgccccagaccacgtactgtcggcgcacgtcgccgcggccgtcgccgggcatcaggtagaggaatttggcgcaggagagcacctggccggtggtctggttgcgataggtgtccacgatggcgccccacacgggttgcggtgcgccgttctcgtcgcggccgcgcaggtagagcggctcgtcgccggtttcggtgctgcccacgccgaccatgccgcgcaggtaggtgtagtcgctgcgttcggagcggccggagttcgaggccttgttgaacggcgtgccggttgggtacagcagggagatctgcgcgtcgaccagcgtggatttgccggattcgctggcgccggcgagcagggtcaccggcagcttgtggtccgtggaggggcggaattcgtggtagccctcataggagccccagttgatgagtcggcgggattccagcatccaccggtccgcgatcatctgcacgtctgtcgcctgcatcattcggctcccttctcgtcgtcatcgtcatcttccgtgtcgccgtcgccgtgttccgcgacgtcgagccaggtgtcggccagttcgcggtcgagcaccacgggcacgagcggcgtgatctggtacatggcttcgtcgtccaggcgcaccaaatacccgtaggtgatcatcgcggagacgatggcgccgatctgctttgccacgccttcctcgtcgttgcgggcggccagatagccggcgccggtggcgagcgcggcgcggatctcctcaaagctgacgagccagtcggcggggtcggcgtgcacgttctcgtattcgaggacgcggatgcgcaggaaggcgagcagcgcggcctcctcgcgtttgaggctgacacgggttttgagcgagcgcagggtcacgtcgtcgccggccacgggcgtggcgtacatgatgcggtagcgttcgttgatcaccaagtcgagcaggtcgttgttcagggagcgtacgacggcgtcgcggttgtcgagcacggtgtcgtaggtgggcccgctgatatagcggtcacgtttgagggcgatggcggccatgcgtgcctcggccggcatgtcgccggtgtcgccttcgaacagggcgtacgggttggcgttgtccatatgctcctcgtgttcctcgtgttcctcggccacggtcatccttcctccacaatgatgctcagctcgtccatgtcggccagcaccggtctagtgatccagttccggggctcgccgtcgatcgatacgcaatgccaggtcgcggtatcgccgcgctgcgccggggccggctcggtggcgatgtcgctgtcgaccccgacgccgacgccgtcagtggacggctcgtcggcgatggcgttgccgcttacggctcccagcccgcccaggaagccgacgatctcgctttcgcggcgttcgctttcgggcagccggttgaagctggcggcgatgtccacgagggttgcgccgggcctgtcatcggacctgtcaacggtcaccgggttgcgccggatgaggctgaccatgcgcaggagtcgggggccgccgctgttgaccatgtcccgcagatcggccaccggagtcgactgcggggcttcggcggcgaggtcgctcaggccgggtgcggtggcgcgggtcatggatttggccgggcgcatcggcaatggcgcgaacagcgcgtccgaggtggccgtgtcgtacgggcgcgaggcgtctcccatatgggttttcgcatccgcgttgaggcgcgcgtacagtcggttcaagcgggtgagcatcgtgcggtagcgagtgtcggtttgctggcgcacgagccggctgatcgcctcgtcggagacgcgcatctggcggcgcacggcttcgatgccgtcgtagatgcgggccagttcgtcgcgtatctggccgagcagcacgccggattcgccggccagatacggggttttggcgatggcgcgcagggcttcgtcgatttgctggcggccctcgtcggtgatgatcacctggaaggcgtcctcgaagcggcggccgctgtctgattcgctgaacgagcggcggtattcatcgtggtagcgggtcaggttctcgtccacgctgatgtcgccggcctgcatgcgccggcgcaaggcgtcgccgttgtcccgctcgtcgagcacgagttcgcgcaggtcgatgggcacgccgcgcagcgtgttgtggatcacggcgatcacgtcctccacctgggcttcgctcagcgtggcatgctgcttgccctgttggatgcgtttgatctcgtgcttgcgttccttgatttcacggttgaggagtttgatgcgctcgccggggtcggcggtcagctgcatgcgcgcgtgctcgatttccatgatgatgctgttggcctgcgcgccggacagggcgcgtgattcgtcttcgagcctgctcagcgcctcgatggcgcggtgggcgcgggccgtcaaacggtagaggaatcggtgtgaggccgcatcatgcgagttggcgagccaggcgtagtcgccttcgccttcacgggtcaggtcggcgaggatctgatgagcggcctcggcgaaggtctggtcctcgcgcggcgcatattcgccggcgtcggccagagcgttcagactttgcgcgaaccgctcctccacggtctcgcgcggcagctcgccggtgagcgggtcgaacgtggaacgcagcagcgacacgtacagcatcgcgttctggcgcaacagcaaccgcaggacgcccgtctcatacaccggtcgcagccgttccagctcccgcatcacatcggccacagcatgcctccctctgtcgtgaccgcaccatactagccgatagccgcgaaccacaccccgcccgcgccacgcccttcgccccccccacagggaggggcgccaagccatgctaaaaatcacagacaggctattgcctttgcgggaaatcatcgttagattggcgagaggaatattgtcaatgcatacgaaacggaaaacatcgtgaccgcaccgaacacgcccgccgaaacctctgaccagctcaacaagcccgccaaatccggcaaactggaggtctccgacctcatcaccatcggcgtgtttgcggccctgtacttcgtgatggtgtgcatcgccacactggtgagcaccctgttcaccggcggcttcggctccatcttcctgcccgccatcacggccctcatctccggctgcgtgtacatgctgctggccgcacgcctcggcaaattcggcggcatcaccgtcatgggcgtgatcatcggactgttcctgttcatctccgggcatttcgtgctttcgttcatcgccagcatcgtgttcccggtggcggccgacctcatcgcgcgcgccggcaagtataagagcaaggcgctactgctcgtcagctacgtggtgttctcctacggcctgaccggcccgatcctgcccctatggttcatgaaggacgcctacgtggcgagcctgcaggcgcgcggcaaggacgcagcctacatcgacggcgtattcgccaacatcaacaccggcacgttcttcatctcgatgatcgcgattctggtgtgcgcggttctcggcggctggttcggccagcgcatgatgaagaagcacttcatcaaggccggtatcgcctgatgaatcctgcccgccggacgctcgatccgcgcgcgaaactctaccttctgctggtggcgaacctcatgctgttcttccacgtagggctcgccacgcaaatcgtcatggtcgtgctgttcctgctacccctgctggcggccgcccgatggcgaaccgcgttgaacttcggcgtgacctatgccgtactcaccgcgctgggaatgctcgaccccgatgccctgggactgccgtggctgcatgtggtctccgcgctggccgtgggcgtcacgatgatgctgccctgtttcatcaccggcgcgtatacgttcaccaccacgtccgcgagcgcgttcatctgcgcgatgcggcgtatgcgcgtgcctgaggccgtggtgattccctgtgtggtggtcatccgcttcttcccgaccatcgccgaggattaccggcagattcgcaatgcgatggcgttgcgcggcatcgcctccggcggctgggggctggttcgtcacccggcccaatcgttggaatacattctgattccgctgctgatgaacgccaccaatgtggcacaggacctgtcggtggcggcactgaccaaggggctcgggcgtgagggcgagcacacctcgcgcacgctgatccgtatgaccgtggtcgactggctggtcatgattgtggtcactttgccgctcgcgctcgatatcgcgggggtgatctgatgggtggaaaccaatcgcagccgaatgcaactgccattattgggaccggcaagggtggcccactcgacacgtctgcgggaaccatcgcctcccgtggcatctcctttacctatgaccatgccgcagagccggcattgcgcgacatcacgttgaccgtgcccgcaggcgagtgcatcgtgctgtgcggggcgagcggctgcggcaaaaccagctatacgcgcgttgccaacgggctcatcccctcattcttccatggtgcgttcgccggcaaccagaccacgtgcgggctggatgtggagaccgtgccgatcgaccggctcaccccgctggtcggcagcgtgttccaaaacccgaaaacccagtatttcaacgcgaacgtcaccgacgagctcgccttcccggccgaaaacatagggctgccggccgaggacatcaatcgtcgtatcacggccgtggctgagcgctttggcattgggcatctgctgcatcgcagcatcttccacctgtcaggcggccaaaagcagcgcatcgccgtggcggcggccaccatgctggggcccaggctcgtggtattggatgagccgaccagcaatctcgacgcgaacgccatcgcggacatgcgcgccatgatcgagcagatgaaggacgaagggctcaccatcgtaatcgccgaacaccgactcgcatggctcaacggcgtggccgaccggtacgtggtattcgacggcgggcatatcgtgcaggattacgaggccgatgaattcctgtccctctcccccggctgcgtggccgccatgggattgcgggcgttggacctgcaaccgtatcggcgccggattgcggcgctggcttcaagcccagccgcggatgagtgcacttcagtattgctcggcacccataacctcaccatcggatacaaaggcaaggacggcttcacccgcgccatcccggacctgcggttccgtgccggcgaaatcaccgggctcatgggcaacaacggctgcggcaagaccacgctcgtgcgcacgttgaccggactcatcaagcctgtttcgggccgcatcgagctcaacggcgtgcccgcaaaaccgcgcgacctgacccgcgccggattcctgatcatgcaagatgtcaactaccaactgttctccgacagcgtgcgcgaggaactgctcatcggactcgacgagacggatgccggcatcaccgctcaagccaatcaggtcatggccgatcttgaccttgcagcgttcgccgaacggcatccgatgagcctgtccggcgggcagaagcagcgggttgccatcggctcggcattgatgtgcggcaaggacctcatcatccttgacgagcccaccagcggactcgaccgctaccacatggagcaggtcggcgaactgctgcggcaactggcgagccaaggcaaggcgattctcgtggtcacccacgatgaggagctcgccgccggctggtgcgaccgcattgtcaatcttggcgccgacgattccgggaacaacggctcgcatgccagtaacccagatgccagcagccccaaccctaatgcctctaccaatttcgccaccgcatccacccatgaaaggaacgcgcaatgaccgccagcaacaccacggattccacggccttcgacatcaccgactggctcggtgaatgggaaagcttcgagcattacattgattcggatgacgccgccatccagcagacctgggaagccgccgagcaggcggtgctcgccaacccgaagatggccccgatggccgcgcgcggcatcaggacgttctggtcgatggcttgctccaccaccagcccggagaacatcatccatatcggctactggcgtgtgaacgagccggccgccgaatccggctccacggacgatgccgcgctcgccatcgaatggttcgccgaggacgacaccagcctcgacacctacgaatacaccatcgaccatgtcatcgagcacggtctcgaaggctcccccaccttcgtgttccacaccaccgatccggccgccgaagacagcccgttccgctggctacttgccatcaatccgctgccttcgcgcaaggcgttcgccgagggcgggctgctcagccacctgcatttccagtacgccaacgatctgcacacgctcgtcgccacggatgaggccaccggcgtcgagaccttgcgcaatccgcgttggtacgccaccatgtgcgccaacgagggaaccgtcgaggaccgttgcgccatcatccgcgcgttgcaccacttgcagtagacctggcaacatacggcagtgacggctccccactagtgaaactagcatcgcttcagtagccgtgcgagtgcagatactcgtcatcgaagccgaaaaaatggccgatctcgtgcaacacggttttgcggatccgttggcgcagctcggcctgcgttgagcatacgcgttcatgcggcccttgaacagggtgatgacgtccggcatcacgccgctgtagcccgtagttcgcttcgtgacgggtatgccctcatacagtccgagcagctcaccgcacggattgctcattgtagccagttcgcgctcattgggttcgtccgcaacgacgatgccgacattctccagcacccgcgcaaaccgttcaggcaaatcatccaacacctgttcaatggcccgttcaaactcatcgtcactgatgtgcattcgctctccacacgcgaaatgccttggcaccaagtatgtaccaaggcgctgaaatctcagactagcaggctcagctgttgcggttgatctcgatgtcggtgacggtgaggttggcctcgttgatcaggttgaagaggatgacttcggccagcgggccgggctgcatgaaggtgtgctgcttggcctcggagacgtagtcgcgactgtcacggtagaaagcggtatcaatgccgcccggatagacggcgaccaccttgacactggtgcccttgtatgcggcctgcaggctcttggtgtagcctttctcaccccacttggtggcgcagtacacgctttcgttcgcgttgccgcgtgtggcggcggtgctcataatctgggcgattttcacgttctgctcgccgcaggccttgagggtttccaccgtccacagaatcatgcctttgagtcccttgagacatttgtcgacgtcggcggcctcgtaggcggtgggcaccttgaacgaaggctggccggcgttgttgatgagcaaatcgatgtggccgagcgtggcgatatccgccacggattccttcacgaacgcttcgtcggtgatgtcgccgacgtaggcgcggtaggagtcatcgggccactgcgcggtcagttcggcctgacgttcggcattgaagtcgacaccggccaccagccagccgttggcgatgagctggctggcgagctcgtagcccaagcccagcgcgctgccggtgacgatggcgattttcttacctgttgtggttggcatggcagacctctcctactactattcttcggctacgagtttactactattcttcagctacgagttcgagatacgaatcattccagaggtcttcgtcgccgtcgggcatgaggagcacgcgctcggggttgagcgcctcgacggcgccctcatcgtgggtgacgagcacgatggcgccctcatacttggcaatggccttcagaatctcctcacgggaagcggggtcgaggttgttggtgggctcgtcgagcagcagcacgttggctcgcgaggtgaccagcgtggccagagccagacgggtcttctcaccgccggaaagcacgtgagccggtttcatcgcgtcgtcaccggagaacaggaacgagccgagaatcgaacgggcctgcgtgttatcgagctcgggcgccacatgctgcaggttctccaacacggtggcgttcagatccaaggtgtcgtgctcctgcgcgaagtagccgatcttgcagccgtgaccgtattccacggaaccggtgtccggctcctcgatgtgggccagcaggcgcagcgtggtggtcttgccggcaccgttgtagccgaggatcaccacacgcgagcccttgtcgatggccaggttcacgccggcgaacacgatgttggaaccgtaggccttggaaatatccttggccatgatcggcgtgcggccgcagggcgcgggctcggggaaacggatgtccgccaccttctcggccttctgcgcctcggaggtgttttccagcagcttttcggcacggcgcatcatgttctgcgccgccacggccttggtggccttggcgtgcagtcgaatgccttgcttcatgagacggtcggccttcttctcggccacttcgcgttcgcggcggcggcgctcctcgtccaccacgcgctggtgcaggtaggccttccagccaagcgaatacatgtcgatctggccgagctgcgcgtccagatgccagaccttgttcaccacttcgtccagcagttcggtggagtgggagatgaccaggaagccgccctcgtacttcttcaagtagccgcgcagccattcgatggaatcggcatccaagtggttggtcggctcgtcgaggatcagggtgtcggcattggagaacaggatgcgcgccagctcgatgcggcggcgctggccaccggagagcgtgccgagctgctgctccatgacctcctgcggcaggccgagcgaggcggccatggaaatcgcctcggactgggccgcgtagccgccggccttgtcgaagtcctgcatggccttgtcgtaccgggtcatggccttgctcatcacgtccggatccgggtcggtcatatccttttcggccttgcggatgcggttgatgatggtggcgatgtcgcgcgcgctcatcatgcggtcgagcgcggtctgtgtgggatcggaggcatgcgtgtcctgcggcaggtagccgagcttgccggagacgcgcaccttgccggcggtgggcagcatgtcgccggtgatcacgcgggtcagcgtggtcttgccggcgccgttgcggcccaccagaccgatcttgtctcccttggccacatggaagttggtggggtgaagcagcgtgcgcgcgccgatctgaatttcaagtccctgcacctcaatagccatgaataacctacttgcctgttacgaatactgtctcttaccaaagtccgactgtccatcatagcgaacaccatgccgaccgggctcagccgacgctcatgcgtccatacgcagccgcgcaactgatcggcaaggtgaagaatgcgacgcccggtatggtgatcgcgaccatggcgcacggtatcgaagctgccatcgaagccgctgtgagcaccgaaaccgacgccaccgacatcatgggcgaaacccactaacgtacagacagcgatgcccccgccgacaacttctgtcagcgggggcatcgctatgcgttgaacgttacagttcgcgcaactgggcggcgatctggatggattcgacgctggcctcggccttgttgcgcgtctcctgccattcggtggcgggcacggagtcgagcacaatgccggcaccggcctgcacgctcgcctcatggtcgcgcaggaacgcggtgcggatggcgatggccatgtccatgttgccggagaaatcgaagtagccgacggtgccgccgtagatgccgcggtcggccggttccaactcgtcgatgatttcgactgcgcgcggcttaggcgcgccagacagcgtgccggccgggaacgcggacttgaacacatcgaatgcggtcagcgaggggtcgaccttgccggtgaccgtcgagcagatgtgcatgatgtggctgaaacgcttgatgtccatgagctgcacgacttccacggactgcggcacgcacaccttactcaggtcgttgcgagacaggtcgacgagcatgatgtgctcgctgcattccttcggatcggcaagcagctccttggcgaatttctcgtcttcctcaggggtggcgccgcgagggcgggatccagcaatcgggaaggtcatcgcgtggccgttgtccaccttgatgagggtttccgggctggagccgatcacgttgaagtcgcggccctgagcgtcggtcaacgccatgaaatacatgtacgggctcgggttcagcgtgcgcaacacacggtacacgtcgaacgggtcagcaggcgaatcgatgtcgaggcgctgggagatgaccacctggaacacgtcgccgtcgacgatgtactgcttggctcgttcgacggcctgctcgtagtggctcttctcggtgcggaagcgcagctcgggttgggcgaccgtttcgtccaggatgttgacgcgagactcgtccggagccggggtggcggcatcgcgctgcatctggtcgagtcgagcgacggcctcgttgtaggcagcgtcggcgcgagtggatttatcatccacattcaccgcattggcgatgagccataccgaaccggatacgtggtcgaccacggcgatatcggtggccagggcaagcacggtctcaggctggccggtctcgtccggagcttcggcgcgcagggtcggttcccagtggcggatggcatcccagccgaccgtgccgaccagaccgctggtcaggttcggcaggccttccacatgcggggccttcagagtcttcaacgtggcgtgagcgacttcgactacgtcaccggtgacgggcacgccgaccgggaccttgcccagccagtcggcctgaccgttgttggagcgcagctgggccatcgagttgacgccgataaaactgtaacggctccacgtgccgccgtattccgccgattcgaggatgaaggtgccggatcggccgccggcgagacgctcgtagaagccgaccggggtgagcgagtcggcgagcagacggcgcacaatcggaatcacacggtatccggcgtcggccagttcgtggaactgttcgcgactgggccaggtggcgccccacttcaggtgtttgacgctgcattcgctcatattcgctcctttgcttacaactcgatgtcttgtttcatagtacgcggtcgctcggcttcccccagtcaggaaagcccgttctactgctcggccgggcgatggccttcgaccacgggcagggggccgccttcgaggaagcagctgcgcttgccggtgtggcaggcggcaccgacttggtcgacttcgacgagcagtgcgtcgccgtcgcaatccagggacacgcccttgacgtattgcacatggccggaggtatcacccttgcgccagtattcctgacgggaccgggaccagaaggtcacgcggccggtggtcagcgtacggcgtaatgcctcgtcgttcatgtagccgaccatcagcacctcgcgtgtgtcgtactgctggatgacggcggcgaccagccccttggcatcacgcttcaggcgtgcggcaatacggggatcgagttcagtggaattgtcgtatgtagtgtctgtcatacctatcttctttttgtggaccaccctcagtcagcttcgctgacagctcccggattatgtgcgacgtgcgcatagcgcattgccacgaacaattcactggattgttcgcccagcgggagcaaggtgtattcgtttagcgaacggtgtagccgtgcttcttgagttccgccttgacatcggcgatagtcaggatgccgtaatggaacacggatgcagccagcaccgcgtcggcacctgcttcgatggcgggcgggaagtcctcgaccttgccggcaccgccggaggcgatgatcggaatcttgacttccttgcgcacggcgcgaatcatctcgaggtcaaagccttccttggtgccgtcggcgtccatcgagttaagcagaatctcgccggcgccaagctgctcggcgcgcttgacccaccagatggcatcaataccggtggatttgcggccacccatcgtggtgacctcaaaaccggactgcgtatgctgctcacccttttcgcggcgggcatccacggagagcaccagcacctggttgccgaaacgatcggccacacggctgataagcgacgggtcgttgatggccgccgtgttgacaccgaccttgtctgcaccgcagcgcagcagtgagtcgacgtcctcgggcgtgcgtacgccgccgcccacagtcattgggatgaacacctgttcggcggtgcgggagaccacgtcaatcatcgtgttgcggtgggagctggatgcggtcacatccaggaaggtgatctcgtcggctccctgacggtagtattcggccgccagctccaccgggtcacccgcgtccttgaggttatcgaaatgcacacccttcaccacgcgaccggcgtcaacgtccaggcacgggatgactcgtaccgccaacgacatgcttcactcccctgttcggctttgcattacagtccttcagactacctaccgcccgttacatgcgccgcacctgtttctggaatatgagaatcatcatattgagcaccgacatggcagccgctcggcgtgagagaatggctcgtggaagttgtccgccgaatcaaggagattggcatggctgtcgaaaacagcaaggtactgatcatcgtcaacaactggggtatcgaggagaccgagctgacgcgcccgctgcgcgatctcaaggccgccggcgccaaggtgacgcttgccgccactaccttggacccgtgtgagacggtgcagcacgaccgctacgaaggtgaaacgctgaccccggacgcgcgcctgtccgacgtgcaggctgccgactacgacctgctggtggtgcccggcggcacctgcaatgtggatcgtatccgcgtcaatgaggatgcgatcacgctggcgcaggagttcgcgcacgaaggtaagccgatcgccgcgatctgccatggcgcgtggctgctggtcaacgcgggtctggtggctggcaagaccgccgcgccctgccgctatatcgccgctgatatcgagaacgcgggcggccattacgtcgacgagcagctgcacgtggacgacgccaacggcttcaagctcatcacgtcccgcaagcccgacgatctggactacttcgtgggcgcaatcaaggatgcgctgaagtagctaccgctccttggcagcgagctggccgcaggcgccgtcaatatcctgaccgcgggtgtcacgcagtgtggcggtgatgcccgcgcggtgcaggatctccaggaaccgctgttcgtcttccggcttggaggcggtccacttcgagccctcgatggggttgagcggaatcgggttgacgtgggcccagttgtcgccgtaatggttaagcctcttggccagcaactgcgcatgctcggcctggtcgttgatgccgcgcatcaacgcgtattcgatactgacgcggcgcttggaggccagccaataatcgtgcgcggcatccaacacctgcttggtattgaaacgcttgttcatcggcaccagctcgtcacgcagttcgtcgctgggggcatgcagggaaacggccagacgcacgggaatgccttcggcagtgagcttcttgatgccggggaccacgcccaccgtggatacggtgatgttgcgcgcggaaatgccgaagccttcgggaggcatggcggaaatctgtcgtacggcggacagcacggagttgtagttgcccatcggctcgcccatgcccatgaacacgatgttgctcaggcggccctctcccccggccacttcgccgtcgcgcatcatcttggcggccacacgcacctgttcgattatttcaccggtggacatgttacgggtcaggccaagcttgccggtggcgcagaacgggcagtccatgccgcagccgacctgcgaggagatgcacagcgtggtgcgggtcgggtatcgcataagcaccgattcgatgagggagccgtcgaacagcttccacaaggtcttgatggtggtgccttcgtccgccacttggcgggtcacctcggtgatgagccgcgggaaaaacgcggcggcggcctcgctgcgcttggctgccggaaaatcagtgaattcggcggcattcacatcgaaatggccaaagtaatggttggcgagctgcttgactcggaacttcggcaatccgagttcggccgctttctcgacgcgctgctcgggcgtcatatccacaaagtgcagcggcggcttaccacggcgggcatggtccttggatagcacgtcacggaaggcacctgatgtgccgccgggagtaatgccggtttccggagtgtcaggatgctgtgtggtcatgatgggttcgcttcgctctcaatatcagaaaatagtcaaacatgcaatagtaatatcagaatccaccatacggcgtgccgcatacgaatcagatggcccatgtcttagcccatagcgaacgcatattgaacgatgatttccccatatatggcatgtggcaccgtgcgatatacacacgatgccacattgttcatgcacgagacatgcgaatcacagtccggtgatccacagcaaggcgcaggtgaacggtgcactcatcaaaatggaatccacacgatccatcacaccgccgtgccccttgagcagatggcccatgtctttgataccgatatcgcgcttgagcatggaagcacacaaatcaccgaacgtgcccacggcaccgatgagaatacccgccacgatcggcacccaccaacgagtggcccatttcgaggcatcatacgtgcatgcgaatacggcaaatgcgccagccatggcgaagagcatcgagccgacaaggccctcaacggacttcttcggcgagatgcgcgggctgagcttgtgtttgccgagccaggcaccggcaaacaaaccgcccgtatcggatagggcgggtaggaacaccagcatgatggcgtgtgcaatcggatgcccattaaaagtcagtgagatgatgacgcagctggccaacaacggaatatacaacacggtaagcacggacacagccacatggctgagccgggaatgatgctgttccccgccctcatgattaaacgaggattcgaggcgcgcgctggcatccgtgttggacagtttgccggcaaccgccagagataggcggttgccgacgctgatttttgcgctggccgcgatggcgaccagaataatcgacacgatgatactcagcgacatcgtgatgagatggtacggggaatagtaggtggcaatgagggtgaaggacgagcacagccacagcataaacaccgggaggtgcaggcccacggtggcgaagtccaccctgagctcccacagcgccagaatcatgaacacgactaccagcagcacgaagaggtcgacgctgagcagcaggcacgcgacaataaggatgaccagtgccgcgcctgtggcgatggcctgcggcatgttgcggccggtcttcttgttgatctggtcgagcgtctcctcggcctcttcatggggttgttcgttgcgttccataattctccggacctggtctgaatcagacctccatgatctccttctgcttggtctccagcagagtatcgatctcgtcggtaacggacttggtgaccttgtcaagatccttcagcaggcgatcgccttcgtcctcacccatctcgccgtccttgacggccttgtcgatggtttccttggtcttacggcgaatgttgcgcacggcgaccttgccatcctcggccttgcccttggcgagcttgacgtattccttacgacgatcctcggtgagttccggcatggtcagacggatgacgttgccatcacggttcgggctgatgccgaggtcggagttgcgcagggccttttcgacggcaccggcctgggaagcgtcaaacggggtgacggacagggtgcgcggttcgggaacgccgatggaggcgacggccttaatcggggtgggggcaccatagtagtccacggtgatgccgttgagcagggccgggtttgcgcgaccggtgcggatgccggagaagttttccttggtgttttccacggtcttggccatctgttccttggcctggtcgataagagacatattcactccttgtgtgttggtgttcgtcagtgttgttcgtctatgaacgcttgattcgattgtgggcgtttgcggcttactcggccacgcgcgattcggcggtggagaccagcgtgccgatttcatcgccgacgagggcgcgggtcacgttgcccggctcttcgaggccgaagacgcggatgcgcttcttgttgtcgcgggccatggacagtgcggaggcgtccatgacggccagattgtccacgagggcgcgattgtagctcagggtttcaaaacgcttggcgttctcgtccttgcgcgggtcggcggtgtagacgccgtcgacgccgttcttacccataagtacctcgtcgcagtggatttcgagggaacgctggatggaaaccgtgtcggtggagaagtacggcatgccggcaccggcgccgaaaatcaccacgcgacccttttcaaggtgacggatggccttgagcggaatatacggctcggcgacctgtcccatggtgatggcggtctgcacgcgggtggcctgcccctcctgctccagaaagtcctgtagagcgaggcagttcatcaccgtgccgagcatacccatgtagtcgccacgggaacgatcgataccggcctgctgcagttcggcaccgcggaagaagttgccgccgccgaccacgatggccacctgcacaccctgttgtacggccggaacgatctcctcggcaatgcgacgaatcacctgggtatcgatgccgaccttgccaccaccgaatgcttcgccggacagcttgagcagaactctgcgcggattgtcgctatcagtcatattgtgcctttctcaaaaccgaaagtgcgaaattatccgtagacaagcgtatcggtttacgacgacacccctagcaacgacacccttggaatagcgaaacgccatccgattattgaataaccggatggcgtttcgttgaaattacgctaagcgcgtggagtaagccttaggctcactcctcttcgcccttgccgacctcgacacgagcgaatgcggtggcgttgccaccgacttccttgaacaggtcgccgacggtcttggacgggtccttgacgaacggctgctcaagcagcacgacttccttgaagaaagcgttgagacggccttcgacgatcttcggaacgatcttctccggcttgccctcggccagggacttctcggtggccacgcgacgctcggactcgaccacatcggccggaacgtcctcgcgggtcagccacttggcgcccatggcggagatctgcagagcagcttcgtgagccacggcggcgccggccttgtcggtggcgatcatggcgacgatgctcggcggcatctcggcggacttcttgtgagcgtagacttcgacgtgctcgccggagatcttggcgaactggccgaccttgacgtgctcaccgaacagggcggcggcctcttcgacagccagcttgacggtggtgtcgccagccttggcctcgagcagctcgtcagcggagttggcgtcggcgtccacggcgtagccgagaacttcctcggtgaactcgacgaacttcggggtcttggccacgaagtcggtctcggagttcagctcgacggcgtagccggtctcgccattggcggtctcgacgaccttggaggcgatggtgccttcctgagccttgcggccttcacgcttgccggctgcggcgatacccttggcgcggatgatttccttggcgcgggcgacgtcgccttcggcttcggtcagagccttcttgacgtcgagcatgccggcgccggtgtcttcacgaacctgcttgatcagtgcggcggtaattgctgccattgattattctccttgagaaattttgcttacccatgaacgatgggaagcgctcattcaggcacttcccatcgtagagcatcactcggccttgggggcctcggcggtttcgccctcggcggcagccggagcggcggcttcagcggaagcctcggcaggagcctcgttggtcaggagttccttctcccaagcggccatcggctgctcggcggcttcaccctcggccttgttggcgccggagcgctccagcagaccttcggcgacggcgtcagccatcaggctggtcagcagttcgatgccgcggatggcgtcatcgttggccgggatcgggtactcaacggtgtccgggtcggcgttggtgtcgacgatggcgacaaccgggatacccagcttgtgagcttcctcaacagccagggcttccttggtgatgtcgacgacgaacatcgcggacggggtgcggttcatgttgcggataccgcccagctgcttgttgagcttgtccttctcgcgctcgagcaggaggagctccttcttggtcaggccggaaccgtgcacgtcggtgaagtccatttcctcaagttccttgaggcggttgacgcgcttggagacggtctggaagttggtcagcatgccgccgagccaacgctcggagacgtagggcatgttcacgcgggtggcctggttggcgatagcttcctgagcctgcttcttggtgccgacgaagagcacggtgccgttgtgggccacggtggtcttgatgaagtcgtacgccttgtcgatcatgtcgagcgacttgaacaggttgatgatgtggatgccgttgcgctgggtgaggatgaactgcttcatcttcgggttccaacgacgggtctggtggccgaagtgcaggccagccttcagcatatcgctcatagtgatctgagccatggtattactacctttcattgtcggttcttgcctggccatgcgcacctgcgtgcagctgctccccggtttcacgagttgtgcagccgaccgacacaagccgtcgcgagcatgacgcgaatttgttgtgtgccggttgacaatattgggtggctctggacgccagcgactgcgtccgttgccgggtggcacacgagtttcgagaatagcacggagccggtactaaaaaaacaggctcccctctctgaggggagctgtcgccgtaagcgactgaggggagtcacgggcggtaccggcagaaccaccctcagtctcactacgttcgacggctcccgccagcgggagccgagtatggactacttcgcctgacgattacgcatgtagcgcagggcttcgcggcgttcttccttttccaggcgatccaaatacacgtggccgtcgaggtggtcgcattcgtgctgaagcatacggcccatcagcccggagccctcgagcacgacctcgttgccgtccaagtcgatgccacgcacgcgagcgtagtcggcacgacgggtcttataccacaagccgggcacggacagacaaccttcatcgccatactgctcgccggacttctcctcgagtacggggttcagaacgtagccgactttgccgtcgatgttgtaggagaaggccctcaggctcacgccgatctggttggcggacaggcccgctcggcccggatcgtccacggtttccaacaggtcgtcaaccaggcggcgcacggccggggtgatttccttgatctcatcgcagggggtgcgcaggactgggtcgggcacgaccctgatctcacggatggccacttctcgttactcctcgttcttctcgtcagccggccggtccggcttgctgccggtgtcagcggcattgtcggcattgtcggcggaatcgccggtctcgccctcttcgggttcggccttcgacttcttgatcttctccgacacgctagcaatcgaatcagacacgctggttttcatctgttccgaggcctgtttgacctgttcggacgcctgcttgaccgattcggaggatttcttgacggtctccagcgtgctgtcgatgatcttggcagtggcgggcagcggcttgttggatggcttgggcgcgtacagatcctcctcgatgacggtggcgtagcgctgcaataccttgggacgcaccactttcatgctcggggtgagcgtgccgtgctcctgactgaattcctcatccagcaccgcgaatttgcgcacggactcagcgcgggagacattggcgttggcctggtcgatgtactgctggataaaggcgcgcaccgcgtcgttgtcgctggcctcggcgagtgtcatgtcggcattgaggccctgaccttccagccaggaatgcagcatttcggggtcgagctcgataagtgcggacacgaacggcttgccgtcgccgactactactgcatgagccacgatcgggcaggtgtcgatgacatcctccatcggggcggggctgatgttcttgccgccggcggtgatgatgatgtccttcttgcgtccggtaatgaaggtgaagccgcggtcgtcgatacgacccagatcgccggttttgatccagccgtcggcagtcatcgtctgtgcggtgagttcgggctgcttgtagtagccaaggaacacgttcgggccggtcagctcaatttcatcgtcttcgccaagacgcacgcccatgccaggcccaggcttgccgaccgaaccgatctcgttgtcgtcctcccaattgacgagcatcggagcggcggtttcggtcatgccataaccctggatgaaggtgatgtcattcatgccgttgaaaaagtgggccaaatccacgttgagcggcgcaccaccgcaggccagccatttgaggttcggtccgagagcggaacgaatggatttgcctaccgtggccatgtagaacgaatggcgcatgcgctcgatgaacgaatggccgcgaccggcctgctcatccttgctccacttgacgaagtgcttgaccgactgggcgaagatatgcccctggatgccggcaccagccttctgcgaggccgcgttatacaccttctcgaacacacgtggcacgcccagcaggtaggtgggcttgaagctgcggatatcggcgagcagtcgcttggcgtcgggaatgtatccgaccacgccgcagccaccgatgcacacgtactggatgtagcgggcgaagcagtgcgccagcggcaggaacagcagcagacggttgtcgtcgtacagcatgccacgcagaatctcgtagccgttaagcacgatgtgcgtgtaattgcggttggagagcatcgcgcccttgggcttgccggtggaaccggaggtgtagaccacggtgagcagatcatcggctttgatacgagcgatagccgcatccaacgtctcatcggatacgccatgcccgaagtcaacgacagcgtcaaggccatcggccttgaaattgaacacgtatttcatgcccggatgattgacacggatctgctcaagcgtctgtgcgcgctggaagtcgccggcaaaggcgatggcgggatcgacttcctcgacgatgcccgcggtctgacgggcggaatcggtctcatagacgggcacaaccacagcgccgattgccgcgcaagcgaaatcagccacaccccactcatagcaggtaggcgagtaaatcagcaccatggtgccggctttgacgccaagtcccaacaggcccttggccacctcgcgtacgcgggacagcatttcagtagctgtggcgctgcgccattggtgggtgttgtcatcctgccattccgcgatgatgtcatccggcgtgcgagctgctcgtttggacagcagcgagtagacggtgtcgtcatcggtggtgacatatctgggttcttctacatgttcacgcatggtcactactataggcgaaccagcctatgacacggcagaaccgtcttccgctaccagcgtaggaatcggtgtgcgggcggggccgtctggtcagcccagatcggcatagatgcacatccatcgagaaccgatgtacttcagtttgaggttgactcgcagattttcctggccgatggtcatgaataccgccatttccagcgtgtccttgccggtgatcatgccgtcgatcaatgtggggacagtgggcagatagcagaatttcgctttgagctccggatgagtgaccatgtgggtgccgagcaggtattgcatggtttgcagccggtccaggcatggttttgtcatggctctgttgagatgtgcgacgctgagtttgccacgtatcgcgtccgccgatgtgcaggcgatgcggcatgcagccatggccatggaatgacattccttcgcattcagcccgcctatgaatgtgggttggatgtgataccgcaccgggcgatccgacagctccacaacgatgaatccgtcataactcggcaacggcccgtactgatatgtgccgtggaaaaatcccgaatactccatgatgaccccttcaagcccccttgcaactcaccatcatcggcgagcgtctgtactacaacatcacgaaaggcgcgccaagtcaaactacttgagcgcgccttcgggcaagttaagcctcctgcatggagggcaaaccccattttcagggggcaatcgggattatcgtgcggaatacgggttgaccaccatgccgcaacgctggaagttcttcacgtcgacgtagccggtggaggccatcgcgcgcttgagggcgccgatgaagttggtcttgccgtccgcctggtggctcggtccgaacagcacctgttcgagcgggccgaccgtgccgaccgtggtgcggtagccacgcggcagcgtctggtggcgggcttcggaaccccagtgggtgcccttgccgggggcctcggtggcgcgggccagcggcgcgccgagcatgaccgcgtcggcgccgagggccagggccttgacgaagctgccggagtcgcccatgccgccgtcggcgatgacctgcacgtagcggccgccggattcgtccatgtagtcgcggcgggcctcggccacgtcggcgatggcggtggccatcggggcctgcacgccgatggtctggcgggtggcggagaccgcgccgccgccgaagccgacgagcacgccggccgcgccggtgcgcatcaggtgcagggcagcggtgtagttggatgcgccgccgacgatgacaggcacgtcaaggtcgtagatgaacttcttgaggttcagcggttcctggccggaggagacgtgctcggcggagaccacagtgccgcggatcacgaacaggtccacgcccgcgtccaccacggtggagtagaactgctgggtgcgctgcggggagagcgcgccggccacggtgacaccggcggcgcgaatctcgtgcagacgttgcgtgatgagctccggcttgaccggctcggcatagatctgctggatacgctcggtggcctgatcggccggcagtccggcgatttcgtccaacagcggggtcggatcctcgtaacgggtccacagaccttccagatcgagcacgccgagcgcacccatcttgcccatggcgatggcggtggccgggctggtcaccgaatccatgggggcgccgatcaccggcacatcgaactcataggcgtcgatctgccaagaggtggagacgtcctcggggtcgcgggtgcgacgggaggggacgattgccacatcgtcgagtgcgtagccgagacggccttttttgcccaaaccgatttcaatttcctgagacatggtttccagcctattgcccgggtgggacgccaacaaggccgtttcccacggaccggacgattgcttcaagtcgttacaaacatgcgctatgactaaatcatcttcacaccatctatcaggaggaagcatggccaaaatcaaggtcgaaggcactgtcgtcgaactcgacggcgacgagatgacccgcgtgatctggaaggacatcaaggatcgtctgatcctgccgtacctcgacgtgaacctcgactactacgatctgggcatcgagcaccgcgacgagaccgatgaccaggtgaccatcgacgccgcccacgccatccagaagcaccatgtcggtgtcaagtgcgccaccatcacccccgatgaggcccgagtcaaggaattcggtctcaagaagatgtggaagtccccaacggcaccatccgcaacatcctgggcggcacgatcttccgcgagccgattgtgatgagcaacgtgcctcgtctggtgcccggctggaccaagccgatcgtcgtagcccgtcacgcattcggcgaccagtacaaggccaccgatttcaaggttccgggagccggccagctgaccgtcaccttcactccggacgatggctccgagccgattcagcacgtggtctacaactacggcgaagacggcggcgtggcccaggtgcagtacaacgtcaacgattcgatccgcggtttcgctcgcgcctgcttcaactacggcctgatgcgtcattacccggtgtacttgtccaccaagaacacgattttgaaggcctacgacggccagttcaaggacatctttgccgaggtgttcgagaccgaatacaaggacaggtacgccgaggccggcctgacttacgagcaccgcctgatcgacgacatggtggccagctccctgaagtggcacggcggttacatctgggcctgcaagaactacgatggcgatgtgcagtccgactccgtggcccagggcttcggttcgctgggcctcatgacctccgtgctcatgaccccggacggccagaccgtcgaggccgaagcggcgcacggcaccgtgacccgtcactaccgccgctggcagaagggcgagaagacctccaccaacccaatcgcatccatcttcgcgtggaccggcggccttaagcaccgcgccgatctggacggcacgcccgaagtccgtcacttcgccaagacgctggagaaggtcatcgtcgacaccgttgaaggcggtcagatgaccaaggatctggccatgctcatcggcccggacgaaccgtggctcgacaccgacggcttcatgaacgcgctggacgagaacctggccaaggctctggccgagtaaatcatcgaacacatcgtgcggacctacatgggtcatgtcatgtcgcaaactgtcatgattgtcgtgcttcatctggaatgttcctcagcacgataatcatgacagttgttcgatgcacgcacgtaatacctctaattgttcccggatatgtggcgatttgtccactggtccgggactttttcgtatacggcctactagaatcgtgattcagcttgttttcacgcccgcttgaggaggtttcgccgcttatggtgttcgcacgccgctcaaccaccctgctcgccgccattatcgcatcctgcgcgatggtgctgtcactgaccgcgtgcacctcagacaataagaccgttgtagatggtcaaaccacggtgacgtccaattctgccggcggcgtggccgtgttcacaccttcggacggcattacgctgaaccagcagacgccactgaacaaatgggcgaagctggtgcctgacctagccaaggctctggccgacgccggtttcaagaaaggcgatatcgatcatacgacgtccgactcgttggccaagcaaagccgcgccatccaagactttgtggtcgatcatctttcgaataacaccacggacgattccggcattgccatcgcgcccgacaacatgacattgctcgtggctccagtagtcgaggccgacgcttccactcgccaatacggcgattacatcagccagaacctgagcaccaacgatgccacggatggggaagctacttctgacggtgaatcttccgaagacgactcgtccaaagacgattcgtccaacactgagagcgacagcactgcatcggacgagcaggcgcaggccgtggaccggctggtctcatcgctcaagctggccaaggaatccggcatgcatgtggtattgctcggcaacagtatcgagggatataagccggacgccttcgtcaagttctcggacgcccagaccatcggcaagctacaggcggaaaagatggtgtccaaactcaagttggataaggccagtaaagacaaccccaaatacattgaggtgctgctgccatacaccgccgtggacgaaaaaggcaacgccaacgattccacgttcgcccaagaggcgttccgtggtatctggcaggtactgggcttctactatcagaagggcgttgtggaaagcccttcaggcaccttggacggcaaatccacggaaaacgattggcaagccgtggcctacgatgccgctaaggaaggctccactgcgaaagtgcttgacaagcgtctggcaaaaaccgatggacagtccacactcacccgtattgacggcatcatcacgatgaacgactacatcgcctccgaggtcgtcaaggaattggacgatctgggatacaccggctctgccgccgatatcaatccgcagatcaccatctcgggcattgtcggcaatatcaccggcaagaaggatctcagccgcgacgccgtgccggacccgatcaaatcccctgaaaacgacaacgcaaacgactcatccagttccgatgacgatgcggacgaggacacctccgcttccgacaaggaccgtgactcgcagtggcctctagtaaccggatacggcgcgtatgtctcgaacatcccatccatcgtcaatggcaagcaatggatgaccggcatggaagacagacagaccatcgccacggatatcgctcaggcctgcgccaagctcaacaaggacgaagcgctgaattccatgccttcaatcaggaactccgaggtaggcggcgtgaagaagatcccgaccatcagcgaaccgttgctggctgtcagcgccagcaatctcaagtccgcgctgatcgaccccggatatatttccttggccgatgccggtctgtgattcatactcgtcacgccgctagccgcctgcgatgtctcttccgtacggccctgttccggccgacaatcaccgttaaatcatgacggtttcagtacgatttttcgactccccgcatattgctgtggatcaagataatcggccgttcctcgcttgaggccccaatgcaggcaacggtcttcgcaatggtccgagctgccttcaacgatgcctacgggctgtctgcgggagatcgtatccccactgagagctcggtaacggccggttcgaatgtcgacgtgacacctccacgatgccgtacactcaccacatctttgccagctactttgccagcaaaactcacggtccctgcctgtggtgacagaattacggtaccttgctccgcaacaagatccactccacgatgacctggtgcccacgggttgatcggccgctcgaactgttgttcgacctgtggatcgtcgaccggccagtcgaatcgggattcgcactgattgccattgcgccacgccaaatcagacatatcggtgaaatcctccaccgtgtatgccgcatctccggtcaccgcagtatccgcatgcgcaacatgctgaggcgtggatgccagccctactcccaaggcaagcagcaggccgataacggcggccaacgcgattatggcatccatacgccgttgccgttcctgagcccgctgacgcgcctgctgacgccgccggctggcacgtcgggcttcgtcgcgacgccaatcaaacaacagtggtgcattcatgagattcctccccatagtgtgagtgtgatgtgattccggcttctttgccggtgatacccaccttgaggggtccgaaacaggatgtccagccaaaacgacctatgtggttctagcttccgaagttatccacaatgaaatttcgcgtgacagtatcgccgcatcgtcatgttgttcgaccttcagccgcggccgatccatgtcacaaccgctgccatgcagtgacagcggaacatcagaactcttgtgattgttcccactgggttcgcatactcagacggttgttccgtttcaccgattccagtatttgccaagcagacaccagctcctctaccgttagtcgctagtgtatatccgcgttcggtttttggctgtatgagatagtatccgatgagtccgattctgcggaattcagcgcgacatgccctacacgcatgtaatttgctttttcgtggcaggcatgtaagatacgtgacttgtgcgcgagagaaatctcaaacacagcagacattcctgcgtagctcagttggcagagcatccgactgttaatcggacggtcactggttcaagcccagtcgcaggagctcacctgaacgggtaactccggccgggatgaaaattgaatattcctgcgtagctcagttggcagagcatccgactgttaatcggacggtcactggttcaagcccagtcgcaggagctcacctgaacgggtaactccggccgggatgaaaattgaatattcctgcgtagctcagttggcagagcatccgactgttaatcggacggtcactggttcaagcccagtcgcaggagccatcgaaagcctcggttctccgaggcttttttattttcatcgtattggtggccagacacgacaccccatcatcaaccgggaaatccatggcgaagacctcaccactactcacatcaggcagacaggtcactgtcaattcaccgatgagaggcacggtattcccagtatcagtttgggaataccgcgcaaatcttacatcgagaccttggtcaggggcatggcggagtcaatcgggaagtcgggggcgctgggggccacgccggcttcgaccaggttcacgccgagcatggcgaccatggcaccgttgtcggtgcagagcttgatttgcgggatacggacgtcgacgccgtagttctcgccgaattcgagcagtttggcgcgcagctgcgagttggcggagaagccgccgcccacgatcagcgtgttggaatcgtactgccggcagccgcgcatggccttacgggccagcacggtggccacggaatcggccagggatgcgcacacgtcgtccaccggaatctcatggccggcggcctgctcgctttccacccaacgggccacggcggtcttgacaccggagaaactgaaatcatacgggtgcgcggcaccggccttgccttgggtcagacccatcggcaccttgatggcgtgcgggtcgccgttctgaccatggcggtcgatgtgcgggccgcccggatacgggaagccgagcaggcgggcgaccttgtcgaagcactcccccgccgcgtcatccagcgtggtgcccaccacatcgattttgcgcggcatgtcttccacgtgcagcagcgaggtgtggccgccggagacgatcagagccagcgtgtccttggggaacgggccgaactgcagctgagtgacggcgatgtgcccgatcacatggttgatgccgtaaatcggcttgttcgcagcccaggccagcgccttggcgccggacacgcccacggccaggcaaccggccagtccgggaccggcggacacggcgatggcgtccacatccgccaacgtcatgttcgcgtcgacgagcgccttggacacgcatggcacgaaggcctcggcgtgcgcgcgggaggcgatttcggggatcacgccgccgtatcgcgcgtgttcctccatggatgaggccacgacgttggagagcagttcgcggccgcgtacgatggcggctgcggtttcgtcgcaggtggattcaatacccagtacaaccggttcgctcatcgtgcttctccgttcttctccgtttgcttgctggtgatgtcttcaatgtccgccgatgccgtctgcggggcggcaaagcccacgaccctaggtttcaggtccaagctcatggtgtatgcgtcgatgccttcgggctggtagtagcgtttgcgcaatcccatgcgttcgaatccgaaccgctgatacagggccagcgcagggtcgttatccacacgcacttcgagcagcatgcgcgaggcgccctgacgtttcgcctcgtcgaccagtacctgaagcaacgcagcggcgatgccttgccgctggtatgccttgcccacgccgatggtcatgagctcggcgtcctcgccgtcgtaccagaagccggcgtagccgcggacaacagcctgttccgcctctcccagcacatccagcagatacgtgcgggccggtgcgtccagttcctctcgcaccatgttcgcattccatgcgccgcggccgaacagttcgccttccaactgtgcgatggaacgaaccgcaagatcacgacttacggcagtgatgtcaacaatcatcggaccacaacccacttcacgccttatcggcaccggcatggccgagcacgtgcttcagtgggttcggtacttcggcgtccggccggcgcaggtacaacggttcgatcggcacgacctggtcgccgcgcagttcgcggctcaacgcggtggtcgcaaagacggcgagcccggctttcccggcatccaataccgatccgtccaccacggagcccagcgcacgcagtccctgccagacggatgcgtatttggccgcgccgtggccggtcacatccaccacatagctgacgccgtcgcgttcgccgtgttccgcgagcgccgcgttcacccgttcgacgatatgctccgggtagtcgatatccatctcgatccagcgtcgttcggcggcgtcctcgtccggcaggctgatgctgccgtggttgagcgagaagtacagctgcttgcggcgcgcatcgttgacgcacagcgtgacgtggcggtcgagttcgtgttccttggcctcggcgtccgggacgtcaccatccgattggcgcgaactcaagcgcggcacgtcggccaggaaatcgatgccgtcgaacatggcgctgtcacccagcacgaagttcatcatctcgccttgcgggtcgagtacgttctgtccgacgagcttggccccggtggcgaaggccaacgccttggcggccacgatgccggcgcgcaggccggtgaatggcgccgggccgatgcccacgacgatctcctcgatatcggcaggagtcaggccggcctcctcgaccgcgcgcgcgatattgacctgcagtttctccacatgggtgcgcgaatcggtctctacaatgggctcgcgccccacaatgccgaccgtcgagccgaatgaggtgtcaatcaccaacgtgcaacccatgaatcctcctagtcgtaaagcctctagagagtgtacatcgaggagtctatgggagcatggcttattgcaggtcgaacgcggcccatcgcttgccgactgggacgaatgcgacggtacgagtgccgttgctggtgagttcgccgtctgatccagcggatgcgacatcggaggaatcgagaggtcgatcgatatggatttcaagtcgttctggtgccaaggcggtggccatttgttcgccccactccataagcaccaccgtgttctcgccggggtcttcaagttcttcgtccaatcccagcgattccagctcgtccaacaaacgcccgatggcgtcctgccccggcgcataggctgagccgcccagacggtaggcatccacatgcaccagatgagccggagtgccgtcggcgaaatgcccgtcaagttcgcgggcaatggtgaatgtaggagacacgatgggttcggtaatgtccagccccgcgccgaagccttgggcgaatgtggttttgccggcaccaagagggcctgagagcagcaatacatcgccgccgtgtaccattccggccacgcggcggccgagctcctgcatggcctcgctggtgggagccgcaatagtgtgttcgctcataaatacccctttatcgacttttaccgacctttatgactgatgtcttcaatgcagcgttccagcgcatataccgggtcgccgccgttcgttttgctttgctcatccgcccaggcgagcatacggatgcaatgcgcgagtcctgccgaagtccagccgccaagttggcgcatcgcattcttcagcacccacggattggttttcgcttcggcctgtgaaatcgtgccggcccggaccgccgaggctttggcaatggtacggagcttcatggccaacgcgccgatcagcgcgatgggatcggtcccttgttccacagctgcacgcatcatgacgatggcttctgcggttttgccttccacggccttgtctgccacggcaaaaccggtgacctgcggattggcggtcaaatactggttgacacggtcgagccccatcggattatcgtcaaagtcgaaacacaattgctcgcacatggcggcgagttcgccggttttgccgccgagcacggataccagctgctgcgcggccatcggttcgactctacgaccgcgtttctcgaattctccgagtacgaaattgagttgggcatccggtttcttcaaatccggcacgtcctctttgcgagcgccggctttcaccagttggtcgatgatcttgcgccctttgacgccgccctcgtgctggcagatcaccacgctggagccgttcggatccttggcggcctgcttggtgtacgtcaccagagcttcggcgagcttttcgtcggcattctgcaggttgacgagtttgaccacggcaacgtcggaaagcaacgatgggctgacggcttcatcgaaggcatattggtcggccgatgtggcgtcgagctcgatgagttcggcgtcgggtcgcgccttcaacgcttgtgcgcacagtgccttggtgcgcgcgtcgttcaaatacgagtcgcctccgggcaccacggttaccggtacgttcgctgctgttttcgccatgccccatctcgccacacaggttggacaatgacctgccggcataacggcccggcagcactccgcgattaggcgtatgcctcatccaacagggcgtcgatatccgcgaaacgcttgggagcgggacgccataccgggtgaccggccgcgatgaccagtgccgggtgttccaacgcgcgcaggtcgtccagcggattggcattcagcacaagcaaatcagcggatttgccgacttccaaagaaccggtctcggcatcgacgccgagaatggaggcgttgacggcagtggctgcgtgcagggcctcagccgggctgaaaccggcgtatgcgaccagcagctccagctcacgccatgtggcgtactgcggcacgaatgtcatgcctgtatcggtgccgacgcctatcatcaatccggcctcgtgcgcttgacgggcacctgaaaccatgccgccgaccacgtttttggaattctccaattggatgtcggtgatgccggtcgcgtcctgtccaagcaaggtcaggggaaggccggcggaaagtgtcggaatcaatgccgagtatccgcgcaacgcattcggattgtgccggaacatgccgatcaattcgtcgtcgagcacgctgccgtgttcgatggtatcgacgccggccagcagcgaacgccgcacgccttccgggctttgcgcgtgcgcgccgacaataacaccgtactgatgcgcctcatcgcaaatcgcccgcatctgttccacgctcatctgcgggctgccggcctcgccgatttcctgtgcatcggttacgccgccggtcgcggcgattttgatggcgttgacgccagccttgagattctgcgcgactgcggtacgcgcctcttccggggtgccgctggtcagtgcgataagcggggcgccatggccttcgggaatcgccatcagcggtccggatgccaagatacgcggtccgaggatttggcctgcatcaatctgatcgcgtaatgtcacgacttcatatcccacgtcgccaagcgtgcggatcgtcgtaacgccggattccagcaatgttgtggcgttgtgttttacggttgcggccatgtacggcttgcccaatggcgaatgcgcgaatgtggcgaccatacgttggcctttgggcgtcgccagcttcggattgagcggcttgccttgggagaacagatgggtatgcgcattgatcagccccggcatcacgattttgccggtgccgtcaagatagtggtattcggctgggatactggtttcgatgctgggtgcaacctgttcgatacgtccgtcggctccgaccacgatcgtcatgttacgcagtatggttccggctttatctccggtgacgatggtggcgtgggccaatgcgaatggttcgactatcggattatgagacaacatcatcgccggcactccttcatgcagctggttgaactggtctcaactgtatcgcagttttgccggctgatggtttatgccgcgcggcctatcgcataggttcggctggctattgcgatggttgctgcaccgaataccgcattggctattcggcttgccgccgcgtaaagagacgtctcgtctcctcgcaccagagactgaggcggacatgccaagcggaaccgaagcgcacgccaggcattccggcctcataacgacggacatgctggaggcaacggctgacgaacaccagtagcatgccgataccgatttccaccgccacaatcagcacggcacccgtaacgccgtctttccatgggatgacggccatcgtgctgccacccagccacaacgccacccgttccatcaccagcgtgccccatgacgatatccacgcgaatacgccggccagccatggctcgcaccatgcgcaggccaatgccatcaatcccgccatcgtggccaatcccacaaacggcgacaccaacaggttcgccggcacggacagcaacggcaactccggttccatcaacacctgaatcggcagggtgaacaactgcgcggccacggtcatcgccatcatttcggcgatgccgtgcggcatcgctcgctcaaaggcaccggccagccgccccgcaaacagcacgatacccagtacggcggccgaagacaaggcgaatccgtagctggccgacatatccggattcaccgccaatacaccgattaccgtccagcacagggcgctcaacgcttgcgtacgccgccccatcgcatacgtcaacgcacctatcaatcccatgatgaacgcgcgggtgaccgaatcactggggaacatcgccaatgccagcagcacatatactccagagaccagcaacgccgtcagccgccgatcaagcagcatccacatgcataaccggcgcaccaatcccgccaccagtacaaagtggccgccggatacggccatgaggtgcatgatgccggactggcggaactgattctccaacgtttgcgcatacgtgctgttgaccggcatcggaccggtctcgccgccgatataatcctggccaagcacacccatcgtcaatcccggcaccaacacacgcccctgatcggacaattgttcggtcacggtgaaaaacgcctcctgcacatgcgcaatcgcggcgagatgccacggcggagcccgcacctgtgctaccggctgttttccttccaagagcagccatagtggtatgcgtccatatcgcgcttgctgcaatacgcctgtcagcagatggaccgcgcctcgacgcaactgcccacaatacgattcgtcggcgtatacacgcacagcgaccgtggaacgtacatccgtaccatccacagtgatgccgctcagccgtatgtccgtctgacaatcgtatgtgcgttggtccgaagcgatcacgggcgtcgtcaccgtggccatgacttcgtggtatgaactggattggcgagcttgtgcggaggcaggatcatgccaggcaatggtgtccgacgcgattgccgtcatactgccgatgcacgccaccgcaacgcatacggtcaatgttcccgtccaccggatccgcaggcggaaagacaccacaatcatcgccgccacggcagcacatgacgccactgttataggcaatattcgtgtgacaggccattccatgccgattatggtgacgtcaatgccagctccggcatcggcctttgcctgaccggtgccgagtccatcagacatcctccatgcgaataatgcgtgcgctcccagactcgccgcccacatcactatggcgatcggcagcatcctccaatcgcggctcccctgctcgcgcagtatccaatccctgctcatccgaccgtcacctgccctcgcatggtctccaacgtcttggagccgatgcctttgacatccagcagctgatcgactgatgtatacccgccaatcgccgtgcgatgatcaatgatccgctgagcggtaaccggcccaatacctttgatggattgcaattcctcagcggtagccgtgttgaggttgataagaccatgcgtggaagcgccggcatcgctgccgtccgtctgcatgtgcggagattgcgtggtatccgattcggggttcgctgtggcatcggaatgctccgactgctgcggatccgtgcgtttctcgtccgtggtgttctgcgatggcatcgtctgatctccagcggagccgcccgtggtctgcatggcggtcggttgagacagcatggccatattcatcgactgttggaccagcaatgccaagctgatgccaagggcgacgatcagcagcaatatcacggccaaggcatgcccaatggtgaacgacaatcgcggctgatcccgggtgagtctggctgattcgccgacggcatcggcggaacgtacgccaatcagatccgataacgcacgtttgtcacgggtcgcctgccgcaggccgctctgcgccctttggggcgggtggccagccggacggatccgtgcatggccaggaggcggcggaggcgtcgtgggccgttccactcgcggttggggcatggctgcgctctgcctgctgaatgcgcgcaaacggttggcggcatggtctgcgcgatggttatgagaaacgcccatgcatccacgctgatggattcatgggcgtttgtccagctgaaacggggtatgtggttctagcttatgaagttatccacaattgaggtgggcggttgacgctccctcagtctcgctacgcgagccagctccctcaaagaggggagctggctcgcaacaagtcactccgcgggaacgatggagacgatcttcggggccttgacgatcaccttgcgcggctccttgccgccaagacggtcggcgacggcggccagcgcctgcttctcgagatcggccggatcgatgtcgaccggcacttcgagcttggcgcgcaccttgcccttgatctgcaccacggcggtcacggtgtcgtggcccacgtagcgttcgtcggccaccggccacggctcggcggacagggattcggcgtgaccgagcttgctccacatctcctcgcagatgtgcggggcaatcggcgcgagcatcaggatcagcggctccacggcggcacgcggcacagccttcagaccggtcaggtggttgttgagcacgatgagcttggcgatggcggtgttcgggcgcatgccttccatttccgcggtcacttcggcaatcgtgttgttgagcagcttcagggtcttttcgtccggcgtgtcctcagtcacatgggcctggccggtggtctcatcgaccacattgcgccacagacgctgcaggaagcgcatgccaccgaccacgttgcgggtgttccacgggcgagactcgtccagcgggcccatgctcatttcgtacaggcggaaggtgtcggcaccgtagttctcgtacatgtagtccggggtcacgatgttcttgagggacttgcccatcttgccgaactcgcggttggcatgttcgccgttccaggtgaaggtcggctcgccggaggcgtcggccgggccttccacgacctcgtcggccggcacgtactggccgcggtcgtcggtgtaggcgtaggcctggatcatgccctggttgaacagcttgtggaacggttcggccgagtccacgtagccgaggtcgaagagcaccttgtgccagaagcgggagtagagcaggtggagcacagcgtgttcgacgccgccgatgtacaggtccacaccgccttcatcacccgagtacttgttgtggttcgggcccatccagtagtcgaactcgtccttctccaccatgtgcttggtgtcggtcgggtcgatgtaacgcatgtagtaccagcaggagccggcccagttcggcatggtgttggtgtcgcggtagtaggtcttcttgccgtcgcccaagtcgagctcgaccttgacccagtcctcgttgcggctcaacggtgcctccgggttggactcggcgtccatcggatcgaaggtgcgcggctcatagtcgggcacgtcgggcaggttgatcggcaatgcggaatccggcagcaggtgcggggtgccgtcttcgccgtagacgatcgggaagggctcgccccagtagcgctggcgggagaacagccagtcgcgcagacggtagcttacggtgcccttgcccacgccggcggattcgagccaggcgttgaccttggcgatggcgtcgtccacgcgcaggccgttaaggctcagcgcgtcgcccttggcttcggtggcctcgacggaggagttgatcacgatgccgtcatgggagacgaacggcgccttgccctcgtagttggccaagtcgtcgccggaatccggcagaggcgtgacggtgtagatgacaggcagaccgaacttcacggcaaagtcgtaatcgcgctggtcgccaccaggcacggccataatggcaccggtgccgtagtccatcagcacgtagtcggcagtaaacagcgggagcttcgcgccggtgatcgggttggtggcgtacaggccggtgaacagaccggtcttctcaccggcctcgttcacgcggtccttggcggtcttggcttcggcggccagacggtaggccttcaccgcctcgaccgggttggcatagccgcccttccagtcttcgggtacatcggccggccattcggcgggcacgttctccagcaggtgatgttccggggaaaccacggcgaacgtggtgccgaacagcgtgtcgggacgggtggtgtagatttccatgtccttgtcaccgtcggcagtggccacggtgaagtgcacggaggcaccatgggattcaccgatccagttgcgctgcatgagcttgaccttctcaggccagttgatgccgtcaagatcggcgatgaggcggtggccgtacttggtgatgcgcatggaccactggcgtagctcacgctggaagaccgggaagttgccacgctcggacttaccttcggcggtgacctcctcgttggccagcacggtgcccagacccgggcaccagttgaccggggacttggagatgtaggccaggcggaagtcgttcaagatatcctgctgctcggcgtcagtgaggtcggaccactgcttgccgtcggactcgtggcccggaatggccttttcgccggattcgaacttggccacgagctcggcgatcgggcgtgcggagcccttggagccggacgggttggtggcgtcctcgtcgtaccaggaatcgtagatgcgcgagaagatccattgggtccagcgcacgtagccggggtcgatggtggcgaacgtacgacggttgtcgaagctcaggcccatacggtgcagctggcggctcatgttggcgatgttcgcctcagtggtcacgcgcgggtgctggccggtctggactgcgtactgttcggcaggcaggccgaaggcgtcgtaacccatggcgtgcaggacgttctcgcccttcatgcggtggtagcggctcaccacgtcggaggccaggtagcccagcgggtggccgacgtgcaggcccttgccggacgggtagggaaacatgtccatggcgaagtaggcggtgcggccttcggcgttacggcccttgccgtccttcaaatcgccgttgacgttggcggcccagaaggtgccttgctcgtcccaaatcttctgccacttgttttcgatgtcctgcgccagtgcggcgttgtagcggaagttgggctcttcggtttgcgtgctcttctcgttgtcactcataaatcagcaaggtagcctcgcaactggacacgtcgtcaatcgttattcagcatccgagacgatggctttggggtcgccgttcagcgaaaccgtgagctttgtttggcttgtgaacgtatccttggcggccgtccagctgccatcctcaaccatgtcttccaatgcttccgcgattttctgcgccaattggctggtgccttgactcacggcgatgccataaccgacctcgcccttgtccgcaatcacgtccatatactggggcccgttggccgcttgaagaccggaaagcaccgccatatcggaggctatggcatccgccgaccctacttgcacggccgtgacgcactgcgcataactgctgcgctcctgaatccgggcctgcgggtggttgccgcggaagatgccgactgtctcgtcacctttcactgcgcacaccgtgccgtcgcctacgtcacccaccgaacctgcgtcattggtgaatcggccacgctcatccgacctgaccagcaaaccgacgctggtcgtgaggtatggtccggcaaaatcaacgatcgcgctggactcatcggtgataggccaagaggcgacgaccatgtcgacctgtccattgtccagcatggagcgccggttttcggggcgaacctgtttgaagacgatctgcttgttcgcatagccgagtttggcggccacgtatttggcgatggtgatgtcgaagccctggtatgtgccgtcatgccatgctcccaccgatggctcgtcggctgcgaccccaatggcgatggtgggcccctccggcgctccggagacggtggtgacttgaatttggccgcaaccggccagaccggataatggcaatatcacgccaaaggccgcggcgaatcctgccatcagtcgggagcgaaatccgcgccgcatcggacggcgagcgcggagcatgctacggctggcgaacgatgaccagtggtgcataaccgtcaaacgccttacttgaacatgcgcgaacgcgtgaggaaccaggcaaccgcaccggagagcaccatggaaatcacgataatgagcatgaaaccccacggcttgtcagtgaacggcatacccatcatgccgccatcgaagttcatgccgtacatcgagaagatcagggtcgggatggacagtgtgatggagatgatggtgaagatgcgcatcacgttgttcaggttgttggacacgatcgaggcgaaagcgtcggtcatgttcgcaagaacgccgctgtaaatgttggccatctcgatagcctgcttgttttcggtgatgacgtcgtcgagcaggtcctcgtcgtccgggtattgcttgatgcgttgcagggtggtgagcttctccatcacgatttcgttcgatttcagcgatgtggtgaaatacaccaaagtcttgctcagctccatgagcatcacgatctcgcggttctgcatggagtggcgcagcttcagttcaagcttgtcgctttcgcggtcgatgatgcgcaggtaacgcaggtacatcgtggcgttgcggtacaggatctgcaggatgaagcgcgaacgcatgaaggtgttgaagcctcggatcgtgccttccatgaatgggtggagcacgggcgtgtcctgcatgcagacggtgatgatgaggttttcggtgacgatgatcgacagcgggatggtctcgtaccagtcgcgtccgccacgctcttccacggtgggaatgtcgacgatgatcatcgtgtaatcgtcttcgacgtctacacgtgaacgttcctcgtcatccaaaggggcacgcaggtcggccaggtcgatgccggtttgcgaggcgacggtggcgagctccacatcagtgggttcgctcaaacataaccaggagccgttttccggtttctcgatctgctccacttggccattgattgagctgaagattctcagcatgtcgtctcacccgccttccgcgctttcttactgttctatcgctgtacggttccaaaccgagattagtctagacccaccgttcgaatttgcgagcggggtttcgcatagcgaccatcaccagacgattggctgccaacttggcatgtgcggtcctcgcagatcggtcggcccgttctcccagtcggcgctgtcggcgatggcgggagccttgttgtattcctccaactcccacaggggctgttcgatgggggtgccgttgacgctgtggcgcactttgagccggcaccaacaggcgttgcgcatgccgccgagtgcgttcatgccgtccgggtcaagttcgagcaggttggagatggtggcggtaatccatgagccatgggtgacgagcatcagcgtggtgggcgtgctgtctgaataggcggagtcgatgaccagtgcgcgcacggcatcggcacctcgctgccccacggcggcacggctttccacaccatgcttggtttcgcccccagtgtgctgtttccaagaggcgtagtcgtcggctgccacggctttgatttcggcgcgggtcatgccttcccactcgccgaagctgcgttcacgcagtcgttggtcacaggtgactggcaatcccaaaatatcggcgaaggcgtgtgcggtctgttgggcacggaacaggtcggaggtcatcaccaccatgcgccggccagcggcgggagcctcctcgaactggcgcgtatcagtgcgttcggcggcgtcaggaccgggctgggcgatggcttcgggatgctcggcaagtcggttcaccttggcccagtaataccgtgaagcgagcgcgaatccggtctggtcaacctgccattggcctacgatgtcgagcggcacatcgatctggccttgcaagcgatgttcgagattgtattgcgtacggccatgacgcagcatcatcacttcatcgatcatcggttttcaccacctcgttctcttgcggtttgccatactcatctcagcacaacccctagaatggcggcatggagatttctgagtcgacttgggcgttcatcgccaaacaccgccgtgaagatgtgcgtgatgtggccttgcacgccaagcatgatggcgacgtggatgtgccgttcgcgctggagcaaattgccggctggcagcgcgcttcactcaagctacctgactgggcgtcccatgatgggctgattttcccgccgcaagtcccaatggaacaatgttccagccaattcaccgcacagtacaaggctcggctggtacagcgattgttggccgaagaagcagtcgacgacgactccccgacatccctagtcgatctgaccggcggtttcggcgtcgacttttcttacatgtcccgagtgttcaatcgtgccatatatgtggaacaacaatccattttatgtgatatcgctcgccataatttcccgatactcggccttgaccacgccgaagtcatcaatgatgattcaacagcagtgcttgacacgcttggccgagtctccatgatcttcctcgatccggcccgccgtgacgatcatggctcgcgtacctacgcgattgccgattgcatgccggatgtgctgaccctgaaggatatgctgctggccaaggcaccgacggtcatggtcaagctctcccccatgctcgactggcataagaccgtcgccgatttcgccggcgcggtacatgaggtgcatatcgtctccaccgggaatgagtgcaaggaattgttgctggtgttggggcgcggccgttacgcctcaccgctcgtggtatgtgctaatgacgagcaggtgctgtcgtacaaggccggcgataacagcgacaatcacaccactatcagcgattctgccttggctgcacgcaatacttgcaataccgaagattccctgtctgaggaaagcgcgaacgacttcgattcctcgcattggaagtacctttacgagcccaacgcctcaatcatgaaggccggatgctttgatgttctcgaacagcgcttcgccgtgcatcacatcagcccgaatagccacctgttcgtggcggccgaacctattgccgattttccaggcaggtcattcgccatcgaatccatcgccaccatgaacaagaaagaactgaaacagctattggccggcctcacgcacgccaacatcgccgtacgcaatttccccctaaccgtggcccagctgcgcaaaaaactcaaactcaaggacggtggtagcacctacctcttcgccaccaccgacgcccaaggccgtcacctagtactgcgcactaaaaagcgaaaaagtggctccctctgacgaggaagccatcaatacgtcagctaatcagtccttggcgatggtcttgccggcggtcggaccggaggcaaggtcctggatctcggtgacttcgagaaccggaatcacggccggcttcttggtgcccttttcctcggcgaccttgacctgctcgttgtagatgtcgtcgtcaacgtgcagcaccacgttgccgcggaagcggtagccctgcttcttctcgaggttggcgaaagcgatgaccagcggggaaccgttcttgaggttctcatagtgctggccggcggtgcgctcgtggtaggcgatgtgcgtgtcgtccagcacgaacagggacatcttcgggccgaggtccagttcgccgtccttggagacggtggtgatccagccaaggttgttcttgatgaattccttgatttccggagtaatgactgccatgtcgaatcctttcatgattgatacggataacgtatccttactctttccagagtaccggtttcgaacgcgactagcccggatgttcgctgtgagtaacctcaccttcgcacagctttcatccggtttttgcctgcttggcgatgccatgccccggtcgcgcaccagccacacacctgtcacacacccgacacccatcgaccggtcgattttggccggtagttcccgtaatctgtgagccgagagagccacaagttttcctaactgtcctgaggtgcaccatgggtttggtcgaacgtttcagcaagctgcgcagccgctggtcccgcaactttcccccgaatctcgcccgactcatgttgctgggctgcgctgcattatggggtggcagctatctgctcgccaaattcgccatggaggcgattccgccccaatggctgatgggtctgcgcatgatcggcgcctgcctgtgcatgctggccttgttccataagcacatcgtgccgtatctgacgccgaaaatcattgtgccggcgctcgtggtgggcctgacctactggggcacgatggtcacccagaccatcggcctgcagaccattgaaccgggccgcagcgcgttcctgacggccgcctactgcgtactcaccccgttcgccacgtggattatttcaaaaaaccgcccgaaggccatcaatctggtcgccggcgtgatctgtctgatcggcgtcggcttcgtctcgctgaagccgggcggttcgctgtcgctgagtgccggcgactggctgaccatcgccaccgcggtcatcttctcgttcaatctgacctgccttggtgtctacaccaaacgcttcgaccctatcgccgtcacttttgtgcagttcggcgttgccggcgtattgttcatcatcggcgcgttgttcaccgaacccatgccgaacgccagctggctggcaccctcagtagtggccagcgtgctctatctgttcctcggcgccacgatgagtgcccagatcatgcagaacatcggtctggctcacgtgcctgcctcgcaggcgtcaatcatcatgtgtacggaaagtctgttcgctgtcacgttctccgcgctgttctggggcgagacaatcatgtggagttcactggtgggctttgcgctgatcttcgtcgccgtgctgatgtcggtaatcaagccgaccaaacagtcgctgcaccggaactgacgattcagtttcggccatggatggtcatgggttctccattgccctgaaccgttacggtgaaggccgaggctcttgaaggcgtgcaatcggaaatcggacttggcatcgccaaactgcatttcgagttgggtgccggcaacggcagcttcgcttgggctgcatgacgttctgctgaacgtcgttttcgctccaagcgaaccaatttcggttgttctttgcgctactttgcgccactttgcgctgattcccactgctcatcggcaccatatttttgagtcattccacattccgctggctaggttttgaaggtctcgtgtaggcatcctctcggtatcaccgagccttaagcaaccttccagcccgacactttacggtcgtgtcttgtgaagaagtttttcgaaggtctttccctctcatccatcgtggcgggcacccttgccgccgtcacctcattcttactggcatcgaaaatcggtatcgccggctcggtaatcggcgcggcagccagctacatcgtctccgcggtggccaccaaaatctatcaaaacatactcaccgcctccggtgagaaactacagtcggcctcgtcttccggcaatgacgatgacactacggataataagtccgataaggcagccgaatccgagtccgatacgacgatgaccggcatggtcaataccgtttccaccgcgcgcaagccgcgcgaagtcgtgtccaatcgagcgaacggacgaacctattcggtcaatgaactgcgcaaggcccgctcccataattcgaagcgcaccgccattatcgtcacgctggtatccggcctgctcgccgtggcagtaaccgccggcatcgtcatgctagtcacgcagggccgtggcacggaccatatcatcactccgtccaccacgcccacgcaaaccgacaccaaaacgcagaccgacacgtccaatcagaataacggactgccgcagccgggcattaccgacggttcgaatgattccaacaccaaggactccacatccggctcgtccaacgacggcaccgattcaagcacgtccggctcaaccggcaccgactcctcaaccgattccaacaccaatggatccaccgatggttcgaccggcaccgattcctccactaattcgggcacgactggcggttccaccggttccggcaccaccggaggcaccaccggcaccggcaacggttcaaccggatcgggttcaggatcagccaatggctccggttcctcttccagctccacgggcggatcatccagttcaaactccggtaatagcggttcgagcggctcctcaaccggtagcagcagcggaaccggcatcaaattcattggctgacaatcgccgactcgatagcagcgatggcggcaatgccagtcaatgacgtggggcaatgagaacatggaacgtatgactaccatcattatgaatacctctgagggcagcatcaccatcaacctgttcgacgacaaggctccgaacaccgtggccaacttcctgggcctcgccactggcgagaaggaatgggcggacccgtacaccggccagccttcccacggcaagttctacaacggcctgatcttccaccgtatcatcaagcagttcatgattcagggcggttgcccgctgggcaccggtaccggcggccctggctacgagttcgacgatgagatcgacccgagcctgaagttcgacaagccgtacctgttggctatggccaacgccggtctgcgtcgcggcatggacggtaaggtccatggcaccaacggctcccagttcttcatcaccaccgtgccgaccccgtggctggacggtcaccacaccatcttcggtgaggtcgccgatgacgactccaagaaggtcgtcgataagctcgaagcactggacaccgatccgatggatcgcccgctcgagccggccgtgattctgtccgtggacgtggcggagtaagaccgacaacatatacgaaaaggtcctgattctgaaccgcaccccgattgttggactgaagtaattcagattcgatgatcggaggtgcggtttctcatgtgtagggatcgcaggcgtcattacgatgacggtttcatgcgggtcgtcgccgacctgatccggggcggggccgggaggcgttctctcgcccgccggcttggcgcgcccgtcagtaccgcgggaaaatgggtgttgtcataccggtttggcggggaggcggcgctcatgggagaacgcgaaggcaacaggagatacgactacgagacgaagctcgcggcggtgcgcgaccatgtggagcatgggctgacgaaggccgaagtcatggagaagtacaggatcgcgggtcccgccccgttggagcgctggtgccgcgagtaccggtccggcggcccggacgcgctgcgtccgaaaccgaagggcaggcccaggggcgcgaaatccaagccgaggccggctcccacaagggaacagctccttgaggaggagaacgcgtacctcaaggcgagggtcgcgtacctggaaaaagtcgacgccctgctggcgcggagatcggcaaccgggacagaacggtgatcgtctccatgctggcggggccgggacatcggctccggcacctgctcagggcggccggactggcgaaaagcacgtattaccatcttctgtcgcatccggccgccgtgacccggccggacatcgagccgatggtcgccgagatattcgcgcgcacgcccaacgggtgcggccaccggcagatacgcatgtgcctcgtgcacgagttcggggtgcgggtgagccacaagagcgtgctgaaggtcatgaggcgcatgggcctggaatgccggatacgcaggccgaacccgtaccggaaatacagctcgtaccgggacgagacgggcgcgagggcggagaacctgctgaaccgcgacttcacggccgaccggccgtgggtgaagctgggcacggacgtcaccgagttcagggtcgccgacggcaaggcgtatccggctcccgtatacgatatgggatccaaggagatcgtggcctgggacgtcagccggcatcccgacatggcccagcagcggcgcctgctcgccatgctcgaggagaagctgcccgaagacgccgacccgatcccgcactccgattaagccgggtttgttgttaagccggggaacggttcggggtcttggtggctggccgtgtcccatgtggtttcccggcttaacgttccgggttatgttcgtcttgtcccatttgattcgaacgaaggagtttgccatgggtgagacgacggttggccatgtcgcgggcgaggtggtccgcgcgctttacggggccggttatatggaatccaccataggccagtaccgcaagtccatcagggcgttggaacggtacgccggaggcccggatgcggtgtacacgcgtgggttgggcgcggggttcgccgcgtcgaccttcagtgagcggacgggcggtttcagcaggcagcggtggttcgattacggcaggctggcgcgtttgtgcgactcgtatctgcggtccggttcggtggacctgggcaagtggcgcaggagcaggcttgcggagccggtggttccgggtttggccgtggtcatggagcgttgggaggcgtatctcgccggttcgggactggcttcggcgacggtggggcattaccgtcggatggcgggcttgttcctcacgtggctggaatctcatggggtcgtgtcgttggacggttcggatggctcgcatgtgctggggttcctggccgggctgcgttcacgctggtcggagtcgtcgatgcggcacgccgcgtcggacctgcgcccgttgttcagatggctcgggcgggatgacctggcggacgcgatcggcctggccggcatacgcaggacccacgcgatcgcgggaacgttgcccgacgacgagcaccgccgcttgctggaggcgtgcgcctcgcggtcggtgccgtcgagggacgcggcgatcaccctgctgtcgctgacgtgcgggctgagggcatgcgatgtgatcggtctgaggatcgccgacgtggattgggattccatgagcataggtctggtgcagcgaaagacgggcaatccgttgaccgtgccgatgacgggaccgctggccgcgaggctggcgtcctggctgttggacgaaaggcccgccaccgacgacgaccgtgtgttcgtgcggtacaaggcgccccatgtcgcgcttcggggtcattcatcggtgtacgaggcgatcagccgtgtcatgcggcacgccgggctcggacgccggggcggttccaggctgttgcggcgcaacgcggcgacgaggatgctggaggcggccacgccgttgccgacgatcagcgcggtgcttggccacgccgaccccgattccacacgcgtctacatggccacgcaccgcgggggaatgctcgcgtgcgtgctgcccgtgccggaaggcggatcgtcatgagacccacggaacacggattcgtcggcccgctcgccggcgaattggaggagtacatccgtttcaaggcgtccatgggcaggcatggcgccacccgcgtccaggtcctgcgctcgttcgaccggcattgcctcgaacacggggccgtgcgtctggagcggggcgtcgtggagcgatggatcgcccataggatcgacgcgaatcccgggggttgccgctcgtggttctcgtacatcagggacttcggcaggtggatgcgactggcccacgatcccgacgcgtacgtgctctccgaccagtggaaggccggatccccgcgtccgacgccgtacctgctgacggaccgcgaggccgccctgttcctgcgggccgcgggaacgttggagtctccgtcgccgtgggcgtggcagtctcgcgcgttcttcatgctcatggcctgctgcgggctgcgcacccgagaggtcaggagactcgccgtcgggcacgtcgaccacaaggcccgttccatcgacgtggtcgattccaaggccggtcgcagccgcaggctgcccgtgggcgacgaggtcgccgccgaactgctggaatgcgaccaacggtcccgcgaacgcttcggagacgaccgtcccgcgttcttcgtcacctccaccggcaatccggtctccccgggcatgcccggcgtggtgttccgccgcgtctggacgcgggccgggctcgagtggccacaagccggcaaacggcccaggccctatgatttccggcaccggttcgcgttcgcgaacatcgagcggtggactcgcgacggcgtggacgtgatggcgatgctgccctatctggcggcctacatgggacacgccggcatcgacagcaccctctactacgtgcacgccagcctcgatttcatggacggatacgcggacctcgtcgccgacgccgaacgcgtggtcccggaaacggaggaaccatgagcaaggcaaggaaaacggccgccagctccggtgaaccggacttctggcgagtcgcgcgcgactggctgcaccactggctgcccaaggtgcggggcagctcgccgaagaccgtcgaggcgtaccgcatcggcctggaatcctacgtccgatggctcgaaaccacggaaggcacgcagcgcagccacatcggtttcgggcatttcgaccgggcgcgcctgggccggtgggtcgaatggatgcggaccgagcgcgggtactcggaccgcaccatcatgctgaggatgacgacgatgcgcgtgttcctcgaccacgcgggcctcgaacacccggcattgaccgcgctgggcaacgacgcggccggcatacgtgtcaaaccacccgcgcgcaaacccgtcgaccacctcggggaggagcacaccaaagcgttgctgaccgcatggggcaccggcgacgccaaatcgcgcaggaaccgcatgctcctgatcctcatgtacgacaccgccgccaggatcggcgaactcgccgcactgaccatcgcggacgtgggtatggataagccggccagggtcacgctcaccggcaaacgcggcaagagccgggtcgtgcccctgggagaaaggacacgaacccacctggccgcctacctcgaggaattccatcccggaccgtccatgcgcgacggcgacgggccgttgttccactcgacgaggaacggcgccatccagccgctctccgtggaccggatcgacgagatcctcaaaaccgcggcggccagagcacgccgcgggacgtgcccgtccatgcccgaacgcgtccactgccacctgatccgccggacccgcgccatggacctctaccaacagggcgtgccgctaccgctcatcatgcaactgctcggccacgaaagcatgagcacaaccagcgcgttctacgcgttcgcgaccctcgacatgatgcgcaaagccgtcgatgcggccaaccccggccccgacccctccaaggagacatggctcagcgagcaacgactccgacaactacacaccctcaaataacccggaacgttaagccgggaaaccacatgggacacggccagccaccaagaccccgaaccgttccccggcttaacaacaaacccggcttaatcactgttaaaccgatgtcggtttaacagtgacatgggctggcagtaccggcaccggtggtggcgcgaccggctcgcgggactgaacatccgccagtccatgagcaggaagggcaactgcatcgacaacgccgcgaccgagcaggtgttcggccacctcaaggacgagttccacgccggacgcgagttcgcctcatacgaacagttcaagaacgaactggacgcgtacatcatccactggaacaccaaacgccgccagatacgactggagggacacaccccggaggaattccggaacatgtcccccacagcctaatcaggtacccttaataaaccacgtccaacaatcggggcgcagttcaggtattccagtcaggaccttttcgtgttcttggctcccctctctgagagggagccagagtaaggtaacggcctacttcatcttgcgcagtcgaggttcggcggattccttggcaccagtgatgcggtacacgtcgaacacgccatcaatcttgcacacggctgccagcaacgagttgagatgctgcggatcggccatttcgaagctgaactggctggtggccacgcgatcggaaccggtggcgatcgtaccggaaatgatgttcacgccatggtcggaaagcacacgtgtcacgtccgaaagcaggtttcgtcgatccagcgcctcgacctgaatcttgaccatgaacaggcccttggtgctggtccattcgacttcgaccacacgctcaggctgcttgtttttcagatcgatcatgttctggcagtcggtgcggtgcacggatacgccctgattacgggtgatgaagccgatgatattgtcaccgggcaccggcatgcagcaacgggccagcttgatccacacatcgcccacgcccttgacggacacgccggtggagctgctggaggccttgcgttccatgggcttcagcggcaggacttcctgctcgacttcctcatcgacctcgtcggcacccgcatccttgaccagatgcgagatgacgttctgcgtggagacctgtccgtcaccaatggcggcgaacacggcgtccgcgttcgggaagttaaggtcgtcggccacacccaccagtgcttcgggcgtaagcaatgtgttgaccggcagattgcgcttgcgcatcgcgcgggtcagctcgtcacggccctcctcgatggcttcagtacgacgctccttggagaaccactgacgaatcttgttgcgggccttcgggctcttgacgaagctcagccaatcgcgtgacgggccggctgtatcggatttggacgtcagaatttcgacggtatcgccattatcgagcgtggtgtcgagcggcaccaaacgaccgttgacgcgcgcgcccatcgtacggtggcccacttcggtgtgcacggcgtacgcgaagtcgaccggcgtggcgtgagcgggcagggatacgattttgcctttcggcgtgaacacgtagacttcggacgagccaaggtcttccttgagcgagcccaagaattcgttggaatcaggggtttcgctggtccagtcggcgagctgctgaatccatttgaggttatcgacctcggaaagctcctgattgttttcatcacgctttcgatcggacttgtccggcgagctcagggcgcggccggcctggccgttttccttgtatttccagtgcgcggcgatgccgaattcggcgcggcggtgcatgtcccaagtgcgaatctggatttcgaccggcttgccaccggggcccaccaccgtggtgtgcagcgactggtacatgttgagcttcggcatggcgatgtagtccttgaatcggccgggaaccgggttccaccgcgcatgcacggcaccaagcgccgcatagcagtcctgaatggtgtcgacgatgatgcgcacaccgaccaaatcgtagatgttcgcgaaatcatggccgcgcacgatcatcttctggtagatggagaagtaatccttcgggcgtccggtgacgtatgccttgatgttctgctcgtcgagatcctcgttgatctccgccagaatctgcttcaggtacacatcgcgctggccggctcggcgagccaccagtaccacgatctcgttgtagatcttcgggtagagcaccttgaagctcagttcctcgagctccgtcttgatggcgttcataccgagtcggttggccaaaggtgcgtacacgtcaagggtttcacgcgccttcttctgggcggacgtggtcttcacatagcgccaggtgcgagcgttgtgtacgcggtcggcgagcttgaccaccaaggtacgcacgtcgcggctcatggccaccacgagtttgcgaatggtttcggcttgggcggaatcacccacttcaagctgactcagcttggtaacgccatcgaccagaccggccacggtgtcgccgaattcggcgcggcattgatccaacgtatagtcggtgtcttccaccgtgtcgtgcaacaggccggctgccaccacgatcgggcccatgcccagatccgcgagaatctgggaaacggccagcgggtggatgatgtacggctcgccagacttgcggcgctgggcggagtgctggatgacagcacgccggtaggcacggtcaagaatggacaaatcctcatcggggtgatgggacttgcacaccttcttgattggatccagcggattgagcggatcggcactgatctcacaacccaacttacgggcggcgtactgctcgccatcaatctctgccatgccagtcacctccctcgtcatgaagttcattgtagccgcgaaccggagccttgtgcattcacctgttcgccatcattggttccacaaccgttgttgccgtcatcaccttagtcattcaaccggcctaatccggtcaggacgccactcccgtcgaaccgaacccgcgttcggcgcgatcggatccgggcagtgtctcggccgggatgaaccgagcctcaacataccgctgaatcaccaattgagcgatgcgatcgcccggatggaagacggcggtgtgcttcggatcgaggttgatcagaggcaccttgatctcgccacggtagccggcatcaacggtgccaggcgcgttgagcacggtgacgccctgcttggcggccagcccggaacgcggatgcaccaacgccacgtagcccgcaggtagggcgatggccacgccggtgggaaccagtgcccgttcaaaaggcttcagcgtcacatcgacggtggtgatgaggtcggcaccggcatcgcccgcgtgggcatagtgcagctgggccggatgttcggggtcgaggctcttgaccaggacctcggtggattcgggctcgttgtaggtctcgtcgaacgccatcaggcggcgcactcctcacacaccggctggccatcctcgtccgtgtaggcgagctggctgcgatgcttgaccaggaagcactgcgagcagatgaactcgtcaccctgcatggggatgacggtcaccgaggaatcctcgttgctcaaatcggcgcccggcagttcgtagtcttcggcgatggcgttctcatcgtcgtcgatgtcgctcgaggcgttctgcgaggacttccccagcgcctgcagcgattcctcgtcctcatccttgttgcggggggaatcataatcctgagccatcatggtcctttcgtcgtctttggttcgtaagtcgatatatatagcacggtcagcgccgtactcgcccataggatacacgatttgaaatactcgtaaagttcgacacgtggggcatacttaaaagaagtaatgtctttgcgacggaaagtggtgcgaatatgccagatgatcggcttgaaaaagcccgtttcgtgcgcgtgagcaagacggggacctcgtattctcccttggcggcagggaaatggctgtgagcgtggacgacacgctcgaacgggcgattcttgaggccaagcaggtcagaagcgagatgcgacaggctccccagccgcatcagcagtccactttgccgatttcccagatacagtcgctgattcgcgccggtgccgatccggcccgtgtcgcggagaaatatcatctgagcgaaatgctggtacgtcgtttctccatggctgtggagaccgagaaacagtatgccatcgaacagttccttgccgtggcggcacccaaagacagcagggtgcgcaccatcagcgaactggtggaacgcacgctggcctctgcgggaatcggcatggaatcagtgacctggaaatccacccgacgtggacttgagccttggcgcatcgtggcgatattcacttccgcgggccgtgagatccatgccgaatggacgtggaatatgcacgacaattccgtgatgagcctgaacaatgccgctcgaaaactgctcggcgaacagaatccggaatcagccacggattccaaactcaagccgacgattcccgaactgcccggcgactccgtacgctccgcgcgtatcgagcgcgccgtgtctgcttgggcggctcctacgccttcgattccggccgcacggcctgccgcaatccggccctctgtcacttccacaggttccatgcccccagtggatctatccacgtccatctcaccggccacgacccaggctcatggcactacggcccccagtccggtctcttcgcagaccgccggatctgtttcgccatctgccgcaggattacagcaatcgcctgccacggcaccagagcagggctctgacaatgtttcggacaagaccatacggagtggccccaatgcacagctagtagccaccgagcaggagcgggcggccgaatccgccgccaccgaacatgaggcaccagccaaaccggccaagcgtaaatcaggacgttcggccgtaccaagctgggacgagattctgttcggagactgaatttccgaatcaggccatatcgatcaggcagggaatatccatttccaatgctgtttgggagccatgcacgctcggcaggtgggtggccttgtctccttgcgtacgcgaatcgacgagggtcacggctcccgctgcctgcacgaccacatcgccgagcattggccggactcgctcgcagaccggtccaaacaatccgtccgcgatggcctcatccttggtccgcaccaaggctcggtcttgcagacaatcgcgccaccggcaagctatatcctcaggtcgttcatccggctcggcatacagcatcagcgagcgcggctccccccgaccagtgacacgcctcgggtgagctgcggttcaacggcgatgtcaatccgctggtccatgtcggtttgcaccatgccgtggtcggctacgatgacgatcagcgtgcctttgggtgcgctgcgtttcaggagcgcgagctgggcgtcgatatgttcgaatgcggccacccagtgttcggaatcccacccgtaattgtggccgactttgtcggcgtcacggatgtacaggtaggtcaggccgggggtgcgggaggcgcgtgcggcggccagcacacgatcgcgtggggtgacgttgccttgatagtcggtgcctcgcaatgcggcttcggtcaatggcgatttggagaacttgggcaaccccgagctcgtgacgcgcacctcttgagccgcaagtttctcgaacaccgtctcctcgcgctgcaggtcgagcggatcgaccatgggcggcacaggaatgtgcggattggctggtttgggtgccagcgcgtctttgaactggatgagttggatgagcttatggctggcgggttcgagctgcgtatagcccgccattgcggtcagtcccgggcaggttccggtaccgaatgcggccatggccgccacagtggtgcttggagcgcaggtagcgatgggacgctgattggcgctttcgttcatcagcgaacgcagatagggcgcgtggccgaggcgcatggcgaggttccagtagcccaggccgtccacgagcaccacgatggccgattcggcatcgggcagccccaacgcgcgctggcatgccttgggatcggcgtggaccttggtgggggccggatgtccgatggcggcggacaaggcgggcagcacggcggacaggtgcagtgctcccccacgccgatcggccggggcgtcatccccatagcccactgtgggcaccagccgcagcaactcgtccatatccggcgtctcaacactcatagttgcccattcaagtagcacccctccccttggctcagtgcgcagagaacggttctcaataacaactgtgcgctccaacgcacataatcaaacaaacgcacatcgactgaaacactggaatcacgccgttttatcggcaaacatgtgcgattggcgcaccgaaaccagcgcacagttgttatcgagaaccgttctctgcgcactgtttcgcgccctcccgctaatatgggggcgttcgaaagggagtttcatggcatcacaccgcaaaccgtccgcgcaaacctatgatccgcgcacggtcaaggagcatatcgtcgagacgccgctgaacgaggagatgagcaagtccttcctcgagtatgcgtattcggtgatttacgcacgcgcactgcccgatgcgcgcgatggcttgaagccggtgcagcgccgcatcgtctaccagatgggcgagatgaatctgactcccgaccgcccgtatatgaagtccgcccgcgtggtgggcgaggtgatgggcaagctccacccgcacggtgattccgcgatctacgaggccatggtgcgtttggcacagccgttcgcgatgcgtctgccgctggtagacggccacggcaacttcggctcgctggatgacggccctgcggcctcccgttacaccgaggccaggcttggcccggccgctctcggcatgaacgcggatatcgatgaggacaccgtcgacttcacgccgaactatgacaacaagctcaaggaaccgaccgtgctgccggccgccatcccgaatctgctggtcaacggcggctcgggcatcgccgtgggcatggccacgaacctggccacccacaatctgggcgaggtggtaaacgccgccaagttcctcatggcgcattcggacgccaccctggaacagctgatgcgttacgtgcccggccccgactggcccaccggcggcacgatcatcggccgcgacggcatccgtgaggcctatgccactggccgtggtacgctcaccacgcgcgccgccacgcatatcgagcatgtcacggcccgcaagcaggccatcgtggtcaccgagctgccgtacatggtgggcccggagaaggtaatcgaacgtatttccgacggtgtgaagaaccgcaagctggaggggatttccggcgcgttcgatctgaccgatcgtcataacggcacgcgtatcgtcatcgagatcaagactggtttcgacccgcatgcggttctggtgcagttgttcaagcacacaccgttgcaagacaacttcgccatgaacaacgtggcgttggtggagggccgcccgcacacgatgggtctgaaggagatgcttcaggtgtgggtggaccaccgccgtgtggtgattcgccgccgcagtgaatatcgcaagaagaaggcgctggagcgcctgcacctggtcgagggcctgctgctggccatgttggacatcgacgaggtgattcaggtaatccgcacctcggatgatgcggatgccgcgaagagccgtttgatggtcgttttcgatttggacgaggtccaggctcagtacatcctcgacctgcgtctgcgccgactgaccaagatgaaccgtatcgagcttgaggccgaacgcgatgatctgaagaagcgtatcgaggagctgacccggatcctggcctccgccgaggcgctcgaccaggtggtcaccgacgagatggacgaagcggtcgccaagtggggctcgccgcgccgtaccgtgctgctggatgccgacccggatggcacgttgacgccggtcgtggcgcagggtgccggggcttcgggcgtgtccaagtccgcgctcgaagcggtgaaggccgccactacgatctcctccgccgaagccgatgtggccgcagccgcagctgcggccaagaagaccggcgaacagtccacgctgaccggagccttgaagatcgaggacgagccgtgcgtggtgatgatgagcgctaccggtttgattgcccgtaccacgccaagcgcgatggacgtgttcaatgcacgatccacttccgatgagcgtttgagagacgatcagatcaccacaatcttcgagacttccacgcgcgctacgtatgggctggtcacgtcggccggccgcctggtgctcgcgcatgtggttgatttgcctgccttgcccgctaccgccacattgtcgctgaagggaggagttcaggccgacgaactgatcggcatgaccgaatccaccgatccgattcgcggtgagcgtgtgattacggcgattgccatggagcagccgacgtccggcaagaccagtgccaaggacgagagcgaggatggcggggccgccgaggccaagccgttgccgtcgctggctatcggtacccgtaacggtgtcatcaagcgttggaatcgtgaggcacccaccaccatggattcttggcccgtcattgatctgaaagatggcgacgaagtggtattcgccgccgtggccgaggatgacgaccgtctggtgttcatctcctccgattcctcgctactgacctttgaggcgaagaacgtgcgcccgcagggtcgtactgcgggcggtatggccggcatcaagctggccgagggcgcccgtgtggcggccttcaacgtggttcccgccggcaaggtggcatggacctatgaagagggcgagaacggcttgacttccggatccggtgcagtggtgctcaccgtggccggcgattccgatgcactgcccggcaccgaaaacggcgcggcgaaggtcactccgctggaaatgtaccccaccaagggtcgcgctaccggcggcgtgcgttcccagcgattcctgaagggccagaacacgctgattcttgcctgggtgggcctctacccgttgcacgcctctacatccgcaggctctccggtcgagcttcccaagcccgatatgcgccgagacggttccggagtagacctcgcctcccccatcgccttcattgcgtaacctcaattaagctccctctgatgggccgagccgtaaagcaaacaccccagtggggtgtttgtaggcgaggagcgaacgatagtgagccaaacaatagagaagagaccctaaacccggcctacactaagcattaaggaggtggcgatgagactactggttgccgtatccaatgaaccgttggcccacgccattcatggtgccctgcttgccggtcgtcatgaggtgtctttggcaagcaccggtagtatcgcgctcgccgctgtcgccaaggagtcatttgacgcagtgattctcgatgaatccctgctcggcatctccaccgagcagctcatcgaatccctacgcaatgcccgtgcctccgtcaagattctgctgctgacttcgacgccactcagcaaaaccattggtgaaggcagccgctggcgagcgctgcctgacgagtacgcccctatcgaagagacgccctacagctccttcagcgcgaattcacgcacaaacaactcagatgccgaagccgaacaacgctcggacaatgctgcctctagcgcacaagctaacgtacgacgcccagatgccgcgctgagcaaaccattctccgatggcgaactgctctcatacgtcggctcgcttgccaccgactcccccgccatgatcattcgtggcaatctcacgttggacaccacgaatcacaaggcctactacgcatccactcacagcgcaatctcactgtcccgtctggaatacagtttgcttgaagcgctggtcaaggctgatggccagttcgtcaacaccagcgagttggtcaaacttgtcggcggcccattcttcgagcaacagggcttactcaagaacgccctctacacactggataagaagctcacccgcgccggcctcatcatgacccaacgaggctccaactaccgcattcgatagctgggctcaatcagtacagccgcatgccttggggaacgggggtgaagccggactggtggaggatgcgggcgaaggggtgacgggcgttgaggggttcgccattgatgtcgctgaatgtcacggagccggtgccattgcgtttgagggcgtaggccagttctgtggcggccttgcgcatttgttcgtcggaatcattgacagcggcttcatggccgaccgattgatcgaacgctgtcaggtgcttggctttggcggccgcgtatagtagcgcgccttgcgcattgagcacgaccgtggctccgatacggcgtgccggtttacccgcaccggcaggcgcgtccggccacgcgatggcggagccactgagatttgcggggtcgagcacactcaatgccaccacggactggccgcgatgctctgacggatgacgcaacgcatccacggtgtcgcgctcggcaaattgggccgcgccgaaaccacggacgaacatgcctcgtaccagtcgaccatgctcctccatgcgattcaataccggatacaacgctgagtagccacccgggatattttccttgtcaatcaccggctgcgcgatgacgccatacctgtccagcaacgtctcgaccagtgcgagtgcccgttcggtctggtcggtgtcttcggcttcagcttgcccgattacggcggaccacaaacctcctaacgtcatatccgtagtggctcggcgaatcggagcgacacgcccacgacgacgtgatgtagtggatttacgcgggcttgctgcgcctgcggttaatgcacgcaccggcgcgaagctggaattggtgaccttaccttgccagaccaagctccacaaggcatccttgaactgctgttcgctccactcttgcggaatgatttcgccggtgtttggattgatgtccggctccgcggtctcattccacgcacgtttggcggcatccatcagttgacgggcatggaacgctcccctgagtccagtgcggtcagaatcgcttccggcatggtggcgtctgaggcgttcgatgtcgtaccatgttccacaccgctgaacaatattgaatccgccggatagaaagcaacctcaccggggtccatcgcactggttcccccggtttttgagccgacccagaccacatcgccgctggtcagcaactcatccagcaatgcaggttggtagtctcgtactcgtgcggggaatactgccgactcccagagtgcagtgggcagtgatatgccctccagctgctcgataacgcgcatgagcccgtcagcaccttcatatcgttcgccgccgaccggcccgataccttgtcggtcgataagaaacatctggaacgcctctgattctactggcttgactgctttacgcgccttggccaatgagcgagaccgaatacggcggaatacgtccttatggagccactgttggccttgctcgtcatcatctacaaagtggccttgcagcaactcgcctttggcagccagcacatccagagtgtgcacggcatccgtagcatcgaggtgtagatcggctatgagctgatcggcggtgaaaggaccatgggttttggcgtaacgggtcacgcgaccagtcacatcatcgtcggcaagctcattccagaaagtgtgctcccccagttcctgttcgacttcgcgaatcacgtccgggttgagcacttgtgccatatcggtggtgccgagcaagcgttcgagcacgtgcggatcgagagacagcagttgcgcgctacgctcggcctgaggttggtcatactggtacatcaccacgccgacgaagccaaagagaatgttctcggcgaaaggcgatggcgactcggtttccacgtccttcacggtaatggtgccggcttgcaatccggtcatcacctcgttcagggcgggcatgtcgtatacgtcttgcaaacattcgcgcgcggtttccagcagcagcggaaagttcttggccatacgtgcggattgcaggagctgtgcggcgcgcagtcgctgctgccataggggcacgcgacggcccgggtcggatcgcggcatgaacagtgatcgggcggcgcattcgcggaatcgtgcggcaaatagcacggactcgcccacttgacgctctacatctgctttgaggtcttctgggtcgaaaaggaacaggtcttgagcaggaatatgtccgtcaccgtccggtagctgaatgacgataccgtcatcggcggcatatacctgcccgtcgaaaccgtagcgttggcgcagtctgcggctgatggccatggaccacggttcgtgaacgcggcggccgaaggggcttaacagcacgatgcgccatccgccgtcttcatcgcgtgtgcgctccacgataagggtttggtcgctgggaactgcaccagtggcggcttgttgctcggagagtaggcgggccaagttggtgatggcgttggcatctaggccatcgtggtggagacgggtgaggattgttgggatgaaggttgggacagctggaccttctgcggcagaactcccccagtccgcttcacgtctaatccggcggcgatttctcgggtgaagcgggctatggtacggctgaaaccgtagtcacggccagcgccttcaccgtgccagaacggcagacgggcggtgcggcccggagccggcgtcaccaccacacggtcgcgggtgatttcctgaatctgccatgtggaggtacccagtgtaatgacatcgcccacacgcgattcgtagaccatctcctcatccaactcgccgacgcgacgctggcctttgccggcgtccgcctcaggcaggaccacggtgtacagccctcgatcgggaatcgtaccgccagaggtaacggccactttctgcgaaccgggacgggcggaaatcaggccattatcccgattccataccagtcgcggccggaaggccgagaattcctctctgttgtattcgccggacatcatgccgattaccgcatcgaacatgtcacgtggcagttcggcaaacggcgcagcacgacgcaccgtggcataccagtcatcagcgttcaaatcgtgcatcgcggcagcggccacggtctgctgggcaagaatatcgagcggattgcgcggcacggccaatggttctatatcgccggcaatcatggcttccagacttgcggccccagtgacaatctgctgacgggtgagcggatagaacaatgcgtgagagacgccaccgacctgatgatcggcacggcctacacgctgcaatccggaggagaccgacaacggcgtatcgacttgaatcaccaagtcgaccgagcccatatcaatgccgagctccaaactggaggtggccaccacgcaacgcaattcaccacgtttaagccgttcctcaatcattttgcgacggtctttggaaaccgacccatgatgagccatggcgatgacatcatcgccctcatgtgagccgacaagcatggtggtggagccgaccacagcatcgtaatgcgtggagaacccttcgcggccttccggagagcccagatcccgcacagtgtcgggattggtgccatgccgggtctgcgcatacaaatcgttcaagcgcgcagtgagtttctcagccacaccacgcgaattaacgaacaccaatgtagtgcggtgcgcgagaatctcatccaaaatactgcgttccaccacaggccaaatggaaccggaggtacggtcgcccgccgctccaaccaacgcggaggaatcaaactcatcactcgcatcagaatcgtccccagaagtggaagaaacatctctatcatccaccggcacaatgcccctgcgttcagcaagtcgctgcatggccggcgtgacaccactgatatgcggagcggaccgttcagcatccacgccaccgacacgctgcttggcattcacggactgcaaatcacgcatgttttccaacggctcaatcatgcgcaaatccattgcaggccgcccaccgggattcacgatggtaaccggttgcccgccgcccaggaatcgcgccgccttttcaggcggattcaccgtagcggatagaccgatgcgctgcatatgacgatcgccacggccagcatcaacggcggcatcaccgccctcatcagcatctgcatcgattgcatctcgcttgcgcgattctgcgacaaggttctccagccgttccagacttaccgccaaatgtgcgccgcgcttggtgcccgccactgcatgaatctcatcgacgatcaccgtatcgacagtgccgagaatccgccctgccttcgaagtgagcaacaaatacaacgattctggcgtggtaacgaggatatccggtggatgggaggctatgcgccgccgctcctgtgcggtggtgtcgcctgaacgagtggcgaccgcgatcttcggtacgggcagcccttgcgcctcgcattgtgcagcaatgccctccaaaggctgttctaggttcttggccacatcggccgcgagcgcctttaacggcgagatatacagcacacgcacaccggcacgccgcgtgcgtggcacggtcatcaatcggtcgatggctgagagaaacgcggccaatgttttaccggaaccggtaggggcgatgaccaagacattgcgaccggaatggactgccggccatgcctgagcctgtgcctcggtcggctgaccgaaggcatgctcgaaccacatcttggtgggttcggaaaacaggctcaggctttcgtacatatgtacgattataggtcagctgaagtaggcgatgacttcttcggcggtaccgtaggcactttgggcaccaagcttggtggccgcataggcggagacgtaggagccgatttgcgcggattgcagcagcgtatgaccggcggccaagccagccagcacggtccccatgaacgagtcgccgcaaccggtggtgtccactgcattgacttgcgcggcggatacgcgatgccaacgtccgttctcgatcaccaccgatcccgacgcaccaagcgtcactatcgcccggtcgaatccgtaatcggtgaatcgttcggcgacctcataccagtcgagtgattccacgtcatcatccggcaggcccagcagttgagccacttcatgctggttgaccagcagaatatccgtggcttccaccagttcgtgaggcagctcgtccataaatggcgagtcgttgagcagcacggtcacgccagcgtcatgcgcggtctgcgcggcggcgataacggtggcaatcgggctctccagacacagtcccaataccgcgcattcggcgatggtcgtgcgatgtgattgcacatagccggcacttgccttggcattggaacccggcgaatagacgatggtgttctcgccctcagcgctcacggtgattaccgtggtgccgctggggccttcgacatgcaggatatcggcggtgtcgacgccggcctcatccagcttgcttaataggaagtccgcgttggagtcctcgcccaccgcgcccagcaactggacattgacaccgagacgagcggcggcagatgcctgattcgcgcccttgccgcccggcagcactttcatggcaccaccattgacggtttcacctggcttgggtagtcgtttagtggttacggtgtaatcggcgttcatcgagccgaccacgattaccgagcccggcgcatccttcagcgctctcaatcgttcccgtacgggctcgggcatctgttcatgttcttcttcacttatcaccatgggctccaagcatagtaggcgtcgggcccaaatgcgcatatgatcagccgcgcaacttgcgaagacgctcgtgcatggccaccatcagcaccaagagcaccagcaaataccacgggtagagactgattgtcgcatattgcgcgatgatgccgaacagtggcggcatgagcagtgagcccacataggcgcaggccatctgcacgccgacgatggcctgcgatttgtcttcgccgaagtaggccggcgtcgagtggatgacgcacggataaatcggcgcgcacccgaagccgatgaccaccagcccaacgaccacgccaaggtggtgaggcaatggcacgaacatggtgaggatgccggcgaacaccagcacttggccgaggcgaatcatgaccgggtccttgaatcgcatggtcaggaagccggaaagcgcacggcccacggtgatgcctacgtagaataggctggcccagctggcggcggtgatcttgtcgatgccgctgtgcatcaccatatagctggaggcccacaggcccgccgtagattcgacggcgcagtagcagaagaacatcacgaggatttccttggcaccgcgaatggcgagcacgccggccacgccgagcggtttgcgttcggcaacagacaccccttcagcagtgccaaatctctcggcattgccgtcagatgatgcggtgtcatcggtcgattcgccgaccgcaattgcgccacgtttcttccacagcggcaggctcagcaccaggatgacggtcagcatcacctgcaggatcgcgatgtaccgatagccccacggccagccttggccttgagagagcgcatagcccatgatgtaggggccgaccgatgcgccgacgccccacatgcagtgcagccagctcatatgccggctttcgtagtgaatggctacgtagttattgagcgccgcatccactccgcccgcgccaaggccgtatggtatggcgatggccaacagcacccagtaattcgaggtaacggagaaaccggccaaggccgccgcagtcaacgccaccgaaacggcggtgaccttgcctgccccgaatttcaatgtcattcggaccgaaagcagtgccgagacgatcgtgaacatggaaatcaccgcggagatgccgccggcccacgccaccggcacgttcagatcctggctcatggtgggccatgcggatccgagtagcgaatccggcaatcccagactgataaacgccacatagatgacggcaagcaacagactggccatgtcccatctcccattcacagtacggcaccggttgtgataacgatgtcatcagtctatcgaatgactcatgggcaacacgcataaaacatatgacaacgtgctcacctcaaacgccaattacggaaattctcggtaagcacgatgtcattatcagcgacgtcttcgatcaggtatcgatcttggagcggtcgaaatcgtcggcgttgtcgacgatgaactgcttgcgcggcggcacgtcgtcgcccatcagcaggctgaagatctcggatgcctgggcggcgtcctccatgcggatgcggcgcagcatacgcgtgcgcgggtccatggtggtgtccgccagctggtcggcatccatctcgcccagacccttgtatcgctggatgtcgtcgttgtaaccgatgtgcttcttgtcgaggtcggccagtttgccggccagctcgtcatcggaatacgtgtagatgtattcgcccttgtgcgagccggtcaacgcgatgcggtgcagcggcggtactgcggcatacacgtagccgtgttcgataagcggccgcatgtaccggtagaacagcgtcagcaacaggatacggatgtgcgcgccgtccacatcggcatcggtcatcatgatgatcttgtggtagcgcgactgttcgatgtcaaagctctggccggagccggcgcccaccacctggatgatggccgcgcattccttgttggagagcatctgcgtaatcgacgccttctgcacgttcagaatcttgcctcgaatcggcagcagcgcttggaaaccggcgttgcgggcggccttggcggtaccgagtgcggaatcaccctcgacgatgaacagttcggccacgtcgtcattgcccggctggcagtcggagagtttggccggcatcgaggcggattcgagcgcgttcttgcggcgcgtgacctccttggccttgcgcgactggatgcgtgcgtgcatttcgccgacgatcttctccagcacgcggccggattgttccttgtacccgcgcttggagccggtgatcatctcgccgaattgcttgtcggtgagccgggtgacgatcggcttgacctgcgcggtgccgagcacatccttggtctggccttggaactgaggttcggccacgcgtgcggtgaccacggccacgagtccggcttggatatcgtcgcgctccaccttcatggcggagtccttcatgttcaccttgagcttgcgggcgttgtcttccaccgccttgcgaatctgcttggtgatggcgttcatgaaaccgtccacgtgagtaccgccgccgggcgtctccacgatgttcacgaagctcatgattgtggtgtcatagccgttgacccatcgcagggcgatatccacgccgcaggtgcgttcgatttcctgggcgtgcagttcaccgcccttgcccacggcctgggtctcctccttataggtgccctcgccttggatgcgccagatgtcggagatcggctcgcctttggacaggaagtcgacgaagtccttgacgccgcctgtgtgcaggaattccacgacgcgcgggtgcgcgggctgttcgccgaacgcgccatcaacgacctggtcgccggccgtcagtgagaagtcctcctcggccgggctctcggcatcgtcggacgagacatccaaggccggtgcctggtcttgcgcaggttcgactgttgtgtcatcagtggcctcgacggtgtcagtcgccgccgtttccggtacgttttcgtcgatgatggtgattttgaggccgggcaccaggaagctggtctgacgcacgcggtcgatgagctgttcgtatgagaactcggcggttttgttgaagatctccggatcataccagtaacgaatacgggtaccagtggttttgggagataccttgccgatgatttccagctcggtgggtcggttcttgcgagtgcgcttgaacggggaatcgggagacggattggccgggtcggcatccgtgtatacgccagggtgaccttggtggaaggtcatgtggtgcgtcttgccgtcacgatccacttcgacgtccagtcgggagctcagggcattgaccacggaggagcccacgccgtgcaggccaccgacggcgttataagacgagttgccgaacttggcaccggcgtgcagtttggtcagtacgacctccacgccggacaggccggttttcggttccttgtccaccgggatgcctcggccattgtccgcgacttccacggaaccgtcggtgtgcagggtgaccacaatgtcgttgcagaagccggccaaggcctcgtccacggagttgtcgatgatctcccacaggcagtgcataagcccctgcgagtcggtggtgccgatgtacatgcccggacgcttgcgtaccgcatccaagccctcaagaacagctaggtccttggcaccgtattcttctttgggcatacagtcctatttttctcttcaaatgcttggctcccctcacagaggggagccagacgatcattgatccaggaagtcgcgcagggtctgcgaacgggatgggtggcgcagcttggacatggtcttggactcgatctgacggatgcgttcacgggtcacgccatacacacggccgatgtcgtccagcgtcttcggctggccgtcttccaggccatagcgcatcttgatgacgccggcctcacgcggagacagggtttccagcacctgcttgaactgttcctgcagcagggagaaggccacggcgtcggacggagcgatggcgtcggtatcctcaatgaggtcaccgaactcggaatcgccatcctcgccaagcggggtgtgcagggaaatcggctcgcggccgtacttctgcacttcctgcaccttctcaaccggcatatccagctcgcgggccagctcgtccggcgtaggttcacgccccagatcctgcagcatctggcgctgtacacgggacagcttgttaatcacttcgaccatgtgcacaggcacgcgaatggtgcgggcctgatcggccatggcacgggtgatggcctgacgaatccaccacgtggcgtaggtggagaacttgaagcccttcttccagtcgaacttctcgacggcacgaatcagaccaaggttgccttcctggatcaaatcaaggaagagcatgccgcgacccgtgtagcgcttggcgagcgagaccacaagtcgtaggttggcttccagcagatggtccttagccttcttgccgtcggcggcggcccacttgagttcacgcttgcgcttgaactccatgccttcgctttcggtgtcgagcaggtgctgggcgtacaggccggcctcgatgcgctcggacaggtcgacttcctgctcggcattcagcaggctcacacggccgatctgcttcaggtagtccttgaccgggtcggcggttgcgccggccgcaatcacacgacgcttcggattgcccgaggggatgatgttttcttcctcatcatccgtgtcggagaccacgtaggcacccttttccttgggctgctcgggtgccttggacttggcttcttcctcgtcctcgtcgtcttccacatcatcgtcgtcggcatcgtcctcatcgaggtcttcgtcgtcggcatcgtcttcgtcaacgtcgtcaagatcctcgtcgaggtcgtcaacgtccaaatcgtcgtcgttgacctcggcatcgtcatcaagctcgtcatcgacctgagtgtcctcgtctttgacgagctcatcgtccttggccttcttcgcggttttcttcgcagcggacttgcgcgtggtctttttcgagggctctgcggacttggacttcttggcggaagtcttgcgtgcggtggtcgtagagctggccttcttcttggtctcggtctcctcgctggactcggctgtctgcttggttgccgtcgtttccttcgtggccaaaactgctcctcctgatctctcgccgtgaagtgcatataccacatgggcccacttctggcaagggcaaatcgtcaactatgtgagtaaaccaccctccacggacgattattcccacatcgttgcccgacgtgttgccgatcaccacacgctttccttccgcgcatcgcgcgtaaaacctcggaaatccgccgtttctgttcactcagcccgagcaccatgccggtgccacgcctcgatcggcggctgagaatatcatcgccgccagcgaacaatcctcatcgagcagcaggcatcgcaaggcgaacaccattgctcgcggatcgcccagccaccataaggtgtaggcgattacggccaatggctgtatgcagtacggcaccggtgaggcttcggcgatatcgagcaacataccgatgccggtatggcaacgctccttatccggcatcatgccttcatcctcgaatgcgcaggtcagcagctcgcccattcgtgttctcgtacgcgccagatgcggtcgcgccgcgaattccatgagccatgacttggggcaacggctttcatcaataaccaacgagagaatcagcgcatcacgaatcgataaggtctcgcgcatgcccaccgcaaacgcggccatcgtctctcggcctaggtcggtgttcccggcatcgaggcaagacagccattcgtccaatggttcggccacccagtcggcattagcctgttgcgcgcctcgaagtcggcgatcattgcgaaattcctgtgatctcgtcttcaactcgtcaaagacaaagggctccgtctgctcggcggcgtgccgtttggcgtgtcggttcttacgcggcttgtgtggcgtgttgttgttcatcatgtcctccttgactaatggtgtgcaatctattggtgttgtggtgcacgctgagccaggtagctcacgcaccgagtgggtgtgcccactatggctgaaaacgccgtatgacgcaggaaaaaacgaccattgtggttctagcttcaaaacccttgatttccaacgttcttgtgttcttcaaaccctgtggataagttattaggcatgtgcacaactgctaacaaccgcgaaatcatcgagccacgcatcattcagttggtgcgggaactgactgccgcccccgccaccgacgaggttgccgacgccctgaaaccggtgatggaacaggttgtggaccaagccgcctcctccagccaaggaggcaaacgactgcgtgcgctgctcgcattggacgccttcgatattcttgccggcgacgtgactcctgattggcgtgatgccatgatcgacctagcctgcgccattgaagtgtttcagacggccgcactggtgcatgacgacatcatcgacgaatccgatctgcgccggggcaagccttccgcacatcatgccttggagcaggccgtacacagcggtgccataggccgtggcttgggcctgatgctcggcgacattctggccactgcctgcattgaaatcacacgccggtccgccagccgtcttcccaacaccgatgccctgaacgaggcgtttcttaccatgcagcgcgaggtggaaatcggccaagtactggacttggccgtcgagatgaccccgctgtctaatcccgaagctctggcgaacgcctcattgaacgtattccgctggaagacagccagttacaccaccatcgctccactgctgcttgcactgctggccgcaggagagagcccggatcaggccagacattgcgcgttggccgtcggccggccgctcggactggcgttccaactggcggatgacctgttggatgtcgtcggatcaagccgcaataccggaaaaccaattggcggagacatccgagaaggcaaacgcacagtgctgttggctgatgctctgtctgcggcagatacggcggataaggccgatctgattgccatcttcgaagcggattgtcgcaatgacaaccaggtggcccgcaccattgaactgttcacgtcgaccggtgctcttgatcgatcccgcgagcgcatcgctgccctatggggtgagtcccgtaaggcgattgccggtcttgagctgaattccgaagcgcaacgccgtctgaccgaggcttgtgcgcgattcatccccgaatccttgcgatagtccgcaatgcgagccgccggaccatgagaccatggacaccggtgaaaacccatgaaaactatgcgctgatgctccggccgcgtaaccggggccatgtacactgaacgtgtttagtcgtgattaaaggaaccgtacgatacaacatgagtgagaacgagcccgcgcagatgattgagggacgctaccgcatcgtgcgcaatatcgccgagggtggtatggccaccgtgtatgaggccgtcgatgagcgtctggggcgcaccgtggcgattaaggtcatgcacacacaactcgccaaaggcccgcatcgggagcagttcgtcgaacggttccgccgcgaggccaattcggccgcgtccatcgccaacccgcacatcgttcaggtgtatgacaccggcgagttcaatggacttgattttctggtcatggaatatgtgcatggcgtcaatctgcggcatgagatgaacacccaaggcacattctccgtgcgtgagacgctgcgcgtggtcgcggagacgctggatggtctggcttccgcgcatcgcgccggcgtggtccaccgtgacatcaagcccgagaacattttgatcaatgatcgcggccatgtgcagatcaccgatttcggtctggccaaggccgccagccaggccacattgagctccaccggcatgctattgggcaccgccgcttatctggctcccgaaatgatcgagaacaatcaggccaccgcgcaaggcgacctgtattcggtgggcatcatggcatgggagatgatgaccggcaaggtgccgttcgattcggataatccggtgacgcttgtcttcaagcatgttcatgaggacgtgccgtccgtggccacggtctgccagggcattgatccgtccgtggcggcgttcatcgcccatctgaccgcgcgtcaggtggatgcccgccccgccgatggcgcggcagcagctgaggaattgagccagttggccgccaaattgccgctggaggcgtggcaataccgtttgcatgccgaacccatcggaggcgatcataccgatgccaccgctgcagcattggtaggcaatatcgccgagcaggccccgctgaccggcgtacctgccggtgcagcaacgttcgagccgtccgtaccggcatttttggtcgatgatgccgcaagcaataccgccgataccggtggcgccgcagacgtcaatcctccggcgcctccggtcgcccccaccacggcacttgattcgtcgatgttagccgatgcttcggctccccataagacgcagatcatggcacagtccggcagcgagacacaagtgctgcctcaggccggcgatgccttcacccgagcgcttgccctttccgatgagccggatgtcgcttccaatggcaccgggccaaagaagcagcgcagcaaaaaaccgctcatcatcgtactggtgatagtgctggtactggctgcaatcggcggaaccgccggctggtggtggtttgccggaccgggcagctattggagtgtgcccaagccggatgacgtgacctgcgatgcgaatgcaagcaccgaatgctcgttggccggcgcggattgggccacgtatgagagcacgttgaaggctctcggcatcccctacaagacgcacaaggaatacagcgacgacgtggcggaaggcaagatcatctcttcttccgtgaacaagaccaaggccgttgtgaacagccgcataagcaagcgagccaatcaggagcttacggtggtggtgtccaagggcgtgcggatgaccaccatcccgaaggatattctcgacgcgaattcggccaatggcaaggacccgttgaacgcgctcaagaaggccggcttcgataatgtcaagcatgacgagtcgaaggatgagtattcgatggacacgccgcagggtgtggcattgacgatctcccctgatcccggtaccacggccaagcacaacgatgaggtgacggttactttgagcaagggaccgatgccggtgaccatgcctaacatcgtcggtaagacccaggatgagatgcaagccgcgctcggcgagttgaagctcacggccaatgtcaccgaacagtacgatgacaaggtcgaggccggtcaagtcatttccgcgtctcaggaagccggagcccagctgaagtggggcgatagcgtggacgtggtgatttccaagggtccggagatggcgacgataccgtccggccttgtcggcaaacaggaaagcgccgtaaccaagacacttgaaggtctcgggttcgaggtgaaaaccgacaaggtgctcggtggcctgttcggcacggtacgtaccgtgaaaagtggcgatacggacctatccaacggcggcaagattcgcttgcgcgatgccaacggcaaccccaccgtcatcaccctcaccatcgtgtgagatttgaatgaggctccctctgtcttcagacgagggagcctcatttgctaattacttttcggcttcttcagcggcctgctgggccttgagctcggccttgaccttctgggcgtattcgttcacgaattcctgaccgctcattttctggattgcggtggaaacacgatcggtcagcgaacgcaaatcatcatgtgtaatttcatcagccggcttcttcgcaacctcaatcggcttgccatacaacaccttggtcttgcccttcttgggaatcgacgtgccaatcggctgcagcttgtccgagccgatgatggcggtcggaacaatcgggcaaccggtctcgagcgcaagtcgtgcggcaccggtgtgtcccttgtacagtcgaccgtctgggctgcgcgtgccttcaatgtggataccgaacaggtgcccatcctcgataatctcgcgtgcatgctcgagtgcgccaagcgacttgctgccaccggaacgatcaaccgggaacacgcccacggacgtgaaccaccacttcttgaacttgcccttcaatcccttgccctcgaagtattcggctttgcccatgaagtgcaccatgcgcgggcaggtaatcggaatcaaagcatcgtcaatcaccgccagatggttggctgcgataatcgcgccaccctctcgaggcacgttattcagtccgctgacagcagggctcaaacgatgatgagcaatagggccgagacctttgacgaagaaccagtagagcacttggcattcctcccgcagacgaactagccattggccggtcgcctgattagagtgacagttatgactgagaaccagaatagcaatgccgacggagagcggccaacccccacgccgggcaacggacaggattccgatacttcgtccaagtcgtcgactcccggtgccgccggacaagccacgaatggtgccgatacaccgcaatcgcatgacgcgaacgatttggatgcggcgtgggccgcgttcgaagccgagcatcaggccgacttgcatgacgtggcttcctccaggcaggccaaaaagttcgagaagcaggccaagaaacgcgagaaggaggcgctgctttccgtagatgacttggatatcggctcgttcaccgatgatgctcgcccgagccgtggcggcaaaaaaggcaagcagtcaggtccccgtgatttcaccggctccagctggctggataccgataatgtgatggacacctatgatgatggcggcttcactcccccgaaccctgatcttggtccggtcaaagcgtctacggtactgctgacggcgttgcttatcattggtctcgtaggcgaagcggtgatgatattcgtccccggcttgaacgcgattcctctcttgggcgcgctgctcaatattctcttcgggctgggcgtcattttgggcttgggtggattggtggccaaaattctcaaccgcaaagaccgccccggtgatcagggcggctattacgacgacggcgcgagggtgtagctcgcgtaggctgtgtggtccttggctcccctctctgaggctgagccgttaagcgaacagcccagtgggctgtttgtaggcgaggtgtgagagatagcgaaccaatgtattgcgggcgtgtctcgtccgtaattgcggtcgagccacgataggtcacgaattgaagtcgatggactcctgtaactcggcaatcatggccttgatgcgggcgtcgcctccccaccagttgagacggatcgtcacgtcccctttggccggcacaaccggcacatcagcggcaccaaccgaagtgccgcgcgtcgcagtcacgcacaaggccacggccgccataacagtcgccatatagacacataagccccctcatcagaggaggctgagtacggtgtatcacgccttggacttggcggtttcgatccacttgtcgaacagggcttcggccttgccggaatcgacggtttcctcggccagcttgtaggcttcggcgaaacgctcggccagtgtgccgttgccgaccagattgccgtcggccacgatggcggaggcggcgttgagcagtgcggtggtgcgggacggaatgtccttgccggccaggaagtccttgaatgcgttggcgttgacgtccggaacgccgcccttgagctgttcgacggtaatcttggccaagcccagatccacggtcgggtcgaactcggtttcggtgaccttgccgtcgcgaatctcccagacggaaaccgggccggtgggggcgagctcatccatgccctcatgcgaagtgtagaccaagccggactgaccacggctggcgtagacggcagccatgatcgggctcaccttgcggttggcgcagccgatggccacgtgtgccgggttggcggggttggtcaacggtcccaggatgttgaagacgcacggaatgccgagcgcggcacgaatcgggcccacgaagcgcatggccgggtggaaggtgcgggcgaacgcgaaggtgatgcccacctcgtcgcccacttcgccgacggcctccggcttcaaatccagcggcaggccgaggtcttcgagcacatcggcggcaccgcacttcgaggatgcagcgcggttgccgtgcttgacgatcttcacgccggctgcagcggcggccacggagcccatggtggacaggttcacggtggcgaagccgtcaccaccggtgcccacgatgtcggtggtcccaccggaaacgttcagcggcacggcgtgggagaccatggccttggcggcaccacgcacctcgtcggcggtcagtcccagctgctgctgcatagcgagcgcggcacccacggcggccggattggcgttaccttgcatcaggtcgtccacgaaccactccgattcctcagcagtaaggtggtctcccccgaccagcttggtgagaatcgacttccatgtgatctcggccatgatgccctccttggcgtttcctacgccgtgtgatgtatgttcgccgctcattgtaatggttcgtcatttcaaggccctgaatcttccatattgcaaaatatggcgctattgctgttttcgtggatgtcggttcgtcgtcgagccgttggtttcgtaagcgtgaggggcgttcccgcgtattctgttttccgaccaaagaaatgaatcacgaagaacgcctgggcaaaagcccattcaccggattgccgaacgtcaaaggcacggttgcagaggatgcgcggatcacggattcgccgccgcgttccgaacccgtgctcgagatccgggtgcgtccacgtgcgggtatgctccgatgctcccgatgcggaaggaggcgccgcgggcatgaccagggcggcggcgtgcggcgtcgtggtcgcttccgtgccgtgggccgagccgggcagccggtccacacgcgatttcgaatcggaacgcgcgtggccgatgagcgtcgcgaaccagaagaccgtaagcggttttccgcacgtcgcgtggcgcgccgccggaagacgccgcccatagggtcgccgaacggttgaaagcgtcgatgccgtctccgttcggcggcctcacgtcgatcggcgtggacgagaccggctaccgcaaaggccacacgtgcatcaccgtggtcgtcgaccacgaacggcatcgggcgatataggcgcacgacgggtacggcagggacgtgttcggcctgttcttccaaacgttgacgcccgaacagcgcgcctccatcagggtcgtcgccggggacggggcccggtggatcgactcatgcgtgcatgagtggtgcccgaacgccgaacgcgcgcccgacgggttccacatcgtcagttggacgagcgacgcgcccgacaacccacgaaaacagcagaagcctcttttttgtgctatcccgtaaaactgcgggacggcagctcattttcgccgtttgagccgtgccgtcccacatcaccctttgcggaccgtgacaccataacaccgagaatggcggaatttcaacgattccgtaattcgtactgcgggacgccacgctagtcaatcgattgacactcgtgccatcccgcaacagtgtgggatacgacgtcaaaatccgcgaaaatcgcgtgccgtcccgcgcgtacggcaccgcacgaatacatgctgatgaaccgcatagaaaatggctccccgtgtggggagccatgagctagttactaactagcgatgcgtcacttctcgttctggccgtggcacatcttgtacttgcggccggaaccgcacgggcacggggcgttcttgccagtgccagggaaggtgcggccgtcggcccacggcgtcttgagctcttcgctcttcggacgcttggaaaccgggaccttgccttcggcgtggctgatcggagccggtccggcaacaggcagcgtggactcgccggccccggaggcggctgcggattcggcgatcgcctgcttggcgtccgtatcctcgtcctcttcctcgacttcgccctcggcggcctcgaccacggattcgccgttctcgtcggggccggaggccacggcgatggtgtcggcgctttcggcggtctcctcgacctcgtcaacggcctcgtcggtggtggcgacctgcttgatgtcgatgtggaacagcagctggacggtctcctccttaatggcctcgatcatggagttgtacatctggtagccttcgcgctggtattcgaccagcgggtcgcgctggcccatgccacgcaggccgatgccgtccttgaggtaatccatctcgtaaaggtgctcgcgccacttgcggtcgagcacggcgagcaccacgcggcgttcgagatcgcgcaagccggtctcgccgatggtctcctccatttcgccgtactgctgcctggcgtcctcgacgatcaggtcgcgcacggcctcgacggccttcgcacccttgaggccgccgacgatcttcctgacctcgtcttcgtcgaccttggtggggatcacggtgttgagcgccttgaacaggccctcccaatcccagtccttcggtttctcggatcccttgttggcacccttgatgtaggactcgacggtgtcggaaatgaaacgcaggatgtccttgtggatgtcttcgcccttgagcacagcctggcgctcggagtagatgacggtacgctgcttgttcatcacgtcgtcgtacttcagcacgttcttacgaatctcgtagttgcgggattcgacggccttctgtgcggtgcgcacgcccttggtcacggacttggcctcgatcggctggccttcctccatgcccttggccatgacctgggccaccagctgggtgttgaacagacgcatcagatcgtcttccagcgacaggtagaagcgggactcgcctggatcgccctgacggccggaacgaccgcgcagctggttgtcgattcgacgggactcgtggcgctcggtgccgagcacgtacaggccgcccagctccttgacttcctcgtgctcgtccttgacctgggccttgatctcgttcagggtgcccggccaacgcttctcatactcttccggggtgtcttccggagagtagccctcggacttcagcttggcgtcggcaaggaactcgacgttaccgccgagcatgatgtcggtaccacggccggccatgttggtggccacggtgacggctcccttgcggccggcgacggcgaccacggcggcttccttctcatgctgcttggcgttcaggacctggtgagggatcttggccacgtcgagcagggtggagaccacttcggagctttccacggaagcggtaccgagcagcaccggctggcccttggcgtgacgcttggccacgtccttgacgatggcggccagcttctccttcttggtgcggtagatgaggtcgtcctggtccttgcggatcatcggcttgttggtcttgatcggcagcacgcccagcttgtaggtgttcatgaactcggcggcctcggtttcggccgtaccggtcatgcccgcgagcttgtcgtacatacggaagtagttctgcagggtgatggtggcgaaggtctggttctcggccttgacctccacgccttccttggcctcgatggcctggtgcagaccctcgttgtagcggcggcccggcaggatacggccggtgtgctcgtcgacgatgagcacctcgccctgggtgacgacgtagtccttgtcacgcaggaacagttccttggccttgatggcgttgttgaggtagccgatcagggcggtgttggccggctcatacaggttgtcgatgccgaggaagtcctcgaccttggtgatgcccgggtccaggatgccgacgaccttcttcttctcgtcgacgtcgtagtcctcgtcgcgggtgagcttcagcaccagcttggcgaactgacggtaccagcgggtcacgtcgccttcggccgggccggagatgataagcggggtacgggcctcatcgatgaggatggaatcgacctcatcgacgatggcgtagtggtgaccgcgctgcacgaggtcggccttctcccatgccatgttgtcacgcaggtagtcgaagccgaactcgttgttggtgccgtaggtgatgtcagcgttgtactgcttgcggcgctccggcggcttctgctcggtgatgatgcagccgacgttcatgccgaggaaacggtagatacggcccatcagctcgctctggtagctggcgaggtagtcgttgacggtgaccacgtgcacgcccttgccttcgagagcgttcagataggtgggcagggtggcgaccagggtcttgccttcaccggtcttcatttcggcgatgttgccccagtgcagggcagcaccgcccatgagctgcacgtcgaagtgacgctggccaagggtgcgcttggagacctcgcgcacggtggcgaacgcctcgggcatgatctcgtccaggctcttgccgttttcgatttcctgcttgaacttcggggtttgggccttcagatcctcgtcagagagggcggagatctcgtcctcaagagcgttcacggccttggccacgttctccagcttcttgagctggtggccttcacccattcgcagggctttgtcaataatatcgaccactgggttctcccttgactgataagtggtggtgtccgcgtatcaggatagcgcctcacaccgtcagcagtcgaatttttcgacctttttacgaaaaaatggaccgcctccatattggaagcggtccatgcggtatcagctgatcgtgtcagcaggccttaccttcaggccttcttgacgttctccggagtatcgatttcgaacacgccgtagctccaaccgtgacggtggtagacgacggacgggcgtccggtctccttgttcacgaacaggaagaagtcgtgtccgatcagttccatctcgtacagcgcctcgtcgatgctcataggctcggcgatgtgcagcttgcgacggatgacaatcggcgtatccccaacctggacctccacggattcgccagggccaagatcggaggcgaccgcagcctgcgggctgttgttcggctcttcctccggctcctccggctcgggctccggggcgataacacccagatccaccgggaccgggttcgcgtaaccacgacggtgatccttgcgacggtcacgagtacgacgcagacgcagcgtcaacttatccagcgccatgtccagcgcgctgaattcatcggtgctggaagcctccgcacgcaccacggtacgtccggcgataacggtgatttccacgcgcttggcggtatcggcctgacgcgggttgccctcatgggtcagcacgatctgcgcgcgctgagcatccggggcgatagcggtcacacgattcatcttggtctcgaccacatcacggaacctttgcttgacctgcgtgtggcgtccggtaacgacgatttccatgttgacctcctctaactcaagcggtgtaacccgctatatgtgttccgaacggcatcatcaccgaccgggtatgtttcattgtagacgaacaatgggtgaacggccggaaactcgcccagagaatatatgtttattcccgggcttttctctgcaatgaaacgatgtatatactggggctttggcagcagtctcctataagaagatttgataccggtttatcaggctggctcgtttgttcgtcatggtaaatactgcaatggataggcagcgttttcttgctctttctcgcacataccaagctcttacagatttgattcgtctccatacgacacgccacaacacgcccgacacgccccatccgatattcggcgcgtcgttcacgaatcgcccaactatgcccaaccatggagaaaacaggataaccgggcaacggcatggcctcgccgcagggcgggatgccgccttttccgcaccttatgtataattgcaagcttgagacctcttgatggccgcggccgtgatcttcattgggatcggctgaggaacttccgggctccatagagcacgatggcggataacgtccgcccagggtgacctgagagatagcgcaacagagaacagaccgcccgtcctcgacgggtaagggtgaaacggcggtgtaagagaccaccgggcctctggtaacagtaggtcgcatggcaagcctcatcgggagcaaggccaagcagatggcggtaagggctgctcgcccgtgtcatcgggtaggctgctagagcctggcggtaacgtcaggtcgagatggatggccatccgtgccgtgcgttcgcgcacggcacgacagaacccggggtataagaggtctcatttttttcttggctacaccaacaattcggcggcgactcgacggagggtttcggggctgtggcctttgcggccgccggcggaccaaagccgacgctgacggacccgacgatcgaggccatgggttttgcgggctatttggcggcccaattcccatgcggcatcttcaaagatgccattttgctcagcttcgtcacacacctgttcagccagcttgcggtccacacctttgcgagcaagttccatgaccgtaccacgacggcccatcatgcgaccggcacaatagcgtacggccgattcggcataagcgccgtcgtcaatcagttgcacgcgaatcagccgttcgatgacctcgtccacgatcgcctcgccgtaccctttggcaagcaatcgttcgcgtaacgcaccggatgcacgcggggccgcgtccagcaaacgcaatgcagcctcgcggcaagcgtccaaatcattgggatcttcgacaacggcagcgtctctcccccgtcgagaaaaacgtcccgacggtttcgactgaacatgctgctcggcaatgggcatgtcttgcgacgcaacaggattgcgccgcaagaacgcttcggcactaatcatgttcaggccttagctgtgccggccttggcacgggtcgttttggcagcaggcgccgctgcggccttgctgtccttggccacgtcggcagcagcagcctcgctgacggcggccgctgctgcggcttcgccatcttccgcgaactgatcggcggaaccgatcagaccgaactcggccttgaccttgttctcaatctcctcggtgatggccgggttgtccttaaggaactgacggaccttctctcgtccctgaccgagctgatcaccctcataggtgaaccacgaaccggacttcttgaccacgccaacctgctgggccatgtcgatcaccgagccctcacgggaaatgccttcaccgtagagcatgtcgaattcggcggacttgaaaggcggggccatcttgttcttgaccaccttgacgcgcgtgcggttgcccaccgcttcgtcgccgttcttcaaggtctggatgcggcggatgtcgagacgcacggaggcgtagaacttcagagctttaccaccggtggtggtttcagggttgccgaagaacacgccgatcttctcacgcagctggttgatgaagatggcggtggtgccggcctgagccaatgcgccggtcatcttgcgcagcgcctgactcatgagtcgggcctgcaaaccaacatggctgtctcccatttcgccttcgatttcggccttcggcaccaaagcggcgaccgagtcgatgacgatgacgtcaagcgcaccggagcgaatcagcatgtcagcgatttcgagggcctgctcgccgttatccggctgggagacgatgagtgagtcggtgtccacgccgagcttgcgggcgtaggccgggtcgagcgcgtgttcggcatcgatgtaggccgccacgccgcccttcttctgggcattggccaccacatgcaatgcgagcgtggtcttaccggatgattcggggccgtagatctccacgatgcggcccttgggtaggccgccgatgccgagcgccatatcgagagccaacgaaccggtgggaatcacctcgacgttctgctcgggctggtcgcccagtcgcattgcggaacctttgccaaaactcttctcgacctgcgccagcgcggtgtccagcgccgccttgcgcttgggatcgagctcgtgcttgtcctcggctgccgggtccttggccggcttggtctcaagtgccatgatcttctccttgtcgaagtcgtgtgcgaatcggatgcctccaccgtatgacggacatgccatgtgaggcaatccaaaccaaccattgtggttccagcttgcccgagcttggccacctggcctccttaaaccctactgcggtaaggattatggcagatggcaagcaccctgtgcacacgtatgcggcttcttgtcactgtggataactataaccacacacacgaacatttgttcgaatttggcgtgcaacacgccgaaatcgccaatttcacgattcagcgactccgtaatcccgcagtgtcagacggcgggcatgggcggcgcgttatgatcgtggccccaacgcttggagtccggaacctccatttggtcgcagagcacattccagaccacgcgtggctcctccccgcgtccagcgcctcgaccacggtcatattcgccagtttgggcatccgttgatcacgcgacagcgaacgaccgtaggtccgaccgaacacctcttcaagtaattcccagaattcccgttcacgcatacacgccagtgtgccaccaaccgcaggacagcaaaaacccgcatcgccacaagcgatacgggttcacagctagacatagattacgggacgcggcttcacaccgccaaccgatcagccctcgaccgagtcgagataatcagccaccatgcgcagcatgcgcgaagtggagactccgagcgcatcggcgatggagctcagcagttcggagctggcttccttctgtccacgttcgacttcggaaaggtagcctagcgaaacgcctgccttctcggagacttcacgcaacgtgcggcgatcgcgcgtgcgcagctcgcgcagcacatgaccgatagcaccacgcagcgaaaactcgcgaggctcctcctcagccaccacgggctcggcggcggcagtcggcttgtacgacggcgaatcctcatcccacatacgttcacgaacggcttgacgctgatccttggccttcttggcggcctgtgccttgagcacctgctgctgggcgaacatcaccgcacggcgctgggccggagtcagttcacgcatacgggcgacacccggctgcacagccatcggcttcttggcggccacatccatctgttcgttcactcgggtcatcgtttccatcgccatcgccccttcccaggtcggttcagtgtttccactatgtacaacacgacaacccaacggttttattccttaaaacttgctgtgaatagactcaagttttgcagaacgtggaatacggtgaggcgacgaacctcttcgcgcatgccatcaagatggagttcgacggctttgagcacttcggcatggtccgcggtgaggcttgcggggatgcgcaggcccacatacaccagtccggccggcttgtcaccgtccggaccggggccggccacgccggtggtggaaaggccgatgattcggtcgccgtattccggctggctgtataggcgagcggtaccgatggccatctgccgggcgacttcggggtgtacggcaccttctcgatccaatagggccttgtccacgtgcaggatcgaggccttggcattgatgtcgtaggtgacagcggagcccaacaacacgttggaggcgccgggaatacgcacgaacgcatcggcaagcaggccaccggtcagggattcagcgcaggcgattttcgtattgttcgcctcgcaaatcttgaggatgccggccgcgagactgtcgcacaattcccgcattggaatatccgtcacttccgcttcggggcgacgaacgtgttgtacaggtacacggcacccgagtagaggcacaggaccaatgccacgtagatgatggcgtaggtcaggaagtagtaagcggtcatccagaacggcgtggcttgtccgttacccagagaccagaacggcagcagcagcatggacagacccacgcactggaatacggtcttgagcttgccgggccatgcggcggcgatgactttgccgcccggacgctccatgacgaagaaacgcataacggtgataccaatttcgcgaatcaggaacaggatggttacccaccagccgagctcgccgaacgcggagcatacaatcattgcgccgcaagtgagcagcttgtccgcgatcggatccatgagcttgcccatttcggtgacctgattgtatttgcgggccatccaaccgtcgattttatcggtggacgcggcgatgatgaacagcaccgcggcgacccagcgcatggtcaggttgttctcaccccaggcaccggcgagaatgtcgagtgtcaggaaaaacaccacgagtacgatgcgcgagtaggtgactaggttcggcggcgcgttccatccgtcgaacagcgatgatttgggcgatgactgcttgtccattgtgttctcatccatagtgttcacgttacccccacacttctaccttgagtgagtattggctggatattgactgccattattcgggaatcaggttgcgtgctgatggccgcgtggccgcgcttctctctccgccccttcggggcacctccctcatcagaggaaggtcgatgggtgaattattcgccgagttcgggctgttgcggggcggtggcttcgagcgagctggtttcgcctcggatgaaggcgagcacctgcggcaggtcctgcggctggacgagcacttcgcgggccttcgagccttcggacggcccgaccacgccacgcgattcgagcaggtccatgagtcggccggccttggcgaagccgaccctgagcttgcgctgcagcatcgaggtggagccgaattggctggtgaccacgagttcggcggcctgcagcagcacgtccatgtcgtcgccgatctcctcgtcgggctccatgctgtctttcttttcggcttccttggccatctgttcgatgtcttcgcggtatttcggcttgcgctgggtgcgcacgaactccacggccttgcgaatctcggattcggacacccacgagccctgcacacgaatcggcttggcggaacccatcggcaggaacaacgcatcgccctgaccaatcagggtctcggcaccgaccgtgtcaagaatgactcgcgaatcggtggcggacgaggtggcgaacgccagtcgggatggaatgttggccttgatcagaccggtgaccacgtccacggacggacgctgggtggcgagcaccagatgcacaccggcggctcgtgccagctgggtgatgcgctggatggagctttccacatcgttcttggccaccatcataaggtcggccatctcgtcgaccaccacgaggatgtacggatagggggccaccttgcgctgggagccggcgggcgcatgtaccttgccggcgcgcacggcctcgttgaagtccttgacgtggcggaatccgaagaattcgaggtcggagtagcgtgcatccatctctttgaccacccattcgagggcctgtgcggctttcttcggatcggtgatgatcggggtcagcaggtgcgggatgcctgcgtaggcggacagttccacgcgcttgggatccaccatgatcagacgcacctgttcgggcgtggcacgcatgatgatcgaagtgagcatcgagttgataaaactcgacttaccggaaccggtggcaccggccaccagcaggtgcggcatcttggtcaggtcggcggtcacgaagtggccttcgacgtccttgccgatgccggagagcatcgggttcgggtcgcccacggccttgtcggagcgcagtacgtcgcccaagtgcacgatttcgcgatcctcgttcgggatttcgatgccgatggcggatttgccgggaatcggtgaaaggatacgcacatccgaactggccaccgcgtaggcgatgttgcgctgcaggttggtgactttctccaccttgacgccggggccaagctcgacctcatattgggtgaccgaggggccacgcaggaagccgacgactttggcatccacgttgaactgttcgaaggtggaagtcagcgcccggatcacgcgatcgttggccggggtgcgcatcgcatggggctggcctttggtcagcaggttcaggtcgggcaactgatacggcctattggcgtcgtcgtctgtatcgttgccggcggtggcattcggctggccgcccgtattgggcacgccctggccgactccgctgccgtccgcatcggcacccgcgtaggctccggtcgcggctgccgcagccgcggcaccggcggctccggccgctcccatcgcaccggctgcccctgcgagcgcgacagtaccggcctgggcggcactgggtgcccacgggtcgtctaccgctcccccaccgggcatggcgacggtctggccactggtgatgacgcgggttcgggaagcgtcgccatcatctgcatcggcagcaggcgcagggctggataggtgcggacggccgtcgtacgaagacgatgcaatggttcgcgcaccgataatctcgccggtcatcggatcgaccaccggggtttcggcggtggcaccatgctggctggcggcacggtcgaatggatcgtcggcagcatacttgtcaagagttttgtcgtcttcggtcttggatttgcggccgaacagtcgtgcgaacaggctgggccgtgcatcgccggcctgatcgttgtcgcttccgtcatcgtcgccgtcatgcgagggaacaccgtcggcaaaggcgagagtggtatctcccacacggacctcgttggggaactggctggcgctcccatccgtctcctggcccatcggcacatacggtttgcgttggattttagcggcgattttgcgcgcatcctccggcaaatcggtgacgtgggtgccggtaatcatcagcaaggagaacaggccgacgaccacgaaaatgatgatggcgaacacgttggaaaggccccaggcgagcggtgagccgaggaagaagccgaacaggccgccggcggattgcagaatcgtgatgtcgaatccggtgtggtcggcggcgatcgccacgtcgatgatcgaacaaatcgaccacatgagcagcacccaaccggtgaccacacgcgggttattggaccctttaccggaattgcgcatgagtcggaaggccacggcggcgagcaacaccggcagcacgacgctcatcagaccaagcacaccggccgcggtggcgtgaagcagctggccgaatggaccgctgacgcggaaccattcggacgcgcagaacagtacggcgagcacgagcagcaggaagcacaaaccgtcacgacggtaggctggatcgtattcgccgacgccggtgacggcgcgtacgccggagccgaacgcgcgcggaatcgcgagcaggatcttcttccacaacggctcaggttcgaggtcaagctcgggctggaccttggtttcgccatcatgggtagacccgttgtctttggatttacggggtttggtgctgttggaggatgctgttcgtgccatatcgggtctgattctactagtacgggggtgcatggttggtgacgacaccgtgacgatatggtcgattgacgaatcccgacagccgattcgccgcgttcgtctgagtcgattccccgctggggcgcgaatatgccttatcatgggttgcatgacacccgcagagcgtgcgagcgcagtcgcatttgcactcaagaactgcgcactggaagcgatgacgccgggcgaggcaacgatgcgcgccgcggctgcctacgaacgcggcttgaagcccgtgacccatctcatcgacgtggcggacgaacagaccgccatgcgtctgcgcgccaccgccgaccctgccggaaaggatcgtctggctgccggcagtctggatgatcatgccacggatcgggcggatgcggtgttcgcacgtaccgtgttgttggcggaacgtcgatggaatccgtctggcgacttggatgagctgaccgccattcataaggggctgttcgaaggcgtgtttgaggatgcgggcaagttgcgtacctcaaacaccacacgcgaggtgacgaacgaccgggctcgagccgcgaatcctgaggcgttcttcccggctgggctcattgagaccggcgcgcacaacatcgcgatggagttggcggacaagcgcaacctgcatgcgttggatcgcgacgtgttcgttcacgcgttcgcttctatttatgatgagctcggttatctgcatccgttccgtggcggcaatgcgatggtgctgcgtatattcggttcacgcttggcgcatgacgccggctgggatctcgactggggctcagtgacgcgcgaggagtatcgctccgccaagcactcggcatatcggggcgacacgtctgcactggagacgatgttcgacgcgatactacgcccggcgaatccgacgcgtgtgttcttgatcgccggctggaatcaggggcctgcacactgattgcgggtgattgcatcggcctttggctgattcctacgccgtgatatcgcccagatgatgctgggtgtattcgtcggctcgggcgtcgatcgggtcgtagtcgccggcgtcggcgtgcgcgataatggccatcgcgttgtcgaccagtttcgggttcagggcctgcagccagtggatgcgcgggtcacggccgaaccatcccatctgtttgcgggcgagtcgcttggttttctgtgcgatgtccgcgaaggcgtcgttcacatcccagatgccgtccagcaggtcgatgatctgctgatagccgagcgcacgtacggcggtggcacccagatgcgggcgcaaccgttcgacttcttcgatgaacccatcgtcatacatctgcttggtgcgcaaatcgatgcgatggtccaaatccgggcggtccaggtcgagtccgatctgcacggacggaatcacgtaccggtagcgcggcagactggccgaatacggtttgccggtaagctcgatgacctccagcgcacggatggtgcggcgtggattgcgtgggtccatgcgcgcggcggcctcggggtctttggcccgcaactcgtcgaacaaagcaccggcaccctcggttttctcgcgttcctcaagacgtgtgcgcacgtcgggatcggtgccggggaaggtgatgtcatcgatggccgctctggcgtacaagccggagccgccgacgagaatcggccgtatgccacgtgattgcaggtcggcgatggtctcgcgcgcaagctgctggaatcgggccacgctcatcgtgtcttcggggtcgatgatgtcgatgagatggtgcggcacggccgcctgttcctcggcggtgggtttggcggtgccgatatccatgccacggtacatctggtaggcgtccgcgttcacgatttcggcccgctcccccgcttcggccagacgccgggcgatggcgatgcccaaccccgtcttgccggacgcggtgggaccgacgatggagacgactcgttgcgtcatatacgccccctcagtgccgcacggaataggtctggccggcggccacgtcggggtcggcaagcagattatggcggccggcgtgtgtgacggtggccgtgacgaaatcgccgatttcaggtaccggttcgccttcaggcacgccgatgtgcaccagcacgccggttttctcgcggccggtgacacggtgggtgtcggtgtccttcttgccgagtttgccggtgatcatcacttcgacgtcgcggccctcgaatgtggcgaggttctcttcggtgatctgctcctgcaacgccaccagacggtcgaaccggtcctgcaccacgtcgcgcggaatctgttccattgcggcggccggcgtgccggggcgtggcgagtagatgaacgtgaacgccgaggagaagcgcgcctggcgcaccacgtccatggtctgttggaagtcctcttcggtttcgccggggaagccgacgatgatgtcggtggagatctgcgcgtcgggcatggcggcgcggatgcggcccagtatgtcgaggaacttggcggagcggtaggagcggcgcatcgcgcgcaggatgcggtcggaaccggactgcagcgggaagtgcagctggtgcatgatgttcggcgtttcggccatcgcggcgatgacgtcgtcggtgaaggcggccgggtgcggcgaggtgaagcgcacgcgttcgagaccgtcgatggtgccgcaggcgcgcaacagcttgctgaaagcgtatcgatcgccaataccataaccgaacgaattcacgttctggccgagaagcgtaacctccttggcaccatcggccacgcattggcgaatctcatcaagaatgtcaccggggcggcggtccttttccttgcctcgcgtggtgggcacaatacagaacgtgcaggtgttattgcagcccacggaaatcgccacccacgagctgatgcgggaggcgcgggcggcgggaagctggctcgggaactgccgcaattgttcagtgacctggacctgcgccttgccggtcgcacgattctgatccaacagcttgggcagatcttcgatgttcttggtaccgaacaccgcggaaacccatggcgcagtatccgcgatcttcttgcggtcaagctgggccatgcagccgccaacggcgatctgcaggttcggccgaaccagtttgacgcgattgaatcggccaatggtgccatacatgcgttcggctgcgttctcgcgtaccgcacaggtattgagcaccagcaaatcgaggtcattgtcattgatctggtcctcggttgcaggcacgtagccattggcctccagcacgccggcgatgcgctcggaatcgtgcacgttcatctggcagccgagcgtatggatatggaacacgcccttgccgcgtttctccagcaaaccatcggttccatcggctgcaatcgaggcgcgctccgcctcggtcatcatgtcttcattcataacgaccgattctatcgacggggttcgtcatgctccggtcacgtatgccattggttgtcacgatgtcaaattatgggttcttggaaagattccccgcgaacgtccagattggctggaatccgccgagtatattggtggacgtgatacttgaccgacatagccgactcaaaacctccgatctgcaagcccgtctcaaagcgttggatcttccgggaggcaccttcactcccgaacaggtcgttgaattcgttgacctcatgcaggtgtatgaaggcgcgatgtacgagatcagcaccaaactggagattctcgacgacgagttccaggtgcggttcagccatgacccgatacatcatatggaacgccgtctgaagtcggtgagctcgatcatcggcaaactggagcgcaagggtctgccgatcggcgtcaattcgattaaggacaatctgttcgatgtggccggcatccgcgtgatctgtaattaccgcgacgacgtgtattccgtgtccaactatctgtcgtcgcagtccgatattcaggtgctgcgcgtcaaggattacatcaagaacccgaaacagaacgggtatcgttcattgcacgtaatctacgcggtgcccgtgttcctctcctcgggcgcgcattacacgccggtggaggtgcagttccgcaccatcgccatggattattgggcgtcgctggagcatgcgctgcgctacaagaccgatttgccggacaacaagctcgccgagcattcccagacgctgctcgactgcgcgcgctcattgcagaacatcgaggtacagatgcagaacatccaccgcgacatcaacggcgcgccgcaagtgggcgaagcgcctaagacctcggactgaggtgctatggaatcggcctgcggccgattcattcaccgttgcggccacttcggcagcctggccggcgcttgggccagtagggtgccgaggaagatgagggcgcagccgaggtagccgcgcggggtcatcacttcaccgagaagcaacgcaccgcctaccgccgagaagaacgattcgaggctcatcagcaggctggctcgcgtcggtggcacccattgctggccgaccacctgcaaggtgtacgcgatgcccaccgagccgatgccggcgtacagaatcggaatccaggaatgagcagcgccggcccagtcgaccgagccttcgatcagcgaacccgcccagctcagcacggcggtggtgcagaactggccgaatgaaagcttgatggcgtccacggtgccgcccaaagtatcgatcaccagaatatgcacggcgaacagcacggccgtgaacacgagcaggatatccgccaggccgatcgaaccgaaaccatcggtgatgcacagcagatagaagccggcgatggacagcgccacggccacgaacaccagcatgccgatgcgccggcgcaggaacacgaaggccagcaacggcaccatcacgatgtacatggcggtcaggaatcccgcacggccggccgatttgccgtacagaatgccatactgctgcagggtgctggcggtgaacagcacgatgccgcagatcacggaaatgaccaccgggttggcgagcaatcgcgccacggccgaatcgggcttgttcgcattcagcttggcaccggtgatggtaacgacgtcggatgcaccgttcgatgcggcatctgtggagacggccacggatgcctcggtcccaacgacatcggccccggctgtatcgcccttatccgcgctcccccggccacgcatccacagcagaatcggcaccaaagacagtgctcccagcgtgaagcgcgcggcgttgaagaacatcggcgacatcgaatccatgccctggacctgcgccacgaacgcaaaaccccagatcagcgcggtcaacaacaggctcagcatgcctacgagttcttgtcttttcacggggagccagcctaacgtgcgaatgtgacagacatgaaaaagcccggccacaatgtggtcgggctgtgacgtttgacgggcaggctacatgccgctcgccaatcggctgtcgaggctagtccctgttgccgagcagctgcaggatgtacaggaacatgttcacgaagtcgaggtacaggttcagggcgcacaggatggagatcttcttgaccatttccgggccctgggcctcgtattcggtcagcagcgcgcgcgtggactgcgcgtcgtagatggtcatgccggcgaacaggatcaggccgatggcgcagacgatcttggtcatgccgtcgacctgcacgaaggcgagcacgatctgcgagatgatgagcacaatcaggccgatcatcaggatcgggccggccttgagcatgttgaacttggtagtcatgccgaacatggtcagcgcaaagaagaacgcggcggtgacaccgagtgccacgccgatcgagccgaggtcgtagaccatgaagatcgagctcaaggtgaagcccatcaatgcggcgtacacatagaacatgacgcgcgcggtggccgacttcatcttggtgacgcgcatgccgagcaccacggccagggcaatctgcaccacgcacaggccgatgaggcccaccatgccggtggccatgaggaagctgtagtaggctccagtgatctggccgagcacggcgaccacggcggtgacgaggatgccgatggtcatctcgccgtacaccttggtcactgagactcggcgggcttcctcatagttgtaggtcatcgtcgtgttgatggtggccgcacccgcaccggcaccagtaccctgcggcacgtattggtaggtgggagcgccctgcggctgggcatagtagttctggccgtaaccggactgtgcgtattgctggccatatccagactgttgggcggcgttgtaatcaggcgtgttgtattgcgggttgtattgcccgttgttctggggctgctgaccgaatgtcataatcgctcctttagcgtttgttccagtaccaatcttagaggaacaaagctgaacattccatgaatatgatcgatcggctcgttctgctcatctcaaagcgtaacgggcgtttccaccatgcgcgtggcatgcacttgagattcgattgacattcgatcgcagcttggaccgccgcgcgattcactgcaacgtgaaggtatgcgtcaccttggtgtcttgatccgttgataggaacgcagtgacatccaccgtaatcggcgaatcgtcttgcagcacatagcccagcgtcaccgttgccgcggtcccgggctgtgcttgggccaaatacgaattcgcgtcatagccttcaggctgatcgaagtatactgccgtctccagttcggtgccgttctggaacacgttcgggtgagccaaagtggcgaacgagttgttcttggacgtgttgttcgtccattcataagtcaccagagcggtgggcttgccgttatagtcgttgacgcttttcacggcggagactattttcacgtgggcaccttcgatatcaccttccaaatcctgctcgccctgcgctttctgctcggatgccttgctcttggaggcatcagacgatttgcccgcggactttgatgatgaggattgtgacgtgtcgatgcccttggactccttaatggaatcgtcaatggccttgctggcagcggactgcatggccagcgtgatcacaatggccaacaccgacagcaccgccgccacaatggacagcaccttgccgcgtttcttgccccggaaggtgcccactatggcgataatcgccagtatgacgccgatgaagccaaggattgcggcgatattgttgacgatgggaataaaactcagcaccaaacccaacgcgccaaacaccacggccgcgatgccgcagatggtggtatgcagatgttgcggttgcggcggctgaggctgaggctgttgtggctggtactgctgtggctggtactgctgtggggatgagggaaccggctgcggggcgatgttgtggttggacatgatgtgctccttctcgtattcttccccgaaatagggatgtgagcacgacgctaccggccgcgaaacagcgacgttagtggacgaacggtcattgttcgttgcctgttcgggcaatacggaggtgataacggtgcccgcatgtccagtggcgggggccggatgcaggtcatacagtggaaagcatgacgaacccacaacgcgccgccgggccataccccggtttccgacccggctcacggcctgacgctcgccctatgcccggcacggggtccccggttcctacaccggatacggacgaggtgcccgtgactacgcgcgtatggtgttcggtcgttatggtgccattggccagtttcatgtgcatggcgcaaacctcgttcttcgcccagaattttgcgcaggattccgcaggatacacgctgatggtcctctgcaccttgctggcattcccggcagggttcctgctcttggcccgcagcgaatacccggaggcgacgttctggatcgcctgcgcgctggtggtcgtgttcccgtatgactcgctcatcgcactgatggcgatgacctcattgctcgcccgtcgttcaaaccggaacacgaccatccgcgccacggttggcggcaccatcgtgacgctcatctcccagctccgcgacgccctgcaacagcccaaagcctcgatttggcatctgattttcgctcaaccgcataccggcggcgattcaggctccccgatggtgatgctggtggaggagccgaccgtcatcatcaccgccacggtggcctcactggtgttcgtgaccatcgctacgctcatcggcctgcatatccgttcgcgcgcccgcctgcgcacggcgaatgcggtggccagcgcggccaccacgcatgccgcgaccctgcagaccgacctgaccaaccagcagctcgccgacgccatcgcagccgaagcgcacgacaccctcgcgcattccctgtccctgatggccctgaacgccagcgcgctcaaggcggaggcggccaagctcggcgactcccccgaagcgcaatcgttggcggataaggccgaggacatccgtcggcagtcggccggggcattggacgaggcccactcgatcatcgacatgctgcgcaacccgcaccaggcatgggagcagctcgccccgtccgacgacacgtcgctgacccgcgaatcgctggatgcgctgattgcggacacgcgcaactcgggcacgtcgctcaacacctggatcgatatccagcagctgagcgtgatggatgagtcaatcggcaaggtggcctaccgcgcgatccaggagggattgacgaacgcgcggcggcacgcgcccggagcgccggtgtcgttggaggtctccgccacgccgcaggcgggcgtacatatccatatcagcaatccgatcgccacggatgcgaccgagacgcagcgggcccatggggccggactgcctggtttggcagcgcgcgtgcactcggtcaacgggcaatgccggtatgggatggacgatcggcacctgttccatgtcgacgtgcaactgccttggcgcagctaagatggctagcgtgagtgagaagaacgggaatagtgtgtctggtggaaagcccgaacgcggcggtctgaccggaagcggcaccggcttagagcccaagccgatccgggtcagcgtcatcgatgacgatccgatgatctgccaggcgatgagcctgatcctcaacgattattcccacgggcgcatcgaagtcgtctccacgtccaccgatggcgagacctgcgtgaggcgggctgccgaggaaaagccggatgtggtgctgatggacatcgccatgcccggcgtggacggcatcgaggcgacccgtctgctgcgctcgctctcccccgcgccgcacgtgctgatcctgacctcgttgagtccgtccggcaccgtggaacgcgcggtggaggcgggcgccgaggggttcgtgtcgaaaaccgatgcggcggacgatatcatccgccgcatcatcggggtatgcgagggcgcgccgcagttcaacacggccagtcagaaacagctgatcgacgatctgagcgtcacgcggccgcgttcgcgccgcgatgaggcgcgcgccctgctcgacgcgctgcccgaccgcgagcgcgaggccgtgatgctggcggccgagggctatacgaacgccgaaatcgcctcccgcatgttcatttcggagcgtacggcgaaggcgcatctttcttccgcggcgaacaagctcgacatgggccgcgtgcagatggcgcggctggtggagcgggccgatctgccggcgcggctgtaagtcgtccggttgttgagccgtatcagtcataatgggaatatgagtgaagcgattattcgaacattacgtagggatgactatccggcgctgatcgacctggtgcgccgcacctggtatgccgaattcgatgagcggaccggtctgctggcggccgaagcggactgggagaactgtctggcgcgcaccaccaacgcgttcgtcgccgaactggacggccagccggtcgccctgatcgtggggcgcgtcgatgcgctggaccatcggagcccgctcaactcgcatcggatcaactcgtggaacgcgctggcgcggctcgtgttcgcgaagggcggaatcaaggccgccggcgagattctgggcattctcggcatcgacaaacggctgcgcgcccaggccgcgagcgccgggcatgactatgcggcggaagtggtgctgttcgtacttgacccggcggcgcgcggccacgggctgggccggcgcatgttcgagacgctgatggacgcgttccgcctggccggcgtgcgcgactacttcctgttcacggacaccacatgcgatgtcgggttctatgtgcatcgcggcctgacgcaggtgtgcgagcagtcactgcccgcatccgtgccgggagaaaacccgtcttcgttctacttgtatgaggggtcggtgcccgagccggcgtgatgtgcccgccgtcgggcaaacactggtaggcttgagcacaagttggtatgccggcataccgtccacaggccggcgacgaaggggctgacatggcaatcagtgcgaaggaactaccactcgggaaagtgttcaccccggatttccggttcacgatcccctcattccagcgggcctacatctggaagaccgagaacatcctgcaactggtaagcgacttggatgacgcctgcaagtcgcccggtactccgtacttcctcggctcgctaattctggtgcgcgagggcgataaccgttacgacgtaatcgacgggcagcagcggctggtatccctgtcgatcatcatcgccgtgttgcgcgatctggagcgcgatccggacctcatgcgccaactcgatgcgctgctggtggagcccggcgacaagctgcgcggcatcgtcaccgagcctcgcctcacgttgcgcgagcgcgacgcagcgttcttccgcgaacacgtgcaggaagacaatctcgaatccgtgttcgatatgaacgacgatgatctagcgaccgcagcgcaacgcaatatcgtagccaacatccgtaagacgtacgacgagatttccaattggtcggatgccggacgccagcaattcgcgcagtatctggtcaacgaggtgacgctggtcatcgtgaccaccgacgatctcgacggcgcgcatcgcatcttcgacgtgatgaacatgcgcggcctgccgctcacctcgtccgacgtgttcaaggcgcgcgccacggccggcctgtcgaccgccgaacttgacgtgtacgccgcccgttgggatgacatcattgacccgattggcgacgatccgcatgactgtgaggaattcttcgcctatctgcatctcgtgctcacgcacaagccggccaccgacaagctcatcgaggatttcctggccgacgtgctgcaaccgtacatcgacaaaggcacggtgcccacgttcatcaaccaggtgctggcaccctacgcgatggcgtggcggatcatcgcgcgccccagcgataccgtactgcccgccgaggtgcgtagccggcttgagggattggatgattaccgcagccacgaatggaagcccgtggccatgtgggcgttggtcaattcgtatcgcgggctgggcgacgccgatttgtcgccgtttgtggttcgtgcctcgcgtatcgccagaaccacggccacgctggaatcgttgggtgcccatgacgagcgtcggctgctggaaattctgaccgcattggaacaggtgaccggcatccgcacgctgaatcgcactggagcgttggagcggcgcggttatgcgaacgccgccatccgtgatcttgacaagggctatctggtccagcgcgtgaacgggttgcatgtctcggacggcgaccgtgaaggcgcattggtccgtttgcatggcgagatgcagggtgacggcgatttggtccgtctgctgctgattcgcgccaacgagcagaaggccggcatgcagttggatcgaccacgccggttcagtgcgctgccgattatgccgttggatatcgaacggtcgaaatcgtttgcggactggccgcaggatcagcatgatttctggatgtaccgactcggcaatatggcgctggtgcagggccctgaggatcagttggacaggttgagtgaatatccggcacgtcgcgaccgcatgctgttgcgcgcggattcgcgtcgtttcccgctgaccaatcagttgaaggatttcgctgactgcacacctgccctgttggaagcgcggcaggaagaggcggtccgactcatcgtggaatactggggcatccggtatgacaaggacgcccgcgatctgaccaagcagaatgtcgatgagttgtcgaagacctctccacggccgtctcatagttcgcggcgcgtcacgatccggcaggtgattgacgcgggtcttctggtgccgggcgagcgtctggtgtgggagcggccgcgcaagggcgagcgctggttcgtcacggtcaccgaaaacggtcgtctccgtctggatgacggctccgaatatccgactccgaccgccgcggcccgtgccgccgccggaggacgtcgcggcggcggtctggacgtgtggaagcgcacgcgcaacggccagaagctcagtgacatctggaagcagttccgtctgcaggcgcagtagccggcacatcattggtggctcccctccgtgaggggagccacacgcttgtctatgccagcgccgccacgatttcagccggcgttttgcaatattcgggaaaatgcttggctagttttttgtcatacgtcaccacataggtggccccggattgttgtgcggcggcgataataaggtcatcctcgaaatcgttatgcgcgtgccgcaacgactgcgccaattcacattcctccgcgccaatcggcacgattgtcatgagctccttgagtttgctgattcccgaccatgccacctccggcaatatcagcttggcggtggtcgcaacgaccatggattcgtcattcatgaatcgttctttgaatcgttccggggtgatgtagaacacgtccttcagcgacagtgacgcacaggacagctttacctcccgctcgacgcatcgctcgaacagtttcatgacatccttgatgaaccgaggcgtacagagcatgtaataaataaggatattggtgtcgcacaagatcgacacctgctttgactgcctcatgacagactccgctccttctccaaataacgcgcatagtccgactgatgcctgtattccttcagccgttcgtcagctatctcatcgcggaactgcttgtaggtaaggccttccatgaggtcggtgtcttctgagatcagtccggccttgaccagttccttgtgtacgtatccggcaccttctcgaatcagtttcagcttgcgctgcttttcctcctcgcgggcttgctcttcggcggtcgtttccaaggccggcacttccttgcggtcggcgatgtacaaccacagcgaccggattacgtcactcaccgatacgcctttgcccttgaggacttcttcgacctcgttcttcagtttcgcatcaatgcgaacgttcatttggaccatggtcatggcaacctccattccaaagatgctatacagtatagcatactgacgtgcatgaaaaaggccggcatccgttggtggataccgacctttactccccctcagtcagcttcgctgacagctcccctcagagaggggagccagaataagtcacttcatgaggttgcgcagcacgtactggaggatgccgccgttacggtagtagtcggcctcaccgggcgtgtcgatgcggaccaccgcgtcgaactcggtcttggagccgtcctcgtgggtggcggtgacgtggaccgtcttgggggtcacgccctcgttgagcttctcgacgccggcgatatcgtaggtctcggtgccgttgaggcccagggactcataggattcgcctgccgggaactgcaacggcagcacgcccatgccaatcaggttggagcgatggatgcgctcgaagctttcggtgatcacggccttgacgccgagcatcaccgtgcccttggcagcccagtcgcgcgaggagccggtgccgtattccttgccggcgagcaccacgagcggcaccttgttgtcgatgtagtcgcgggaggcttcgaagatcgtggtcggcttcttggcgaggaagtcgtaggtgaagccgccgggcgtcacctcctcgcccacggaggcgagcagctggttgcgaaggcggatgttgccgaacgtaccacgcaccatgatctcatggttgcctcggcgagaaccgtaggagttgaagttcttcggctccacgccgcgctcggtcaggtacttgccggccgggccggaggccttgaacgcgcctgccggggagatgtggtcggtggtgaccgagtcgcccaggagggccagcacgcgggcgccgtggatgtcggcgaccgggtccggcgtggccttcatgccgtcgaagaaggtctgcttgcgcacgtaggtggacttgtcgttccacgcgaacagctcgccttccggcacgtcgaggcccttccagcggtggtcgccgtcgaacacggaggcgtagtctttgaggaacatctcgcggctcacagtgccgtcgaccacggcggccacctcggagttggtgggccagatatccttcaagtacacgtcattgccgtccgcgtcggtgccgagcggttgggtttcgaagtcgaagtccatcgtgccggcgagcgcgtaggcgatgaccagcggcggggaggccagatagttcatcttgacgtccgggctgatgcggccttcgaagttgcggttgccggagagcacggcggtgacggtcaggtcgttggcgttgatcgcctcggagatctcgggcagcagcgggccggagttgccgatgcaggtggcgcagccgaagccgacgagctggtagccgagcgcgtcgaggtcgtcctgcagaccggcggccttcagatagtcggccacgacctgcgagccgggggccagcgaggtcttgacccaaggcttgggcttaaggcccttggcatgtgcgttgcgggcgatcaggccggcggcgatcatcacggacgggttggaggtgttggtgcatgaggtgatcgaggcgatggccacgtcgccgttttcgatgtcgaaatcgccgcggaagtcggtggacacggccaccggatccttgacggtcttctcggtctcataggcgggagcggtcttctcgaacatctccttggcttcggagagcagaatgcggtcctgcgggcgcttcgggccagcgatggacggcaccacggtaccgaggtcgagttcctcgtattcggagtactgcggttccacgtaatccgggtcggaggcgtcgccccacagcttgttggccttggcgtaggcttcgaccaacgcgacctgttcttcggagcggccggtcaggcgcaggtagtcgagcgtgacgttgtcaatcgggaagatgccgcaggtggagccgaactcggggcccatgttgccgatggtggcgcggttggccagcggcacggaggcgatgccttcgccgtagaattccacgaacttgccgaccacgccgtgcttgcggagcatgtcggtgatggtcaggaccacatcggtggcggtaacgccctccgggatggagccggtgagcttgaagccgaccacgcgcggcacgagcatggagatcggctggccgagcatggcggcctcggcctcgatgccgccgacgccccagccgagcacgcccagaccgttttcggtggtggtgtgcgagtcggtgcccacgcaggagtcgaggtaggcgagcgtgttgccgttggcctcggccttgctcatgaccaccttggccaagtattcgatgttgacctggtggataatgccggttcccggcggcaccacgcggaagttcttgaatgcctgctgaccccagcgcaggaactggtagcgttcaccgttgcgctggtattcgatgtccatgttctgctggaccgcgtcggcgatgccgtacttgtcgatctgcacagagtggtcgatgaccatatcggactggacctgcgggttgatgacctccgggtcgccgccaaggtccttgaccgcgtcacgcatggtggcgaggtccacgatgcagggcacgccggtgaagtcctgcatgatcacgcgggacggcgtgaactggatctcgtggctgggttcggcgttcggatcccagtcgagcagggtcttgacgtgttcgtcggtgatgttggcaccgtcgatgttgcgtaccagattctcgaccagtaccttcagcgagtacggcagatgatcgatgccgtcaagattggcgatgttgtagtaatcgaagtccttgccggctgccttgagggtagccagctggtcgtcgcgtaaggacatgcttcctccgaaatcatgaatcggcttatgatgccgttgattatccgatacaaatggtacgggtacgttactttggctctggcgtgtcggcttgaagtgtgagacaattcgccgctattagatattgaaaccgtgctggcgcagtagattgccgaatattctgccgaccagcggagccagccatagacagatcacgaaaatcatggccgcgccgcccaacgcaatcagcgtggccaccaacgcagtgccggtaggcagaatcagcgcgaagaagttcgccacgaacgggatgaacgcgccgatgatgccggccgccgcgaaccccgcgaccagcgcacctcgccagctgttgagcggcctcgccacacgggccagcacaaacacgcccatcaaaaacagaataatggcgctggtggcgcgcaaagccgacagatcggcgtcattgttcaccacatcccagcccatgacgttcggcagggtccatgaagccagcaacaccgacagcgcggtggcgatgccgcccggcagcgcgaacgtgaccacgcgcttgaggaatcccggaatatagcggcgcgtgttcggcgcgagcgccagaatgaacgcgggcatgccgatggtgagagcgccgatatacgtgatatggcgcggcaggtatgggtatgggatttgcgtcagcactacgccgagcgagatcagcgcggagtacacggttttgacgaggaacaggctggccacgcgctccatattggccatgacctgacggcctcgcgccacgacgtccggcaggtgcgagaacttcgaatccaccagcaccacctgggccacggccttggtggcgggtgccgcattgcccatggcgatgccaaggtccgcctccttgatggcgagcgcgtcgttgacgccgtcgccggtcatggccaccacgtggttctgcgtgtgcagcgcttgcactatggccttcttctggtcgggcagcacgcggccgagcacatcgacgttttcgagcacgcgggcaagttcgttcacgtcctcaggcagttcgcgcgcgtccatcgccaccggctcatggtcgccggtgagtttcactctgcgggcgatggcacccacggtcactggattgtcgccggaaatcacacgacagcgcacaccctgctcacggaaccaagcgagcgtccgctcggcgtcctcgcgaatcttctcagagcacaacaccaacgccaccggctcagcctgcacatccagttgcgggtcgtccgagacattggctccctcaactgctcccctcagtcgcttttggcgacagctcccctcggagaggggagccagctcgctcttctcggctcccctctccgaggggagccgtccgcgaagcggactgaggggagctgtagaccgcgcaaccagcaacacacggttgccgtcattggcatactcgttaacccgctgcaacaccgacgaatagtcaccctcaagcgcagaaataataacctccggcgcccccatgtaccaggtctcgccggatttacgcaccgcgctccatttgcgcgccgaagagaacgggacacgagactcaaccgcacctgccccatatccttgggccttaagcccggcgagtacggcttggccggtgccgttgggctgctcttcgttgcagcagtcgtagagagactgcgtggctgcctgttccgcagtcgcattggcggagccgagcatcacgagccggttgaaggcgataccgccatcggtgatcgtgccggttttatcgaggttcagcgcgtccacgcgagccagtgtctccacggattcaagctcctgcaccagcgtattgtgacgggcgagacgcatggcggccaccgcgaagttcagcgaagtcagcagcaccaagccttcgggaatcatgcctactacgccggcgaccgcggaaaccacggcttgccgccattcgccggtggagagtgccgtgccccaaccgccgaccgtatgaatctgcgaaagaatcagcagaatgcacagcggtaccacgaggaaggtcatgaatttcagaatcgtgttgatgcccttgttcaggtcggacacggttttcttgtataccttggcctgcgcggtgagcgtggcggcgtaggaatggctgccgaccgcattgaccttgaccaatgccatgccggagaccgcggtggcaccggaatacacctgctcccccaccttgtggcgcacggtacgagattcgccggtgagcatggattcgtcgagttccagtccccaggtctggatgatctgcccgtcggccggcacctgttcgccggcacggatccacagcaggtcgtcgagcacgatctcgttgtggggcacctccacgtccctgccgtcacgatgcacgaggaattcggaggccacaaggatggaaagcttatccaacgtgcgcttggccctgagttcggtgacgatgccgatgcccgtgttgatgatgatgacgaaaccgaacaccgcgtccctccaggaaccggtgatcagcaccagtaccatcgcggcgaagatgatgccgttgaacagcgtgaatacgttggctcgcacgatatcttgaaccgaacgcgaggtggatgttttcaccgcattcgattggccactttcgatacgctgcaccacttctttgggggtaagaccggttgctccgatctcaggcatttccacggctgttgttgcactcatattccccagcctaccgcgtcttgtttcgcaatccgctaaggctcagggatgattcagggtgctttctcagcttcaagggcctgattcggctcaggaaacggtgactttgatctcgcgttcgtggggttcgtcgcgcgtgatggtgagcacggcgtcagtaatagtcattggcttggtatcggcagtgtcgccagaatcggcactgttggtgttgaggtgaaggatgacggcgtacagcagttcatcttcgggcgcatgctttggatcaatgagagcgactggaataccggcttcacgcgcattggtcaacgtctggttccagctctcccggttggcgtcggtaacgtcgatgccgctgataaccacgattttgaccgcgcgagctacgaaatcggcaacaccctgctgtgcggtggccgcattcttgtcgacgccagtatgagcatccatactatcggcaccgttttcgctggtagtgccggcgtcagaagattcggtttcaccggatacaccatcagttgcgtttgccgagcttgcggatgtttcgagcgaggcatagtagacattgagtttgtcatcagacagcgcattgatgacgaactcgtctgcggcggtgtcagtcgaccccacaaagccgactgtgacatccgtgggatgtgtggaatcgtgggcgacttccggcatgctgtcttgggtatcgccaaccgccctaccggccggcgtgcaggcggccagggacaacacagccgccatgcaggccagcaatccgagaattcgtcgtgtcatatgctcacctgtcagcgggtaaacagggccaccgtctcaacatggtgggtcatcgggtagatatcgaaggcacggatgtctttgagctcgtagccttcgccgatgagtgtcgcggtgtcgcgtgcgaggctggtgggatcacaggcgatgtagaccacgctggatgcgccggccgcggcaatctggcggcagaccttggcacgagcaccggcacgcggcggatcaagcactacgacattcggcttggccagatgcgccggcacatggtccagcgtgcgcgagacgtcacccgcgcgggcgtccacgtcgttcaggttcatggcgcgcagattgcgctgggcgttcttgacggccacacgcgcgccttcaacgctgagcatgcgggtgcgttcaccggtcattgtggccagcggcagggtgaacaggccggaaccggaatacaaatcccagattacggcgtccgccgctgactgcagctgcccgttgaccaggttgatcacgtgcgtaccgagggcgatcggcgcttggcgatgcacttgccagaaaccgttggcgtcaacctgatagtcgaaggtcgtgccgttgatggtcacctgttcggtgagcagctgggagccggcgcgcagttcgccgtccacaagtacggcgtaattgtcgtctgctgccgcggtatcgacgatctcgccgcgcggttcgggcacggaaagacgaatctgggagccgggttcaaagccgccctcccacacgtgttcgcgcttggcgacgtccagcagcgtgcgcgtggcaagcggcatggtgtcgatggccacgcggttgtgtgtgccgcgccggcgcatggatggcatgccgttgtcgtcggcaatcatttcgatgcgggtacgccaattgaggccgccggctgccttgtcgccgggcatgcgctcgatgggaacggccacgtcgatatggccgagtcggctcatctgttcggagacggtgatggccttccacttgagctggccgggcaaagagacgtgcacgagatccgcgccgcccactcccccgcccatcgccaagggaccggcaagtggccatgccggggtgactcggtcttcggacggctcgagaacctcgacgacttcgccggtccagaaccggtcgtcccggtcgtggggctcgtcaagttcgactcgcacgagttcgtcgggcaaggcgaagcggacgaacaccacacgaccgtcgatatgggccacgcagcggccttggtcggcgtatcgttcgatacgaacttcagcttgcatcatcgtcctttccggttgcgctcggttcgagttcggcatcaacagcgacttcagtctgtatcttcctagccgcgaccttatgccggtgcatcggcgtggcaataatgaggtaactcacccaaatcgccaatgcccagaacggaatgcccatgagcaggcgggtcacgccgagtgcagctacatggttggtcagatacagcggcacctgcaccaccagccgcagcaggaacagaccgacccacaggccggtgacaatcatataggcgcgtttcagggccttgtcgtccatccagtcatggaaccatgccttgaaatgctcggtgggcaggctacggatgaattcgacgaccaaacccagtccgggcacgcgcgcaatcagcgacacggcaagcaacgcggcatagccagcattggtaatgaatccgaagatgtagtaattgcgggcctcatgagtctgccatgcccaaatcaggcagatgcctaccgccaccagaccagagaccgcgcccattaccgactggcgctgaatcagtcgcacaataacctgcaataccgccaacacggccgaaaccgcaatggtgagattcagattgctcgtggccacgaacagtacgacgaacaccacgccaggcagcatggattcgatgacgccacgcgggccaccgatggcgtcgatgacggagaaatcctcgccttcattgccggcgtcggctagagcggacaggccggtgcgtttgttgtctgccaagtctcttcctataaatcagcgaacttcggagaacatcgggccgcgagacagcgtggtcttcacttcggtctgctggtcctggctcaacgggcccttcggcttgttgtccggaatgtccttgaagtgttccttgccgttcgcctcgccggcttcggccgcggccttggcggccttacgctcagcgggggcgaccggcggatgcatcgggatcagatcgcgcggcgccaaaggctcctcgccacgctcgacgacgatgccggcgaagaacttgttcagcgcctcggtctccgggctgtccggatcgatagcagccttgccggagaagatgccacgcagcatccagcgcgggccgtccacaccaacgatgcgcgtgttcacggtcttgccgcccttgacattgaccggcagcttcagttcggtgccgaacacaccgtccacttcagaagcggccttgttggcttcaagcaggtcaccgcgaacgtcatcccacagtcccagggtcttgggtgcggcaaaggcttcgatctccaggctggaggagccgaaggtgatggtggaaccaagcacttgctgggtggcgcggttggccttgatacgcagttggatgccccggaggaagggcaggtagtaggcgcccagatccagataatcgtcataatcgggcacgtcctcatcattgacgtcccacgggcctcgctcttctccgcggccctggtattcgctggccggttcggcgagcacggtctccgcgctctcggcctttgcggcagcgttcgcttctgcggcagccaccttgtcttcatcgacaggctcaacggccggctcggcttccttcttgctcttcttcttgccgaatccgaacagtcccataattcctcgtttcatgtaacggttgcaaccttgctaacactagcactcaggcttagagaaagctgagtcacacgtcgtatgtgatggtaagtggcgcgtggtcggaccaacgcaactcgtatgtgggggccttgtcgatcacaaagccgcgcgcggtctccgccagctcgggcgtggcgaactggtagtcgatgcgccagccgacattgttgtcgaaagcgcgcccgcgctggctccaccacgtgtacggaccctgaatatcaccggcgagcgaacgcatcacatccacaaactcatattcatccagccacttgtccacgtaggcgcgctcctcgggcaggaagccggcgtgcttttcgttggccttggcgttcttgatgtcgagcggcgtgtgcgcgatgttgaaatcgccgcacaataccgcctgcttgccgccgtgcgcggcctcgtcgcgcaactcgcccatgcgagtgagcatcgtgtccagaaaacggtacttctgttccatcttggtcgaatcatcggtgttgccggcgtgcacgtacacgcaggccacggtgatcgtgtatccctgcggcgtcttgacatcggtctcaatccaacggccggaatccacatcctcgctcaagcccggaagtccatagcgtttatcggtcacctcaagatcggtgaggagcccgactccggcacgacccttgacacggcagacctcgttcagcgaatgcaggtcagagggtgaggcgatcttgccggcggtggcatactcgaaaccgaattcgccgaaaatcgaatcgacatcctcttgcggggcgcgcacttcctgcatacaccagacatccggagcatgtttgccggcccagtcctcgatgcccttgcgctttgccgcgcgaatgccgttgacgttcgatgtggtgatggtgatggtcatgcagccatactattttggcctctctaccagtaccgcactcacgattacattgaggtataaaaaattagctccctcataagagggagctaatttagaatgtcctatcagtccaaaccgagctggagcttgccgccggggatggcgtcgagcaggtctcgggtgtactgcttctgcgggtggtcgaagacctcgtcggtggtggcatgctccacgagcttgccgtgctgcatcaccacaacctcgtcggcgatctgacgaaccacggccagatcgtgggtgatgaacaggtagctcaggcccttttcggcctgcagatcgttgagcaggcgcaacacctggtcctgcaccagcacgtccaaagcggacacggcctcatcgcacacgatgacgtccgggtccagagccatggctcgtgcgatggcgatgcgctggcgctggccaccagagagctcgttcgggtaacggcccatcacggaagccggcatctcgaccatgtccagcagttccttgacacggttggctcgccacttggaatcgccgatcttgtggatgcgcagcggctcctcgatggaacggaagatggagtacatcgggtcgagcgaaccgtaggggttctggaacaccggctgaacgtggcggcggaaaccgagcagatccttggccttgaacgtggaggtgtcgcggccttcgtagaacaccttgccggaagtgggcttcaggaggtgaagcaccatgttcgccacggtggacttgccggaaccggattcgcccacgatggccagggtggtgccgcgcttgacggagaaggacacgtcgtcgacggccttgaacatctccttcttgcggggcagcttgaattccttggtcaagtggtcgacggtgatgatgtgctcgctcttctcaagcgtgctttcgccggcgatgtggtgatcgagcagggcgtccgcgttctcaccgcgctccttggcggagatgatgcgctgggaggccagcgacggggcggcggccacgagtcgcttggtgtacgggtgctgcgggtgctgcagcacctcgagggacggaccggattcgacgacctgacccttgtacatcacgacaatgtgctgggcacgctcggcggcaaggcccagatcgtgggtgatgaacagcacggcggtgcccaacgagtcggtgagcatgtgcaggtggtcgaggatgcgcttctgcacggtcacgtccagagcggaggtcggctcgtcggcaatcagcaggtcagggcggcaggccagaccgatggcgatgagcgcacgctggcgcataccaccggagaactcgtgcgggaactgacgggcacgggtagcggcgtcgggcagaccggcctcggacagcagacccgcgatacggtcatccattgtggagccgatgacgtacttcttggcgaggtaccaggcctgatcgtcggccacgccggccttgatgaggtcgtcggccacgcgccaacgggtttcggagcccggaacccattcgttggtgaagcgggcgacggccttgtcgaaggcctcgccggacacgccggcttcggtcaaagccttcttggcctcggtcatgagctcgggcagttccttggcaccgaggaaggtctcgtcgtcgttgcccttgacttcgacctcgtcgccggccagggccttggcgagggcggagcgcttctcatggtccacgtccatgttgttggccttcagtgcttccttgacctgggtgccgatacgccacaccgggttgaggttgctcatcgggtcctgcggcacgaggcccatcttggtgccgcgcagcttgtcgaactcgctctgcttggcgccggcgatttcctcgccgtcaagcttgatggagccgttgaccacgtgaccggtgccgggcagcaggcccagcacagccatggcggaggtggatttgccggagccggattcgcccacgatggccacccactggccggggtagacggtgaagttggcgtcgcgcaccgcatgcaccggcttgccggtgtcagtggtgaagtcgatggccagatccttgacctcgagcagcggaccatgctctttctgcatagccagcatcttggcgttggtgttgtcagtcataatgattctccactcccctcactcaggccgtacggctcttcgggtcgagggcgtccttgacggcgtcgcccatcatgatgaacgcaagcacggtgatggccagtgcggcggacgggtagaacagcaccatcggatcggtctgcaggttggtctgtgcgctggagatatcgccaccccagctcaccgtggtggtcggcagaccgacgccaaggaagcttagggttgcttcggccacgatgtaggaggccagcgaagtggtggcgatgacgatgatcggggccaaggagttcggcaggatatggcggaacagattcctggcaggcgtggagccgagggccgtggaggcggtgttgaattcgaggttcttcgattccagcacggcgcttcgggcgatacggcatacgccgacccagccgaagagcgtcagcaccagcacgatcttccagatggacttggaggtcttgaacatctggagcaccacgatggcgccgagcagcataggcagggcgaagaagatgtcggtgatacggctcagcaccgcgtcgacccaaccgccgaagaagccggcgacggcaccgatcagggtaccgacaatcacgaccagtagcgtggagagcacgccgacggacagtgaggtacgggtgccgtagaccacgcgggtgtacacgtcgcagccctgcaggtcgtagccgaaggggtgtccggcggaggcggggctcaaggagttgcccagatcgcaggcgttcggatcctgcttggtgaacagaccgggggcgatggccaccacgatgatgaagaggatcagcagcccggagatgatgaacagcggattgcggcgcagggttcgccatgcgtcggcccacatgctggtggccggtgcggattcgtcgacggaatcgacgtcctgcaacggggtctcgtcgagaggagctacgtaacggtcctgaccgggcagggtttccatgaagtattcggttcctggctcgccggtctcgttgagctcgttttcagtggtttcgtttgccatgtgactcactcctccctatcacgcgtaacggatacgcggatcgagggccgcgtacagcatgtcgacaacgaggttgcacactacgaaaatcagcatgagcaacgtgacgatggacaccaccaggtttgcctcgcccttcagaatggactggtaggtgaggaagccgatgccgtggatgttgaagatctgctcggtgatcatggcaccacccatcagggcgccgatgtcctggccgaggtaagtgacgactggaatcagggagttacgtaacacgtggcgcagcatgacctgaccgttcgacatgcccttggcgcgtgcggtgcgcacgtaatcctcggcgatgttggaggagatttcggagcgggtcagtcggatgatataggccatcgacaccgaaccgagcaccatggccggcatgagcagatcaaggaagccggggtcggcgcctgccgtcaccggcaatatcgctcactgaataccaaagacatattgcatgacgaagccggtgacgaaggtcggcacggaaataagcagcagagagacgatcaggatgacggtgtcgtaccacttgcccttcttgaggcccgagataatgccgaagaccacaccgaaaatcgcctcgaacacgaacgccatcaagccgagcctgatggtgaccgggaaggcgcgggtgatttcgtcgagaacgggctggccggcgaaggtatcgccgaagttcagggtcagtgcattcttcaggtagataaagtactgaacgatgaacggctggtcgagatggtattctgcgcggatctgggctgcgacggcgtcattgacgggcttgtctccgaacatggccttgacagggtcgcccggcagggcgaatacaagggcatataccagaagagtcgtaccgagaaccacgggaatcatctgcagaatgcgtcgcagaagatacttacccatacggttgctccttatttcctagaccggccagaaagggcatagtacgcccccgccggtcgataaatactccgacagtttaccgcatgcccggactgtgatatgtaaatttgcgttaacgcaaggtttgagattgggcaatgttggtggatatgtccatggttgcggtcggatagtggatactttaacttggttcccgatggcgtgagcaagcacccctcacacaacaaaaagggcggggatcttgcgatcctcgccctttatttccgaactacctaacggtatccgttcagtgagtcagactcacttcttggacatctcggtgtaggtcgggaggttctgccaatcgaaggcgtagccggacttcacgttgagggaagccacaccggaggcgttggagtagtacagcgggatggccggaaggtcgttgaggaggatttcctcagcctgctggtacagcttgttggcgtcatcagtgctggaagcggcagcagcctgcttgcacaggtcatcgaaggccgggttcttgtagtcaccatcgttggagccgttgccatcagcagcagcggtggagtacagctgccacaggtagttctcggcgaacgggtagtcaggctgccagccggtacggaaggcgcccttcatctgacggttggtgaccgcgtcacggaattcctggaaggtcgggatcgggttggtggccgcgtcgatgcccaagttgttcttgagctggttcacgatagcatcgtagagcggcttggcaccaccatcggcgttgtaggagaaggtgagctggccgtcgtacttggagatggcgtcagccttggcccacagttccttggccttggaggcgttgaacttcaggttgtcggcacccttgagggagtcggagtagcccggggtcttcggggaggtgaactcggtggcggcggtggcgttgccgttgagcaccttgtcgatgagctggtcacggttgatggccatggagatggcctgacgacgcagctggccttcctcgtcgttcttgaagtggtcaagggaggacgggatggtgaaggtctggatgacggagccggcctcggagtaagcctggaccttcttgtcggtcttgaaggtcttggtgaaggcagccgggacggattccatcacgtcgaggttgccggcctgaatgtcgcggtaggcggcggagtcgtcggtgtagaccttgaaggtcacgccgtcgttcttgggctgctcgttacccttgtagtcagggttcttgacgagggcgatttccttgttgtgatcccagtggtccagcttgtacgggccattggagacaggcttctcgccgaaggccttcggatccttgtagaaggactcgggcagcggggcgaaggccgagtagccgaccttgatcgggaacacggagtcggactggttcaggtcgacggtgaaggtggtgtcgtccacgaccttgaggccggagagctgctcgtcacctttgaggccatccttctgcagatcgtcatagccggcgatggcggagaagaaggaggagcacttctgggcgttcttggcgttggccacgtaggaccaggccttggtgaaggactcagcggtcaccggagtgccgtcggtgaacttccagccggacttgatcttgatggtgtactgggtggcgtcatcgttcggggtgatggactcggccacttcgttggaagccttgccgtccttgtcgaaggagaccagacgggagaacagcaggtcgaccggcttgccgccgccggtttcgttggtgttgcccgggatcagcgggttctgcggttcggagttgtacgcagtgatgatgttggagccagcggtgtcaccggaggcagcgttgctgttggagccgccgcaggcgctcagcagcatggccacggagcaagccatggcagcgaaagcaagagctttcttcttcatatgatttctcctattcattaggttgcgaagcgtttcagcctcgcctcatgcgaacggggtcggatttcctcatcgtcgggacacttacgcttcccgccgcttcggacacccaaccccgttgctgttacctgtcatttttgcgcacttgggagacaagcagcgtatttttgttacacccatgtaaaattcgggggcttttaccggctaggttcagtctttgctaagtttgttaaccaatgcccacatagtggtcatgcccggggaaaggcctgtccgtaacggttcttgagctgctcgatggagacgtgcgtatagcgttgtgtagttttcaaggaggaatgcccgagcatctcctgcacctccctcagatcggcaccgccgtccagcatgtgcgtggccgccgaatggcgcaacgcatgggggctgatgtccggtacgccggcctctcgggccgctctgtgtacgatgtcacgggctatgcgttggtcgatacggccgcctcgtgcgccgaggaacagggcgttggcagcacgggacttgactgcatccgttgccgtacgggccagtaccggccgcccctgttccagccaagtctccagcgcacgctgggcgggtagtccgaacggcaccacgcgttgcttgttgcctttgccggtgactttgatggtgcgagtggagaagtcgatgtcggcgatattcatcgacaccagttcggcgacacggatgccggtggcatacagcagttcgagaatcgcggcgttgcgctgcgattcggcgacgactcgggcgctgtcgcgcttgtctgcacgggcgggtgcctcgttgcggtttacggtgtcggctgacttatcagctgtcttgccgactgccttgccgctgccactgccggacgcggctgccgctcccccatcgcccttgtactggtttgttgcaacggcctgttcggcgacatccaataactgctcagcttgagattcggtgagcaccgcgggcagcgtgctgggaatcgagggagtcatcagtgtggcggccgggtcggtgttggtcaccccatgctcataggcccacgcgaagaacccgcgcacggccacggttttgcgggccatgctgctgcgggcgtgatcgcgcgattccaccgccatccagctacgcagatcatccagcgtgatctcgttcagatcggtcacgccgcgcagctcgaacaggtgcagacatgccgtgagatccgcgcgatacgctttgagcgtattcgctgacaggccgcggttggacttcagataggagacgaaggagtcgatatcgccgtcgaactgcgtagatgacactctcgttctcctccgaattctttatggccttgggttacggccggggtggcgtgttgcgccgctccggcacgggtttcaatgtggcaatctgttcctgatggatggtcacgttctgggccgggcgcgaaccattggcggcggcgtcacgcaccatctccaacgtgtatccgtcccaggaaaccacgtgacccacatagtcgcggaacttcatacggtggtcgaccgggtcaatgccgtcggtgatgcgcaccaccacgcgggcaccggccggaatctgccttggtaacgtcatacgtcatcatcccccttaaccattcgccgcatcaacttcgatgcgtttcccgaaaaacggtacagactaccttactcctttgagcctttcgaacagcggagccacacggtcttctcacgaaaacaagcgggaacttcatccccctcgcgcggccttcttcgtgacaggcggcgaggggaacctgcgcacgggcctacatggcggtacgcagttacatggcggggcgcagttggatgatggcctgacgtggatggacgaagccggtgatggcttctcctcggcgtgcggagaacagcagggtctgctgccagccggcttcggggacgacgagctcgcgttccgggaatccggcggcagttgtgccggcttgcggcgcagcggtggccgtaccgtcttgtgcagcggtgatgccggcatgtgtcacggcggccttgtaccggcggaaggggtcgccttcggcgaagaatcccatcacatcctgctcgccggcggcaccagcgtgcagttggtcggccatatcggtcagacgtgccgccatgcggcgcagcagcgcttcgacgttcagcgagtcttcctcgaccatcgcgcgcgtgcggtccgggtcggtcagggacacgcgggtcatgtccctccagcagccggcggccagcgcggcggcgatgttgcggtccgggttggcgaccagttcgttgatcagcgcggtggacaccacatgcggcatgtgggagatcatcgctgcggccttgtcatgcgtttcgtcgtccacgacgatgacgcggttgccgacgtccttggtgatcatcgcggcgacgtcgaggaagcggcggtagtccgtggactcgtccacggtgatggcccatagggcaccgtcgtacagatgcgggtcggcggcctgccagccggacagttcgttgccggccatcggatgggcgccgacgtagcacttccccagcccggcagccttgacctgatcgcggaccatgcccttgaccgagcccacgtcggtgagcgtggtgttcggatggtcgcccatgagcggggccagggcggcgaggattgcgggcatcgccttgagcggattgcacagcacgaccacatccggctcggcatccatgagttcggagagcgtgctcttgcagaaaatgccatcggcttcggcctgggcgtaggggtgcgggcgatggttccacgcgacgacgcgcacgccgcgctcggtcaggcggcgtgcgagcgagccgccgatcaatccgagtccgacgattccgactgtatctaccacagcagttccttccttgcttcctcggtgtactgccagccttccggcgcgcgattggtgatgtggacgccgccctcgggcagcatccaggcgtcgaccggcgggttcgggcgttcgcggcgtgggtagacggccagggtttttgcccagtcgccgtgtccggcgatctcttccagtgcggtgcggaatctcggctcccagggggcggcgtcaagggtggcgatgaagctgtaggttccgtcgtggcctttgatcgggcgcgagatgaagctggtcatgttcagtcccgcatcgcgcaggacgtccagcaggtcggcgagtacgccggggccggtgaccagcgggatgaaggtgatgatggtttcgaagtcgccggcgtcattgctgtgggcgcgggcgttgagttcctggaccacatcacgcggggcgatgacaaggaattcggtgtgcgcgccatcgaaatcctgcacatgttcggcgagggtgtcgagatcgtagagttcgccgcagatgctggggccgagcgccacgcggccgggcttcaggtcgcggcaggcggcggcgttggaggatgcgggttcgggctgcaaatggtgttcggcgatgaaccgggtgcattgggccagaccgtgcgggtgggcgctgacggggttgccggtgcagtcgtagatgctgtggccgcgcacggtgaaggcgttgaaggccacgtccacactgatccgggcgaagccggccgcgttgggggcgtcgatcagcgcgtcgagattcgggaccacatagccttcgacgttgttttcccatgcgatgacgccccagccttggcgcgactgtacggcctgcatgatcgcgggcacgtcgggcagagcgatgaggtcgaagtcgccgagtgtggcgaactggtcggcggccgtcattgccgcctgatgggtgaaggtgccctccgggcccaagtaaaacagtttcatgcgtgccataaagttctatggtagcggccgtaatcccctacgcccgccgatacgcgacgcattcccgggaatgtatcgccatatatagttacgcgcgcgattcagaatgagtgggaatgacgaaccagcgggcgggaagaatgagcaggacgacttggaccagtatcaggccgtacagccagatgtagccggcatgttgggagaagaacggcatgtcgccttggaatccggcgacgatgagcgctttgccggatgtggtggtcagcgccatgccccatgcggtcagtgaggaggcgatgaggtgcagggccagtccgaccgcgcccatgcgcgaacgggcgcaccatgtcgataggccgatcagcagaaacgccagcaccagaccatacggaatattcagttccgcacccatacggtgggcgaacgtgcccacaaaggcggaagccacgcccgccgcaatcgtgatcaacgatttgaccagcgcgttctggcgatacgaccacggacgcaattcagtagtgctcttcacagtcatgcgtttcagtataggtggggatatgacttggtgaggaataaacttagctcccctcagagaggggagctagagagaatggtcggctacagccgcaccaaatcacttaccctgctgggcggcgttctggcggcgctgcttggcgcgccacttgtaccagtcctcacggccgaggatgatcttgcgcacgcggatggactccggggtgacttccacgcactcgtcctcgttggcgaagtccagggactcctcaaggctcatcttgatcggcggggtcagggtttcgagcacgtcagcggtggaggaacgcatgttggtcatgtgcttggccagcgtgatgttcacgtccagctcgtcgggcttgttgttcacacccacgacctggccttcatacaccggggactgcggttcgacgaagaagttgccacgggcctgcagacgctgcatggcgtacggggtggcgatacccttgcgatcggaaaccatggaaccgttctggcgaatggtgatggcgccagcccacggcgcgtagccggcagagatggaggaggagatgccggtgccacgagtggcggaaagcagcgcggtgcggaagccgatcagaccacgggacggcacggtgaactgcagacggacccagccggagccgtggttggtcatgccatccatacggcccttacggtcggccatgagctgggtgacggtacccatgtactcttccggcacgtcgatggtggtgttttccatcggctcgttgatcacgccgtcgatcttcttggtgaccacctgcggacggccgacggtcagctcgtagccttcgcggcgcatctgctcggcaagcacggccagcgccagctcgccacggccctggacttcccaagcgtcgggacggtcggtgggcagcaccttgatggacacgttaccgatgagctcgcggtccagacggtccttgatcatgcgggcggtgagcttgtggtccttgccctcggtgccggccagcggggagtcgttggtgccgaaggtcatggagatggccggatcgtccacatggatgagcggcagcggcttcgggtcgttggggtcgacgatggtctcgccgatcatgatgtcgttaacgccggcaacggccacgatgtcgccggggcctgcggattcgaccgggatacgctcgaggccctgggtgcgcagcagttcggagacgcggaagttctcgagggagccgtccacacgggacaggccgtaggtcttgcccttctcaagggtgccgttgtagatacggaccagaccgagtcggccgaggaagtcggaggagtcgatgttggccacgtgagcctgcagcggggcgccctcctcgtattcgggggccgggatggtggagatgatggtttcgaacagcggctcgaggttgtcgttgtccggcaggccaccgtcggcgggctggttcacggaggcgtagccggccttggcggcgcagtagatgaccggcatttcaagcagctggtcaaggtccaggtcgatgccctcgtgctgcacgtcgtcggccaggccgagcagcaggtcggaggtttcgccgacgacctcttcgatacgggcgtcggggcggtcgaccttgttcacgcacaggatgaccggcagcttggcttcgagggccttgcgcagcacgaagcgggtctgcggcagcgggccttcggaggcgtccacgagcagcacgacgccgtcaaccatggagatgccgcgctcgacctcgccgccgaaatcggcgtggccgggggtgtcgatgatgttgagggtgatgccctccgggtggccgtacttggcggccagcggaccggtgtattccacggccgtgttcttggcgaggatggtgatgcccttctcgcgttccagatcgttggaatccattacacgatccggcacttcctcacgctcggaaaacacgtgcgactgctgaagcatggcattgaccagggtggtcttgccgtgatcgacgtgagccacaatcgccacattacggatatctccacgaaccgccatcgaaacctctcttaatactgattcttttgcgtaatcgttcggtacttgcgttctcgagtacttaagtacttactctgaggtgtttattcatacctacacacaaaccgtcacgatggtactcgcacaccttgactatgtcggaacatagaaaagcacctcacaacggcagaactcccgcgtctcgacgaacccctcgcgggatttctgccgtttttacggccttcaaacggcagaacccccgcgtccctttcgccgggacgcgggggttctgccggtaatcaggcaaatatctgttctcccgtcatcgacttccgtcagtcttcgagatcgaggcctttgcgttcgggcaggcagagggcggcgacgcaggcgatgatgaaggcggcggcgaagatgatgaaggccacggccttgttgccgccggacagggtcaggaaccacggcatgaggagcggcgcgatgatggcggcgatgcggcccaccgctgcggcggcaccggcggccgcgccacgcaggcgggtcgggtagatttccggggtcacggcgtacagcacgccccacgcaccgaggttggaggcggacagcagcatgccgaacacgagcacgagggccacagatccggcctgcgagaacgcgaaggcggccacggcggagacggccaggaagatgctcagcgtcttgcggcggccccagacctccaccagccaggcggctaggaagtaaccgggcagctgggcgatggagatggcgagcgtgtagccgaatgacttggtcagggagccgaactggtcggcgagcagcgacggcatccatgtgaacgcgccgtagtaggagaagttcacgaagaaccacgtggcccagatggcgatggtgcgggccaggtacttggagccgaacagttcgcgcgtcttgatcttcggcagcggcttgcccttgggagaggttaccggggctactccccggcttcctcgaagtagcgcacggccttttcggcttcgtcttcgcgacccttggcttcgaggaatcgcacggattctgggatgtgcacgcgggtgacgattgcgtagagcagtggcagcgcgccgatggccagcgcccagcgccagccccagtcgccggtgttcgggatcacgaagtagccgatcatggcggcgacgatccagccgacggcccagaacgattccagcagcacagtcatgcggccgcgctgtttggtcggcgaaaactcggagaccagcgtggaggcgaccggcagttccgctcccaagcccagtccgatgatcagtcgggcgccgagcagcatgccgagtgaccaagatagggccatggcaccgttggcgatgccgaagataatcagtgtggcggtgaacacggttttgcggcccacgcggtcggcgatgaagccgcccactgccgcgccgatggccatgccgacgaagccgatggacagcacccatgacttttcggtcggggtgaggttgaagtgcgggtcggcggcgatggcggcgactacgaaggagacgaggccgacgtccatggcgtcgaatgcccagccgatgccggaggcgacgaggagtttgcggtgcgccttgttgaagggcagccggtcgaggcgctcgttgcgggtgagctgcgcgggttgcgctgaagtggtggtgctcacgtcgtttcctttctggtaagtggcgtcagatttaatggcgggtcaggtcggtgtaggactcttcgatggccaagctgatgcgttcgacttgttcgcgggtcagcggcttgcggaaggtcatgcgtaatgccgatttggcgatggacggttcgaggcccatcgccagcaacgtggcaggaatctcgtggcgcccgatggcgcaggccgagccggatgaggcagcgatgccgcgcgcgtccaggtcgacgagcagcgcttccccggtgacgccggggaagatgaaggaggcgtgaccgggcagacggcgttcggggtcgccggtcaggtcggcgcgaggcgcgacccggcgaaccgcgtcgatgagcatgtctcgggacgcgaccaactcacggtactgcgcctgcatgcgcgcattcgattcgttgagtccgatggcgagcgccacggcaccggccacgttctgcgtgccagagcgcaggccgcgttcctgcccgcctccggacagcaccggttcgatgggtgtgcggccgcgtaccagcagcgctcccagacctttgggggtgccgaatttgtgtccggatacggacagggcgtccacatcccagtcacgaaaacgaatcggaatctgcccggcggcctgtacggcgtctacatggatgggcacgccgtgcgcgtgggcgatgcggaccagttcctccacgggttccacggtgccgacctcgttgttggccagcatggtggagaccatcgtggtacgttcactggcctcgccgtcgagctcgcgttcaagtgcgtcgagatcgagatgtgcttgcgcatccacgggaatgcgcacgacttcgaaaccgaaccattcgtgcagccatgccgccgattgggccacggccgggtgctcgatagcggaaatgataatgcgcgggcgacaatttgccggctgtttgccatcggcttcggcgaatccgcagaccggccgcaagcccagtttgcgcatgcgcgccatggcgatgcctttgatggccagattgtccgattcggtgccgcctgaggtgaagatcacgtcatccggccgggcgcccaatgccgcggcaaatgatgcgcgagccgcgtccagcgcgcgggccgcggttttgccgggctggtgcacgctggccggattggcgtaggcctcagtcaggaacggggtcatggcctcgatgactgccgggctcactgattcggtggcggcggcgtccaggtacagttcgccgggttcaccggatgcgttgggggtatcggccatgactagttccaatccaatccgaggtcgatgctgcgcacagagtgggtgagcgcgcccacggagatcacgtccacgccggtgacggccacggctggcactcgctccaggctcatgttgccgctggcttccacgatggccttaccgtcgatgagctccacgccgcgacgggtgtcgtcgagcgagaaattgtccagcatgatggtgtccgctccgccggcgagcacggcgggaatctggtcaaggcggtcgacttccacttcgatatgcgtggtgtggcccacctgttcgcgcacgtggcggatcgcgccggccaggtcgatgccgcgcgcggcgagcgccgccagatggttgtccttcatcatgaccgcgtcggacagtccgtaacgatggttgtggccgccgccgcagaccacggcgtatttctcgaacgggcgcaggccgggcgtggttttgcgcgtatcgacgatgcgggtgcgctcgtagcggcgcggccgggtgacgggtccgtcataatcatcgccgtagatggcgttcaccgcgtccacgaaggcggcggtcatggtggcgatgccgctcatgcgctgagtgaagttgagggcgatgcgctcggcggtgagcaggtcgcgtaccgggcctttcacggtggcgagtatctggccgcgctggaatcgctcgccgtccttgatggcggcggtgacggtgacggccgggttctgtgcggcgaaggctgcggcgaacacgtcgatgccgctcatcacgccgttttcgcgcgcggtgaggtgggccgagccggtttcgtccgcggggatggtggtctcgcaggtgatgtcgccgtagggcgcgtcttcggcgagcgccgcttcgacggcgacgcggatgatgtgtgatgtgagcatgggtcagtccttgatgtaggcgacggagtgggcccagttgtcgactggctcgctgtggtcggtgcgggcgtgggcgcctctcgactcggtgcgggcgagcgcggcggtggcggccacatagcctacggtgagcatgttgcggttctccaaagcctcaacgctgcttgcagcaccatcggcgtttacatcagcctgggcgtttgcggcggcgaggccttggccgagttcggcgatggcggttttcagtccggcctcgtcgcgcagcacgccgacgccatgccacatggtgttctggatgcgggtacgattccacaccttgtcggcggcggtatcgtcagcagcagccgtagcggcaggggcggccagcgcgatcggcgcatggtcgaacacggcaccggtggcggagttcaggaacggttcgggtgcccagaccgcgtcgtcaccgtccgcgacggcggccagaccggcgcggcgtccgtagacgagcccctcgagcagcgagttggaggcaagacggttggagcccatgacaccggtacgagcgcattcgccggccgcatacaggccgggaatggaggtccgggcgttcagatcggtgcgaatgcctcccatgtagtagtgcgcggcgggcgccaccggaatcggctccttgctccagtcgaagccaagcgaacgcgtataggcgtcgatggtcgggaatcggtgggccaggaagctggccaggtcggggttctcgcgggccatcggcgagacgtcgagcatcacgggcttgccgccttgcgcctgcatcacgcggaagttctcgcgggccacgacgtcacgcggcgcgagttcggcgcgcggatcgatgtccttcatatacctgtggccatgctcatccagcagcaccgcaccttcgccgcgcacggcttcggagacgaggaagtgctcgcccacggccatggcggtgggatggaactggtagaactccagatcggcgacctgggcaccggcacgccatgcgacggcgaggccgtccgcggtggcgaccggcggattggtggtgtacgggtacatacggcctgctccaccggcggccaagatcacccggtcggcggccagatccttgtcctgcccgtcgatcagcaggtggacgccggcgatgtggccgccccgcacgatgagatctttgaggaaggcgttctcgatgatgtggatgcgcgggttcttgcgcaccatggcggagacgtccagttcaaacactttgccggtggcgtctcccccggcatgcaccacgcgggcgcgcgaatgagccgcttccaggccgcgcagcatgtgtccatgcgcgtcgcggtcgaagtggacgccggccgcggcgaactcgcggacgcgctccgcaccctcacgggtgaggatgtccacggccttcgggtcgcacaggccgtggcccgcggccatggtgtcggcggcatgcagcttcgggtcgtcgtcggagaagatggctgcagcgatgccgccctgcgcatgataggtgtttgattccaccagttcggccttggttaccaaggtcacgtcgtgtccggtgccggccacggccagtgccgcggacagtccggcgacgccggcgcccacgacgacgatttcagtgttgctcattgtgttgctttcctctgtttttgcgtcatctgctcccttcagtccgctacgcggacagctcccctcatgtacgaggggcgtcagggatggatcacgggtgaacgcgcagcatgcgctccagtgccaccttggcttcgcgggcggtgtcttcgtccacggtgatgcgattgaccacgttgccggcttcgaggttctccaaagcccaagccaggtaggccgggtggatgcggtacatcgtggagcaggggcagaccacggggtccaagcagaacacggtcttgtccgggtactgcgcggccagacggttcaccaggttgatttcggtgcccacagcaatggcggatccggcgggcgcgttggcgatctccttgacgatgtacgcggtggagccagtaccgtcggcggcatcgaccacctgcatcgagcactcggggtgcacgatcaccttgacgcccgggtatgccttgcgggcacgttcgacctgttcgacggtgaaacgctggtgcacggagcagaagcccttccacagaatcatcttggcgcgggcgtaatcggccggatcggcggcgccgccctgtgccttgaacggatcccacagcggcatctcgctcagcggaatgcccatcgcgcgggcggtattgcggcccagatgctggtccgggaagaacagcacgcgcttgccgcgggcgaacgcccattccagcacggcgtgcgcattggaagaggtgcatacgatgccgccgttgcgtccgcagaacgccttcagcgcggcggatgagttcatgtaggtgaccggaatgatctgctgcaagccatcggagtccggctgggtgccgcagatctcgccgagctggtcccagcattcctggacctggtcgatgttggccatgtcggccatcgagcagccggcggacaggttgggcagggtcacgctctgttcgggcgtggagaggatgtcggcggtttcggccatgaagtgcacgccgcagaacacgatgtggtcggcgtccgggcgttcggtggcgttcttggccagctggaaggagtcgcccacgaaatcggcgtgcttgatgatctcgtcacgctggtagaagtggcccagaatcaacagtttggagccgagacgctgcttggcgtcggagatgcgctgctgcagttcctcgtcggaggccttgcggtattcgtccggcaacacctgctggcgcggcgcgttggcgggcagacggtcgagcatcgaggcaccgggaccgtagctgggtgtggtggtgtcgaagtgccatgggtcctgggtcagtcctgcatcgcaggtgctttgcgcgcccagcttggcgatgatctcgtcaacggacggcgcagtgaatagtgcggtcatagtggttcctttcctatatacgtctgtgataccggcccgaagcgggtcggcgggaaaaatcagatgcgcgcggatgggatcagcgcgtcgagagcgtcttcacgctcgccttgtctggacagttccacgatgtcgtcaccatcggattcgtggggcgtaccgttctcgacaggtcgtttggggatgtagcggtagacggtggccggtcgttggcggccttcgcgcatcttctccccggtgtcttcaaggtcgcccgaggcaagcattttgcggcggaagttcgccaagtcgaggggttcgccgccaatcgcctcatagacgccgtgcagttggcgcagggtgaacgtggggccgagcagtcgggtggccacgtcggagtattcgattttggagcgcaggcggagcagcgcgtagtcgatgatctggcgatggtcgaacgccagctcgggcagttcgtcttcggggaaccatcgtacgttgtcaccgtcctcgaagcccgcggcctcggtctggccgacgagcgcccagtacacgacggataccatgggcaatccgccatgggaccgggtcgggcctccaaaggtgtacagctgttcgaggtatcgcgggtgcaggtctgtggtcgattcgagggccgcgtaggcagactgttccaacgaccggtcggagcgcaggtcaccgccgggcaacgcccagcagcccaggaacggctgacggacgcgcttgaccaggggcaaccagagacaggaatgggccgagttcgcggcgttgccggaatcggcggcactgttgccggtatcgccttccgggccgagtgccagaatcaccactgacacgccgacctgtggcggtgcgctgcggcgctcggacacattgccgaatcccatgccatgcctctttccataccggttgttctccctgcattgagagcatagcactacttatagtcacaatgaccataaatcacatatcggatggtctagcgcacgaatattggtcaggcagcgggccccaatcgctacgaaatcacgtccgtatcttccgatttcgactgtgtcatttcggcgacggacgggaggaatggcgctagggagggtagttcgtcgagactcttcagacccatttggtcgaggaagaattcggaggtgaccaagagggccgcgcgggattcggggtccacgccgtcttccttgataaggccgcgtaccgtgagcgagcgaatcactccatcggagttgacaccgcggatcgcggccacttgggctcgggtgacgggttggcgataggccacgatggcaagcgcctccagtgcggcctgactgagtctcgcagtctggccgtcggtgacgaatgatgagacgaccggctcgaacgcggcgcgactggcgaactgccagccacgagcggtgcggcgcagttcgaagccgcgcgggcggatgtcacgggattcatcgccctcatagtcatcgtgcagggctcgcaatgcctcttcgactgtgttgcgatccaatgccaaaatacgggccagctcggtggcggtctgcggctggtcggcgaccatcagaatcgcttccagacaggcgggcagcccgccgggaaaatcgtctaccgcgaaatccacgtattcggggtgcgtctcctccactcccctcaccgcggcctttgcggattcagccgtcgattcggcatccgccatgtgttcggttgtattcgttgcgtcaatctgttcagtcaccaatcgccgtccttacgcaaaatcaccttcggaaatgttcacgtcgctcatcgtttcggctacgccgggtacccacctcaggtgcagttcggcaaacggaccatcttgctgatactgcagcacaccttgtttgaagaacacgagcacggccatgaaccgagccaccacctcaatacgagaagtgcagtcccgggtcaattcgctgaacgatatcgactggtcgcccttggattccaatgccgcgatcagccggtcgcgcaccaccagcgattgggcccgcagatcgaccaacggcacgtgcagctgatggatcgacacttcggaggcgggcgcgttggcgatgacctgggcggtcagtcgggcgagttcgagcggagtcagcgtccataccagctcaggcagcatggcggcaacgccctcgtccatggccgccgggtgcgggaatcggccggagttggcggcgatacgcgcccggaagtcacctgcggcctgcttgtaggcgcggtattggaggagtcgggcgaacagcaaatcgcgttcgcgcagcacttcgaggctctgctcgtcgtgctggctgtcttcgccgccgggcagaatcgccacgcttttggcctcgaccagaatagaggcgatatcgagaaaggcgctggcctcatccatgttttttgtgaaatcgagcccgcgcacgtatgtcaggaattcctcggtgatcgaggagagggaaacttcggtcagctcgagtctgttgttggcgatcatgccgagcaaggcatcaaacggaccggaatagacttcgaggttgacccggaagccggaagtggcggattcctccgtgctgatttcggcttccgcggagctcccctcagcctcgctacgcgagccagcttccctcagagaggggagccgagaaagggaagtctcattcatcgtttatcgaaacaatcgttacgccacgatgccgcgagcaatgagctcacgtgccacctcacggtattcctttgatgtcttgtgctcaggggcatagaccaccacgggcgcggcggcaaccgtggaatcgggcagtttgatggagcgggagatgaacgtgtggaacaccttttcgctgaacgcctcgtaaacgcgctggcagacctcttcgcagtgcagtgtcttggtgtacatggtgatgagcacgccatccacttccaatgcgggattgatgcgggactgcactttttcgatggactgcataagcagggccacaccgcgcaaggcgaagaattcggcggccacgggaatgatcacgccatcagctgcggcaagcgcgttcacggtgagcaggccgagcgatggctggcagtcgacgatgatgagatcgtattccgacttgagcttgcgcagcacgctgttcaggatctgctctcggcccacttcggtgaccagctggacctcggcggcggacaaatcgatgttcgccggaatcacatcgatgttctcgaatgcggtgtgctgcaccacatcatgtgggtccacggaaatatcgaacagcgcggtgtaaatcgtgttctccacggtattcgcgttgacgcccagtcccacagtggcggcaccctgcggatcgaaatcgacgataagcacgcggcggccatactgggccaacgcaccggcaatattgatggagctggtggtcttacctacgccacccttctggttgcacatggcaatgacacgcgccggaccgtgctgttgcagcggttcgggtgcggggaaggtttcgtattcacgtccaagcaaatcggtaggcatactgtctaccttatcaacatccgggttcgctgggggtgcaacgacatacgttcctgtcataggcagcgttccttgacggaatgcgctgtctttatcgcgggtatctcgccagtcgtccatcgttgccctcgccccctttgtcgggaatacctgctcgcccatcctaatgtactcgccgggctcgcctcggaacaccgttttgccgctggtattccagtgttccgaggtttatggatctcgtctcgtactatgtcgatgcgcttactcggtgcgcagtgcggtggccgggtcttgcttggctgccttacgcgagggaatcaggccgccgatcagcgtgagcaccacgcttaggatcaccagcaccacgccaccggtcaccggcagggcggcattgacgtccgcattgccgatgaagtggtgtagcacggcgttgatcggaatattgagcagcacggtcaagcccacgcccaacaggccggagcataggccgatgatgccggtctccgcattgaacacctgggatacgttgtgcttcgaggcacccattgcgcgtaggatgccgatttccttggtgcgctccagcaccgaaatgtaggtgatgatgccgatcatgatcgaggagacgatcagcgagacggacacgaacgcgataagcacgtaggaaatcacgttgacgatggtggtcaccgaactcatcatgagcccaacgtaatccgtgtaggtgatcttgtctttcttcgagacggtgttgttgtagtcggtgatcgcgtcggcgatgtggtccttgtcttcgaagctgtcggcgtagatgttgatcgagctgggcgcgtcacgactcaccacaccgaatgcggcgaggttgtcgtcgtaggtgccggtcgacacgtactggtcgtagatcgcgacaagcacgtcgttcgaagccgtggcgatatacgcgtcgaaactgtcggcgagctgctgttcgctcatcgcggccatggcggcggcctgatcgccggcacccgccgcgccagcgacacctgcagcaccagcaccagcggcgtccgatgtgcccgtgccggactgctgcccggcgctcatcatcgacttggccatgttcgccttctgcgtcacgcccagcgaagccacgtaggtgcgcgcgtcggccaccttggtggcatcgtccgagggcgagaacgtcatgccgttgagcacgttcgtgttcgggttggccttctgatcggtaacgatggcgctggaggccgcacggtcgatcaaatcattggtcagagcgcgcgcgtaccccacaccagcggccaacggcgtggccgaagcatccttcttcgccttgacgacgcccaccaccttgagtttggtggccgtttcgaggcgctgttcgatttcgtccttgtcgttgccgatgaaacggtagtggccgtcatcgcccttgacgtactggtcggatgccggaatcatgtacagcgtctgatcgagggccttagcatagtcgatcttgtcttgtggagtgctgaccttgtcgccggcgttgagcttggacatcatctcgtggtaatcggaggcgggcagcaggccgagctcgtacagcgtggtcagcggcacgctgttgttgtcgtcaagcaccagcaccacttcatccttggacttcggccatgaaccgttgaccacctggtagttgtcggtgataaccttgcctacgagcttgctgtcgtccgctcccggcatgatctcgttgaacgagtcgggcgcggcgttctcatcggttttgccggtcagcatcgacatctgctgcgaggtgatcgacgaggtgccggacatgccggacgagcttgtggacgccatctgcgaggccatcgaggcagagtcgctggatccgatcgtcacgccgtccgcattgaccagcgtgccgtcggggtcgtggtcgaacacggagaatttcacgtcatatgtgtactggatgccggtggaacccacatactggtgaatctcgctcttggaattatccaggtatttcttgaagcgggtcaggttgttttcggtaatcgaactggtcaggctggacgcctgcttgacgctgcggtcgtccgggtagatgccgtcggttttgtgcgtcttgccgccgtatccgccatcgccgcccatctgtccgcccatcatgctgctcaggtcgaaggtctgggagtcgacggtgatcgggtaggcggtcatcgtgtcacgctggatgtcactgatgtatgtgttcacgccagtcgacaccgatagaatcagcgcgatgccgatgatgccgatcgagccggcgaacgaggtcagcagggtgcgcgccttcttggttttcagattgttgaagctcaacgccagcgacgtggcgaacgacatcgacgcgcggcccatcgtcttgtacacggccggctgttcggccgtctcatccacgacaaacgggtcggagtcggagcggatcacgccgtcgcgcaggttgacgatgcgcgtggcatattgttccgcaagttcggggttgtgggtgaccatgaccacgaggcggtccttggccacgtccttgagcaggttcatgatctgcacggacgtgtccgaatcgagcgcgccggtcggctcgtcggccaggacgatgtccgggtcgttgaccagtgcgcgggcgatcgccacgcgctgcatctggccgccggacagctggtttggcttcttgttgatgtgttcgccgagtccgaccttctccagcgccttgcgcgcacgttcgcgacggtcggccttgccgatgccggaaatcgtcagcgcgagttcgacattcgacagaatcgtctggtgagggatcagattgtagctctggaacacgaagccgatggtgtggttgcggtacgaatcccaatcgcgatccttgtattggcgcgtcgagatgccgttgatcaccaaatcgccgtcgtcataccggtcgaggccgccgatgatgttgagcaaggtggtcttgccggaacccgagggacccagaatcgcgacgaattcgctgtcgcgtaggttcaggctgactttgtcaagcgcctgctgaacgaaatcaccggttttatagcgcttcgagatcgatttgatctgcagcatgaatacctcttcctggctgacggttcgctgttatgtactgtattgtcacgccttgaatttccggccgactttggtgctcccccgccgcgattccgctatgggcggacgcgtcgcaaaatggtgtgtctcaccgcgctctgggatgtgaggtcagatacgtttcgatcagggtttcagggcttacgtgcgtgtagatctgcgtggtggtcacgctggcgtgcccgagcagttcctgcacggtgcgcacgtccgcgccgccttggatcaggtgcgtggcaaaggaatggcgcaaggtgtgcggatggagtggtttggtgatgccggcccgctccccggttgctttgacgatttcccataccgattgccgcgagatgcgcttgccgcgtttgttgagaaacagtgcgcgcctctcgggaatcttggcgctggagcgctgttccaactcgccacgccccgcattgaggtatgcggtgatggcccggcatgcgtaactgcccaatggcacaagccgctgcttggagcccttgcccatgagtcgcgcgatgtgctcgtccaggtcgatgtcgtccagattcgcaccggtggcttccgagacgcggcagccggtggcgtacatgaattcgagcagggccttgtcccgtaataccaccggatcggttgagccgccggctgccgccgcgtcgagcagacgggttacctcgtccacggtgagtacgtcaggcagggtgctggcacctttgggtgccttgactgcggcagaaacgtcggcagtcaccgcgtgctggccgagcgcgaagcgatggaattcatggatcgaggccagtcttcgggctttggagcgggcggactcccccgcctggtcaagggcggcgatgtagtcttcgacgtcttgtttggttatggcgtccggttcgtggatgccgcgggtttcgagccaatcaatgtatttggcgatatcggattcgtaggcggtgacggtggccgtggcgagccctcgctccacgccgatgtggacgaggaactgctcggtgagtctggtgaatccgttggtcatagtgcccatggtacaaagaaaccccgctcggaagcggggtttctagtgtgaagtcacgacttcaagcaatcaggcctcaaccggagcgttgacgtcctcaggcagggcggccttggcggcgtccacgatggtcttgaaggtgtccgggtcggagacggcgatctcagccagagcgcgacgatccagctcgatgccggcgagacgcaggccctggatgaagcggttgtaggtgatgccctcagcgcggacggcagcattgatgcgctggatccacagcttgcggaagtcgcccttgcgagccttgcggtcacggaagttgtagttaaaggagtgcagcagctgttccttggccttgcggtacaggcgggagcgctggccacggtagccggaagccctctcgagaacaacgcgacgcttcttgtgggcgttcactgcgcgcttgacacgtgccataatctattcctcagctttctaaagtcttgttatttccgggtaagccctatgctcacttctgcagaagctggtgcagcttcttggcctggccgccgcgcagcacatcgtcggcggacagttcacggcgcttgcgagcggacttgtgctcgaggttgtggcgcatggcggaaccgacatgcttcaccttgccggtgccggtgatcttggcgcgcttggaagcggcggaattagttttcatcttcggcattgctgccctccttgctggtttgcttcttgtcggaagtcttctgagaaatcgcggactgcgcgtcggccgcggcctgagcctgagactcctgcttggccgcgagacgagccgcctggcgagcctgacgctcggcgcgggactcggcgccacgacgacgctgctcggactgggtgtgcaccttcttgcccttcggcgcaagggtcatgatgatgttgcggccctcctgcttcggcttggactcgacggtgccgtattcctcgacatcgtcggccagacgctgcagcagttccacgccaccaatcgggcgggagatctcacgaccgcgcaacatgatggtgaccttgaccttgtcgcctccgttaaggaagcgggtcacatggcccttcttcacgtcgaaatcgtggtcgtcaatcttcaggcggaaacgaatctccttgatttccgcggtgctctggttgcggcgagcttcacgagccttgatcttctcgttgtacttgaacttgccgtaatcaatgagcttggcgaccggaggcttcgcgttcggggccacctcgacgagatcgaggtttgcctccttggccaggttcagcgcgacggaagtcgcgatgacgcccacctgctcgcccttcgggccgatcaggcgtacctgcgggacgcgaatctcgtcgttaatacgtggttcgtcgctgatgatgactccaatcctctacttcaattccgtggcgagggcctttgctggagtcctgttcaatgctttgggttcatggcaagccaaagcccgcgccaatatgcgctcagcttctgcagacgcatatcagttctttgcgtcattcctgattacgcgttgtatatcgcaatcgctaggctgtttgccttgaacccgaggccttgaaaggcttccaggtggggttgccccgctttcttgatttctcaagccaaatagaaagtctaccatacgcccggacattcgcggtccgtgtgtcgaacctactgcacggcgcgcagcagaccgccgaagccttcgtctttgagaatctgccgatatgggccggcctcatcggcgatgatttgatcgatggcatgcatgccgagtacttcgaccggcgccttgtcgtcggtgagaatagtcgacgctgagtccggttcgttcaccttccggaatcgagaggcgacctcttccatataccattcgagatcttcgctgccggtgcgctcgtaggtggtctcacgcaggttgagcgccttggaggcctgctgcatggagttctcttcggagccggaacccggcttcttggcgaacagttcacggttcgtggtgttcggcacgtcggccgtcagtgtgttcccattgccgaacacgctggcgatggtatcgctcaacgcctcgttgatcgaaccttggccgtccgagatcatgttcatgttcaccaccatcacgccgccggggttcaggtgctctctgaccatggtgaagaactcggtggagctcatctggaagggaatggtgatgtcctgatacgcatcgaccatgatcacgtcgtacttgtcatgcgaggcggcgagccaggctcggccgtcatacgtggtcacggggatgtcggcgggctcatcgaagtattcgccggccagatcggtgatcttctggtcaatctccacgccggtgatgttcattttcggataatactgcttcagctggcgggcgtaggtgccggtgcccatgccgaggatcagcgcggaattggcattgtcggcgagcgccggcgcagccagggccgtgtcgtagtacatacctgtcagtcctttgtctttcatcgtgacggactgcacgccgaacagcacgttggtggacaggatcgtgcggtcggagaggttcttgacctgcaggtagttgtagatggactcgccctcataggccaggttggtttcccagaacgcgaagccggtcaggggcgagacacaggacgtggccacgaagatcacggcgctgaccacgcaggcgatgcgcttggccttgatcgagatgaagtagatcagcggacatgccggagaagaattcggtgatgtagaggaatatctttgatttgagaatcggccgttcgcttgcctcggtgatctgtgccatcgctccgctcccctgcctgtgcgcctatcgactactgttctgatgcgtagcctatcagcattttcccggccgatgggtggataccggctacagtaggcatcatgactcaggtatgcgtgatttttggtgcgggcgaatactatgcgggcacgcccgtggtgccggccggcgcgtatgtgattgcggccgatggcgggctcgaccatacgcgccagttgggtatcgtgcccgatgtggtggtgggcgacttcgattcgctggagggccggccgccccgcaccgatgtgcgcaccatcgcgctgcccgcgctgaaggacgatccggacatgctctccgcgctgaaggtcggttggtcggcgggttgccgcgaattccatgtctatggcggtttgggcggccgcattgaccatacgatttccggcattcaactgatggcattattggcccggcatggggcaagcgggtatctgtatggtgatgggctcatcgtcacggccatcaccgatggtaggctttcgttccccgcgcatccggtgcccgaggacggccgcatggtgtctgcgttctcccactccgatgtttcgcttggcgtgaacgagccggggctgaaatatgagcttaaagacggcacgctgaccaatacggtggtgcaggggtcagcaacgagttccgcgacggcgtggacgcggccatcagcgtggagcacggcacactgatcgtcaccttccccatcgaggtggcgttgcctcaggtgagtcgattccacgaatttggcggcgatatcggcgagctggacaccgcagtgtccaagctgctggttcgctgacttgcatgccgcgcgcttgctcatgatgattcgagacattcctccaaaggagaggaaaaatcacatgtcggttgcgggcaatccgaattgtgagcgctcacagaaaatacggcatttttgcccaaaacgcacgctgaaacgttgccatgtgtacagagtcggcattacagtagcaactgttggtaaacaatggcccggtgtgccaaagcgcgccaaggccaccctacaagggagaattacatgacagttaagattggtatcaacggcttcggtcgcattggtcgtctcgccttccgtcgcatcttcgagctgcaggctcgcggcggccaggctggtgacattgaagttgccgccatcaacgatctgaccaccccggctaccctggcttacctgctgaagtacgacagcacccacggcaccttccgtcatgacgatggcactccggttgacgtcaaggccaccgaagactccatcatcgtcgacggcaaggaatacaaggtctacgccgagaaggacgccaacaacattccgtgggtcaagaacgacggtgttgagtacgtgctcgagtgcaccggcttctacacctccgccgagaagtcccaggctcacatcaacgctggcgccaagaaggtcctgatctccgccccggccaaggatgacaccaccccgaccgttgtgttcggcgtgaaccacgacatcctcaaggcttccgacgtgatcgtctccgccggttcctgcaccaccaactccatggccgccatggtcaagctgctggacgagaagttcggcatcaaggccggcttcatgaccaccatccacgcctacaccggcactcagatgctgctcgatggcccgcgtggcaccaagaccggccgcaacctgcgcgccgccgccatcaacaccatcgcccactccaccggcgctgccaaggccatcggcaaggtcgttccgtccgtgaacggcaagctgcagggccacgcccagcgcgtccaggttccggacggctccgtcaccgagctgaccaccgttctgaacaccgagaccaccgccgacgagatcaacgccgccttcaaggctgccttctccgacaccgattactacggctacaacgatgagggcatcgtctcctccgacatcctcggcgacacccacggtggcgtgttcgacccgacccagaccgacgtcaacaccattgatggcgtgaccctggctcgcaccgtgtccttctacgacaacgagtacggcttcacctccaacatgatccgtaccctgctgtacttcgctgagatctccgagtgaaccattgcggtctaggccgctacggttcgtttgagaactaagctgtgagacccccgccttgtgcgggggtttcttcgtagtagaacggtaatcatggcaaagaaaagcaagcatgataagggcgcgggttccactccggcgacagtccaactggagaaggcgggcgtggaattccacgtatacgaatacgagcactccaacgaccatatggatgacggctacggcgtggaggcggccaccaagctcggcttcgacgagcatcaggtgttcaagacgttgatggcggacaccggtgccgaacgcgtggtgggcgtggtaccggtgagcggtcatatggatttgaaagccttggctgcagccgtaggtgccaagaaggcctctatggccgatcccaaggtggcgatgcgtgaatccggttatgtggttggcggcatctcgccgttaggccagaagacacgtcataagactgtgttggatgaaagcgccctgcaattcgaccaaattctggtctccggcggcaagcgaggcctgtctgtgggcgtgaatccacaggacctgctcaaggtcttgaacgccgttgccgcaccaatcggcacgtggtgaccgttcttggctcccctcacggaggggagccaagaatgactacttcttcctgcgcaactccgccggcagcacaaagtgcatgttttctttgatggtttcgacggacttcataccggtgaaacccaagttttgcagagcgtcaatcacaccggacaccagttcgtccggtacggaggcacccgaggagatacctacggattccagacccacgaaccatgccgggtcaagctcgctggcatcatccacgcgatacgctttgccgcgctcccccaagccctcctgcgccacctccatcagtcgcacggaattcgaggagttggccgatccgacaatcaccacgcaatcggactgctgggccaccagtttgaccgcagcctgacgattcgacgtggcatagcagatatccgaactcggcggctcttgaatccaagggaatttggccttcagcgcggcaatggtatcggcggtctcgtccacgctcaacgtggtctgcgagagcagcaccagcttggtgtcgggcgcaaaatccagcgaatcgacatccgattcatgctcgatcaagtgcacgtgttcggggctctcccccactacaccgaccgcttcatcgtgacctttatgcccgatatagacgatttcatacccctcgcgcacgaaacgcagcacctcacggtgcaccttacccaccagagggcaggtggcatccaccacatgcatgccacgacgttcggcttccgccttcactaccggagatacgccatgggcggaaaacaccaccggaatacccgcttgggcagcagcatccggaatctccgccaattcctggacgaacaccgcgccttgcccggccaagtcctcgaccacatgcttgttgtgcacgatctgccggcgcacatataccgggggcagcccatcctcgcgcgtccgctttccggaagcctccgcggctttgagaatggtctgtacggtaagaatcgcacggtccacacccgcgcagaagcctcgcggatcagcgagcacaacgcttttggtcatcggaacctcctgaacgtcaatagtgttttccagtgtaaggcagggattacaggaatctgccgtcacaacttttccgcgtctcccacaaatcaccggtttccaaggaatccacgtgcttctcgcatgatggtgtgagactcgtcactccacgtattgctaccgtgtttatacgaattgtttattatatgccgcatatcgccaatccccgcctcgatagaggagacgcgctagactggggccagcgatagcaggagctaccggcccaccaacctcactacgggagtgattccatgacgagtaaaacaccacgcaccggaaatcagtattcgattcactatggcgattattccgccgtcatctgcgaactcggcgccaagattcgccgattcgattatcaaggcaaggaaattttctgcccgttcggcgtcaacgacctgacccccacctgtaacggttatgtgctggccccgtggccaaaccgcatcgaaaacggcgaatacgatttcaatggcaagcattactgcgcgccggttaacgaatatcatcccgcaccgcgcaacaatgcgaaccacggatacgcctaccactacatgtggaagcttgaatcgttgaccgatagcgccgtgacgctttcgctgcgcttccccaacttggacggatacccgttcgatgtgaccgtgaccgtcacctacgaactcggcgacaacggcatgaccgcgaccgtcaatgcccgcaatgatggcgacgaaccggcaccgtgggctctcggcctgcatccgtggctggccaacggcaagcagggcgcaactgccgccgaacgcgatgccgactccgccgcctgccacctgcagattaaggccgccagtcatgtgacggtgaacgaggcgctgattcccaccggcaccgaaccggttaccggtatctacgacctgaacgatggcccgacgctcgaaggccgagcctttgatgatgcctgggttgacgtggagcgtgccgccgatggtacgaccaccaccacattcacccgcccggacggtatcgaagtgaaaatcattggcgatgagacgattaatgcttggcagtgctacaccgccactggcgcaccgttcgccgagcatccgtatggcatcgccgtcgagccgatgaccgccccggccaatgccttccgcactggtgaccacttggtgacgctcgcccccaacggcgactacaccactgtggtccgctacgaagtagtccagaagtagttctgttacgctggctcccctccagaggggagccaattttttatccttatgtgccgccgcgtcttgggacttatgcgatacgattgtgagcgataacaatttgttccacaaaggagtgtgcactatggctttgaagcctcgcactggtaaccaatatgtcatctcgtccggcgaatggagtgccgtcgtcaccgaactgggtgccagcctgcgcgagctgaagtggcgcggcgaagacctcatcgtccccttcgacccgaacaaggtcattccctgctgcaacggctgggtgctggcaccgtacccgaaccgagtgaccaatggtcagtattctttcgatggcgaagactaccagatgccgatcgacgagttcgaccgccaatcctccctgcacggctatgcctaccgctacatgtgggagctcgttgatttgcaggaatcacacgtgacgctctcctggcgctcccccgacatcgccggctacccgtttgatatcaccatcaccgccacttatgcacttgacgagaacggtctcacggaaaccttcaccgtgcacaacaacgacagcgtgaaggcaccgtgggcatttggcatccacccgtggctggccaacggcaagcacgccaccggtcaggccattaccgccgacaacgagccctgccgtcttgagctgcactgcgacacccacgtgaccgtagacgaacacctgctgcccaccggcgaagagccggtttccggcatcttcgacctgcgcgataaccccacgctggagggacgtggcttcgacgatgcctggaccgatatcaccaaccgcggtgaagatggcagcacttccgccgcgttcacccgccccgacggcatcaaggtcacgctgaccggcgacaagaccatcaactcctggcaggtgtgcaccggcaacgaaatcggcgagaaggctcgtcaggccggcgtggccgtcgaaccgatgaccgcctacgccgacgccttccgcaccggcaaggatctggttgtgctcgagccgggcgatgactacaccaccgtggtcaccttccacgccgaacaaatctgaaaaaccgaataaccaagcctgacgatcatcgccacatggacacacgtgttgcatcacgtcgtacttatgtggcataattccgaaggcttatttttttactgcagcaaaggagtccatcatgggcatgcgcggacgtaagcgcaaggatcgtcgtaagaaggccgccaaccacggcaagcgtcctaacgcctgattcttcgcgtttcttatagaacgctcaaggcccgtctgatgatacatcagacgggccttgttgtatatgtcgttacttatcttccccgcagcagtgatcaagcgtggccttgagccgggccatcagacattcgggcgccacatccgggcgcaagtaggcacgcaacgcggcaatcaacgcctgttcacgctcgtcgcagcaggtacgggggtcaaaacagtcgccctccgtaacgatatgcacgtctgtctggaccgacgcagcggccgagccggtatctactgaacgatgatgcaccgccgtgatatgcacttcggtctggcttaccgtgccatcggccgccgtacgggttatggagatatggcgagtacgctctaccggctgatcgttcatcagatctcctttcccgaaagcttgcttgactgttgtggcgtgcgggcgccagtcgcatgactatgtctcactacggcttgcgtgtcgccattgctaccaacagtttgttcactactttcattatggccggaatcggcgattcgaccaacgttttcgctcaacttcgcggatggtgaaccagccgacgaaccagtcacgtacccgcgctctttcgcatacgaggcgagctcacgcttgagttgcgtgcgggcgcgattcaggcggctcattaccgtgccgattttcacgccctgctcatcggccacctgctggtaggacttgccgtcgatggcggcgtcgatgaacacctgccggcgttccggcgagagtttggcgagcgcggccatgatttcctcgggcgcgaaggcgtccaaatattcctcttcagcggacttgagcccgtccgacgtatgttcggcggcatcgtaaatgtcccaatcgtcgtattcgccagtggagtcgttggcacgctgcgggcgccgcttggccttggcatactggttgaagtaggcattgcgctcgatggtggtcatccacgcctcgaagttggagcccggctgaaatgagtcgaaggccttgaacccgcgttcgaaggtgtcctggaccagatcctgcgcgtcatcgggattgttggtcagcctcatcgcctgccggtacagtgcattgacggcgggcatggcgagctgctcgaatctggcgcgcttggctgccatggactcgcccgatccggctgactgcccggattgcgtagttgcttcgcttgtcgtcacggttcaccattctaatcaaatcatgtgcccatatcgtggtcgatgacgtgtgagccacaacacgctgcaccccacctgtagaatggcgtatcggctagataatagggagaaacaattatggctttgactttggcttcggccgctgacctgctcaaggaacaccatctgctgcgtgaaatcatccaaggggatgtctggaccgacgacccggcccgtatcgcttcggcggatgaaccgttcgccggcatcacctacgacacccgcaaggtcacgcagggcaccctgctgtgctgcaagggccgattcaaggccgagtatctgaacggcatcgacgaagccggcctggccgcatacgtggccgaaaccgagtactcagccgcaaccgccgcccccggcctgatcgtcaacgacgcacgcaaggcgatgagcctgctgtccgccgcgttctacggatatccgcagaacgagctcacggtcatcggcgtcaccggcaccaagggcaagacgaccacctcgtacttcacgcaggcgcttatcaacgccgtctccggtggcaaggccgcattgttctcctcggtcgataattgccttgacggccacacctacgtcgagtccgatctgaccacgcccgaatcgatggacgccttccgcatgatgcgcgaggcggccgataacggcatggagtatctggtgatggaggtctcctcccaggcgtacaaggtggaccgcgtctatggcctgactttcgatgtggccgcgttcctgaacatctcccccgaccacatcagcccgatcgaacaccccacgttcgaggattacctgtattgcaagcgccagatcatcgccaacgcgaagtcgctggtactcggcgcggacagtctgcacgccgatctgttgcgggaggacgcggcggcagccggcatcggcgcaaccaccttcgccctgcatgacgcggataatgccggcaccagtgcggacgtcgtcgcctggcccgccgacacggcgcacgcctccttccacatcgccgacggagatcagacccttggcgactaccatctgtccatcgatggcgacttcaactacctcaatgcggcggcggccatcgccatcgcccatgcggctggcgtatcgctcgatgacgccgacgcactgcacgccatcgaatccgtacgtatcgccggccgtatggaacagttccgcgacccgcagtcgaacacgctcgccatcgtcgattatgcgcacaactacgcatccgtcaccgcgctgcttgacttcgtctacgagcgttggggcgaggaaaacccgcgtatcacgctggtgaccggatcggccggcaacaaggcctacgatcgccgtaaggaaatcgtcgaggctgccgagaaccgcatcgcgaacttcattttcaccgccgaagatacggacaccgagccgttcatcgacatctgcatggaaatgcaaggctacatcacgaacaaggatgtggcctccacggtgatttccgaccgtccgacggccatcaccaacgccatttacgatgcccgtgcgcacgccgaccgattcaacatcctgctgattatcggcaagggcaacgagcgttggatcaaggaccatcacaagcatgtgccgttcgacggcgacgatcacgtcgtcgaacgcatgtttggcttgtgacgggattccagccaatcagatcctgatcggatcccgattggcccacatcagatcacgcgcaatacgaccaaaccagaaacacgacatacggatacgaacgaaaaaggatagctgaatcgtaatgatcacgttggagaaagttgacggagccacactggaagccgaagccgagaaggccggcatcacattgcccatcgaacagaccaaggtttggtctggttttcaggcggatatcgacggacgcacgccatggggcgattatctgatcaagcgtgatggtgaattggtcgccgtgatctcctttatcgattttgagacgcacggttatcattatctgcgctcgatgcatgggccggcgtgggctgccaagcccaccgaagctgaggagcgcgaggtcgtcgacgccatcgtggacaccgtcaagaaggccgacaagaacatcgcgttcctgcgtatcgacacctggttcgccgatggtacggagaaggtgctctccacagtgccgtacgaccagaccgtggtcatcgacgtcaccggtggcgatgatgagattctggctcggatgaagcgtcgtggacgccgtgacgtgcgcaagtctctgcgtgagtgcccggccgaggttgccgatgagacggataaggcgctggccgatttctccgaatattacgatgtgatggtcgagaccggccagcgcgatggattcacgcctgctccgatgagcgactactccgatatgatcggcgcgttgggtgccgatcattgccgtgtgttcgccgcacgtattgaagaccgtgtggtggcatggtcgattgtcaccgtgaatggcacacatgcggtgcgctactatgccggcatgcgcaacgaggttatgcgtctgcatgtgaccgacaagctgctgtattccgaatgctgcatcctgggctcgcagggtattactgaatacgatctcatgggcatcggctccgatttcgcgccgtctctcaagggccttaacgagttcaaatgcaagttcaccgaggaaatcaccccggtggcccccgcccgcgacgtacccatcaagaaggtcttctacaagacgctgcagactgtacagggcgtgcgcaaggcattgcgctaataccgccccgctcccgctggcgggagctgtcgaacgaagcgagactgagggcggtctttcgatatggaccgccctctgtcacctgtggcaccagttcctgtcagcgggaaccattcgtttatcgttcgagtttttgactcaccacggctgttacgccgtcggctctcatggttacgccgtaaagcgcgtcggcaatcgacatggtgcgttgctggtgcgtaatgatgatgagctgcgcatgggcgcgtaactcattgaacgcattaatcaaacgggtcaggttcacgtcgtccaacgcggcctcgacctcgtccatcacatagaacgggctggggcgggcggtgaaaatcgcgaacagcagcgccagcgcggtcagcgaacgttcgccgccggacaggaggctcagctgtttgacgcgcttgccggccgggctggcctcgaccagtacgccggtggtgagcatgtcttccgggttttccaggcgcagtcgcccggtgccgcctgggaacagcgtggcgaacatctgctcgaacgcctcggcggtatcgtcgaacgcggatttgaacacctggaccatcgtggaatcgagatccttgatgagctgcatcaaatcgtcacgtgatttgaccacatcgttgcgctgatcattgagatacttgttccgctcctcaagcgcttcgaattcctcggtggccaaagggttgatcttgccgagtgcggccagatcgcggcgagccttatcgagacgcttcttctgctcctgacggttatacggcacggtcttaaagagggcggaatcgccgttggtgccggcctctcccccggtttctccctcttcggtcccagcctcagcttccgtctcatccaacggcacagggttgccctcatcatccagcacgggcaccggctgttcggggccgtaatcaccaaccaattcctccaaagtgagaccgagttcgtcggacactttctgcatgagctgcccggattcggcggccaaccgttcgcggtttacatccaaggcatgttcgcgcccggtcagatcggtgaccttgggctcgatctggttgcgctgcgcgcgcagggccttgagttcctcgtcatggctggaggcggcggcctgcagctcgtctcgtttggcggccacgtcatgcagcgtatgctctaccatggcggccactgctcgcgcgtcatcggccacgccttgcaggtgtgcggcctgctcgcgtctgcgatcgttcaacgcctcgatgcgggcgcggcgttcggcggcttctttggcgttgtcccgcagcagcccggcctgtcggctcagggactcccctttgcggcttgcctcggtccacgcgattttcgcggcgacctcatgctcgcgagtcaggttcagtccgcgctccagcgtacgttcgcgttcatcgagttcgtcgaaatcggcatgttccgctgtggattgccgggccgatgccaaagcgcgattgaggtcgtcaagcttgagctgatgctcgttgcaattctcttgggtctcggtgattttcctatccagctgctcgagctgacgggtgaacgatgcgacgcgatctgtggcggatttcagagatttctccgcctgctgggctttgagccgggcttcggtgcgtttggcggattcctggtcgacgagtcgagccgcttcatcgcgcttggttttggcctcggccacttgctcagccattccgccgtcttgggcggtcaactgtttgacctgtgccaatgctttgtctcggcgggcggccagagacaggtccgattgagagattgaagagccgccgaccgccgccacgccgtgtgtgaaggtctcgccgttcttggtgacggcccgcatggcttcgccgaatgccacaatctgttgggcttcgtcggcggtgccggccgcggctacatcagccagcaggagacgcacggtgcgcacgaccgcttcggcctgtgccgggttctcggcatccgggttcgcggtgacgagtgctgccagcgcgttgcccgattgcggagcggcccccgcgttctcggcgctactctcctccgactccgtgcccggctctgtggcgggatcgccggcaatgctcgcggtcagcaccacggctttgccgagcttatcttcccgagcgcgttcgagggcgtgcaacatgttgcctgccgcgggtaccacgatggcgctggcatactggtcgagcgcgtgggccacggcttctccccagccttcggccacatggatgaagtcggtgagtcggccaagcgaggccacgtccgtatcgcgctccaacgatccggaggcattgcggctgtctagcgtgtcggcaagcgcatcggccttggatttgagcgagatgatcttggactgtatctcgcgctgcttatcggcgcgttcattcagtcgttcgcggcattcggcgagcgttgcacgtgcggcgtccaatgcggcaccgtcatcgtcggcaatggagtccgcttcgctgcgcaatgcgtccagctgttgctgggcatcgtcgcgctgggaagtcagcgagtcgcgttgggaggcgtaatccttggcgcggctggtcgccagttgtacggcggattcctcgcgggcgatgagttcgcgcagtcgggcgatttgcgcatcgcgttcctgtgcggttttgcgcagttccgtcaaggtctggcggactgaggcaagctttttctcgtcgtcggcgcgttcctcggtggccttgtcgagtgcgatgcgcgcatcggccacggccttggtttgtgccgctgcctgagactccagttcctcggctcgtttgacaagcatgccgggatcctcaccgaagttggtgacgatctggccggcgagtgaccggctgcgctcttcggccaactgggcgagcgcgttcagtcgttcacgggtctgcgagaattcatgccagtattggttggccttggcgatggccggactggattcggagctcaacgcctcgacctgttcgatgcgtactttgacttgggcgagttcacgttgggcgacggccagctggttacgcacagcgccaagctcttgacgtaccgtgtcgcgacggctcatcgagcgttgagcgtcttcggcgtacaggcgggcttgggcgtcgcgtacggatatctgaatcgcgtcggcgcgccgggagatacgtgcctggcgtccgagggggccgagttggcggtgaatctcccccagcaaatcgtctagtcggctcaggttcgtttcggtattggccagcttgcgcaacgcgcgttccttgcgcttgcggtgcttcaggatgccggcggcctcttcgatgaacgcacggtggccggacgggtcggccttcagaatcgcatccaatcgtccctggcctacgatcacatgcatctgctggccaagaccggtatcggagaggagttcctgaatgtcgagcaggcggcattgcgagccgttgatcgcgtattcggagcctccgttgcggaagatggtgcgggagatggtgacttccgtgtaatcgatatcgagcgtgtgatcggaattatcgatggtcaggctcacctgtgcacggcctaatggcgggcgggaggacgtgcctgcgaaaatcacgtcctccatcgaagtgccgcgcaggtttttggcgccctgctcacccattacccagatcagggcgtcgacgatgttcgacttgcccgaaccgttggggccgaccaccgccgtgatgccgggctcgaagcgcagcgtggtgacggaggcgaaggatttgaatccgcggagggtgagttccttgagatacatggcgtgagactgttttccgtatgccgggtgtccgggtatccgatatgccttggatgcgggttaccgggcgtcggcggaatcgtcggtgtcggcgctggctgtgtcagtgctgtcggtgtcggcactggccgtgccggtgccggcgtcaccggcctgttccttaccgaggccgaggacgtcgaacacgtcgaagtcgtccgggcttaccgaatcctcgaggttgtcggcggcctcatcctcggccttgtctgccggctgatccgaatcgtccgggtcaaccgccggctgatgaacggccatagcctgcctcatcgtggggctggcgtgttcctcaagcatcaggcgtgcgtcgccggcggtgacgaagctgccgcagataagcacgccgtggccgtagcccacgcccagctcgtcctcggcatcgaccatattgacggcggtctgaatcgcgtcaggcaggttcgcttccttgatcacacggtcacggccgaacacgtccacggcaatcttctcaagctcgtcggccggcatcacgcgctcgcgccacgagttctcggtgaccaccacggagctcaggatcggctccagaacacccagatattcctcgacctgcttgtcgcgcatcatggcgaccacaccgaccagctgcttgaagtcgtagctttcctcgatggccttgcgcagggcttcggcggcattcacgttgtgtccgccatccagaatgatggtcggtgaggtgcggatctgttcgatgcgtccgggaatcttgaccgagctcaacgcctcggccaccaagtcgccgtccagcgggccgttgaccggaatcaccacttcggaagcggcgagcgcggcaagcgcgttgtgggcctgatgctcgccgaacttggcgatcggcacgccctcgtaagtgccgttgggcgtggtcagggtggcgacttggccgccgactgcggccatacggtcggacgcggtcatttcgtagccgtcgcgcacgagcatggcgtggttgcgttcggcggcttcggcgagaatcggcatgacggcttcctcatgcggctgcgggccgatgatggcggtgcagttcggcttgatgatgccggccttctcggtggcgatctgttcgacggtgtcgcccagccactgcatgtggtccatgtccaccgggccgatgatggccgcatccgcgttgagcacgttggtggcgtcccacaggcctcccatgccgacctcgacgatggccacgtccacgggcgtgtcggcgaacttccagatggccatggcggtgagcacctcgaagaagctcatcttcggcttgccttgctcctccatcttggcgtccaccagggccacgagatccttggtctggtcccagatgtcgatgaaatcgtcatcggacagctgctggccgtcgatggcgatacgctcgttgatcttctccagatgcggcgacgtgtacaggccggtgcgcataccgtaggcgcggcagatggcctcggccatgcgtgcggtggagcctttgccgttggtgccggtgatatgaatcacgcggaacgactgctccgggtggcccaggatgtcgagcatcaggttcatccggtcgagatccagattggtggtgttatgctccggcgggcggctcatgatgtccagttcgacgtcccgcatgctctcattgttccgattcggatgctcgaatgacatatcctcttctaacctctgctcgtgttgctgttgcgccgttcggagtgcgtatgccacttacgtgttcgcgccattctcgtcatgtctacgcatgcccgcatatattccgcttccgcatgcgcaggaagttccccttgcacaggtttgctctgcatggttcgggattcttgccttcacgcgtggagccgcactccctcaattccctctatcctagccgccggggtggtttatcgtgcgcgcacagtgaaaccgtctcatatgtcgccgccgcgcgggcagtctctacctgcagccacgcacagtgaagccgtctcatatagttgcaatgcggctcttgccgtcggcatcccattcttagtcggctgcaatccaaaacttgtatgtccggcgacgctgatgctattcagcgtcggtacagtgccagcttctggcggtacaccgacgctatgatgctcttgcgagtcggtggctggccaaaacctggattaatcccgactccatcgcctctcagtgtcgtctcctcgccaaggcatgccattctgccgtcgttgagaaatttcaacgtcgtcaatcgaccatgtcttgccccggaaacgactctcacaaacgtcctctacatcatcttttgaactcgcagaggctcattcactgttatgactgctctcaccgtcggcagccgtccaagccctggatctatgccgccaataaattgcagcaaatcgtcggccccgatacaaccattggactcacgccgacgctagattccacactcagacagaagccagccaatatctgaaccagcaccgacggcgtacaaagcataagcaccgttaaccgtcaattcgccgccctctaccagctacatccgccttcgccgatgatatcttgttcgaatccccaaagcacgttgttcgaatgacattactgatggtggataagttttgtgtgttatccactattccgaattagcggcctaataccttgaaattatcgggagtatctcgctccaagacagccaagctccgaggctagaaccacaatggctgaaattcatacttacgctgcttcgttccggctacgctcgacgtcatgaagacacacaaagcagtggcctcgctcatatcagccgcgcagaatgagctgagatgcgtctattcaagaaatgaagcggaacagaccgctctacgccgccgtgcccagagtggtgagttgttgaaagtgtatgacggcattcccagtctttatgcaaatactgcatactgggatggtttgacgccgccggagcgaacgttgcatatagcccgcgctcttgcgcaagagcatcctcagtgggtttttggcggcttggtggcagtaagtgcctatggattcgaacatcaatggcatttgcatgatgactgcataaccatcgtgacttccgatcatggatctcgtcaatgccatcagcgcttacgacatgtctatatgcccgatatgaacaatccgaagacacattacgaggcctccggcctatccctgatatcaccggctagaaccttggtcgaggccgctatagaccttgattttcggtttgcgttaccgatctttgactcggcccttgccaagggaataaccaaggaagagatagccgccgactgcgttcaatggagaatcgattatgcccgagtattccgcctgctgcgctatgcaaacgaaaggagcgagaatggtggagaatccctcgcgcgaggcaccatcatcgaagatcgcttcctcacgccgcgtattcaggtaacggtgaccgacccacagacgaataccgagtaccgcgttgatttcgtatggaagctcgatgacgggcgcgtgatagtggccgaatacgacggcacacaaaaatacgtggacccagccatgaccgataaccgcagcattcaggaggtggtggccaaggaacgcgcacgcgacgagggactgaaacgagccggtgccaccgaaatcgtccatttcacatacgccgacgtcatcgaacgtactccgctgcgggtaaaactgatcaaagccggggtgcctcaggtggagacctccgcatagcagtgagtcccgcgacgcgataaaccttcatcgcatgggttcacatggattcagcccacagaatatgtcaatatcaatcggcaagctccagcccaagcccatgcccctctccttccctaccgagaacaataaacgggcccgcattccagcccgccgcactcgccatatgggcatatccggaagaccgtccaaattccgtacttggttttaccgtcagccgtcaatcgtggcacatcgcataaagccgactaatatgaggtgggaatcgatgattcgacaacaactacatacaggagagtggcaatgggtgaagtgatcaccgccaaggacaaggaatatgaggccgaagagcgcgctacggcaccgggcgcgaaccagtcgatgagcgaccgcgtgaacaaccgctcgctgcgcccgcagtcggccgcattcaaggagttcatgaagtccggctgggccgacgatgatccggagattaatcctctcgaatcctccaagttcacgccagcccgccttgaggcgctgggcaaggccttcccgggcgaacgtctggtcattccggccggccagccgaaggtgcgcaacaatgattgcgattacatgttccgcccggacaccacgttcgcctactacaccggtctgggttccgattacgaggccggcgccgtgctggtcctgaacccggtcgaccccgactcccccgaagccgccgccggcaagacgcacactccggaactgttcgtggcgccgcgcgccgacaattccaccgaggacttcttcatgtccgcccactacggcgaatactgggttggcccgcgtgccggtctcaaggagatgcaggcgatgaccggcatcgaaacccacgacatcgcccagctggccgacgccctgtccaaggacgtgggtgccgaagccggcgccgtacgcgtgcgcgtggtcagcgaaaccgacccgcaaatcacttcgatggttgaatccatccgcgaggccaacggtttcgccgatccggacaagaactccgcatccgacgacaagctgcacgagttcgccgccgaggcacgcatggtcaaggacggctacgaaatcaacgaaatgcgcaaggccgtggacgccaccaagcatggcttcgaccgtctgctctccgcactgccggccgcgctcgacaagccgcgctccgagcgtatcctcgaaggcgcgttcaacgccgtgtcccgtgaactgggcaacgccgtcggttacgactccatcgtggcttccggcccccacgctccgattctgcactggatgcgcaacaccggtgtggtgaagaccggcgacatgctgctggtggatgccggcgttgaggtcgattccctgtacacggccgacatcacccgcaccttcccgaccaacggcaagttcaccgacttccagaagcgtctgtaccaggccgtgctcgactcgcagcaggccggtttcgaagccgccaagccgggtgccacctactccgacatccaccacgcctgcatgcgtgtgatcgccgagcgtctgcacgattggggtctgctgccggtgagcgtcgaggagtcgctgtccccgcaaggccagcagcaccgccgttggctcgcctgcggcgtggcccaccacctgggtcttgatgtgcatgattgcgcgcaggcccgtttcgagtcctatcagggcgcgccgattcgcccgggcatgatcttcacgatcgagcccggcctgtacttccgcgaggatgatctgctgattccgccggaataccgcggcatcggcatccgcatcgaggacgacgtgctcatgaccgagaacggccccgaatggatttccgccggcatcccgaagcagatcgacgacgtcgaagcctggatggccgagcaggctgcccaagcgaagtaacctaagctccctctgatgagggagcttcttttctactaaggaggcaatgtgtccactccggaatttgtgttggaattgcgtaagaagatcggccatgatctgttgtggctcaatggcgtgaccggttgtgtactgaacgaacatggtcaactgctgttgggccgtcgttcggacacgggcgaatgggcgatggtctacggcatcaacgagccgggcgaacagccggcggacacggtggtgcgcgaaatcaaggaggagacgggcatcgatgccatcgtcaccgatttggtggccgtcacctcgtcaaacaaggtgctgacctacgccaatggcgacaacaccatgtacatggatcattcgttcctgtgcgccctgaagcccggcggcaatgccgagccgttcgtaggcgacgaggaaagcctgagcgtcggctggttcgatctggatgacctgcccactcccctggcggccagcacgagcgagcggctggagctgttccatacttacatcgagaacaaaaaacacggcgacgcccacgccctgttccagttcgatgggcagcagtactagcggatataaagttagctccctctgacgagggagctccaatgctatgcgattacgcctcttgggctaggagctcgtggaggtgggcgcggtgttgctgctgttcgcgcgggtcgggcacgggcagggaggccagcagcttcttggtgtacgggttctccgggtgctgcataatctggtcggcatcgccgtgctccacgatctggcccttatgcatcaccatgatgcggtcggcaagcatatcgaccaccgccaaatcatgggtgatgaacaggcacgcgaagccgatttccgcctgcagtcgcttgaacagctccaacaccttggcctgcaccgacacgtccaatgcagaagtcggctcatcggcgatcagcagcgacggcttcaacgccaaaccacgcgccaaagacgccctctggcgctggccgccggacagctcatgcgggaaacggttcatgtaggcgcgcggcagctggaccatctccagcagatcgcccacatagttcttggcatcggccacggaaccgtacttgtggtgcacgagcagcggctcggccacattctccgcgatggtcatcagcgggttgaacgaggagcccggatcctggaacacgaaaccaatgtccgcgcgcttgggcttgaagtcacgctccttgacgccgttcatctcgatgccgagcacgttcagggagccgccggacaccttctgcaggccggcgatggcacggccggtggtggacttgccggaaccggactcgcccaccaggcccagcacttcggagcggtggatggtgaagttcgcgccgtccacggccttgaagtcgggctgcatgagatggcccgggtacgtgatggtcaggttcttggcctcgacggcgatcggctgttcgcgccaatcggccttgcgctcgatcggtttgccctcgcggtcgcgcacgaccagcttctgaccgatgcgcggcacggcacccagcagtcgcttggtgtagtcgtccttcggatggtagaagatctgctccacgtcgccctgctcgaccacgtggccgcggtacatgacgaccacctggtcggcgatgtccgcgatcacgcccatgttgtgggtgatgatgagcacggaggcgtcgaactcgtcacgggcgaggcgcagcaggtcgagaatttcggcttgcacggtcacgtcgagggcagtggtgggctcgtcggccagaatcaggccggggttcagcaccaacgccatggcgatgacgatgcgctgcttctggccgccggagaactggtgcgggtagtagtccacgcgggtttcggcatccgggatgccgaccttcttcaggatgttgatggccttggcgcgcagttccttcttgtccttcatgccgtgggcgcgcaggccctcttcaatctgccagccgatggtgtacaccgggttcagcaccgaattgggctcctggaacaccatcgcggcctcggaaccacgcacttcgcgcagctgttcgccgctcagggagagcacgtccagcgaatcggagccatcgcgcttggacaggtagacggcaccggaggtggtggccgtctccggcagcagcttgatgatggagcgcgcggtcacggacttgccggaaccggattcgccgaccacgccgaccacggtcttgcgcggaatggtgaagttcacgtcctcaacggccttgatggagccggcgtcggtcatgaaggagacggacaggtccttgatatcggcgagattcttgttgttttcgctcatctctcactccttgccttccggcttgccctcgccggtccattcggaggcgacgatggtcgggtcatggtcggtgacggtggccggcgggtcgacgttcgcgtcgagttcggcaatcacctcgttgcgtgcggtcggcttctcgtttgggtcgacggacgtgtcttcgatcgatccgaccacttcgccggcggacttgcgggcgcgcagacgcgggtcggccagatcgttgagcgattcgcccacgagcgtgatgccgagcacgatgagcacgatggcgatgcccgggaacacggcagtccaccagatgccggcggtcacgtcggaaaccgagcggttcaggtcgtagccccattcggcggcggcggtcggctcgatgccgaagccgaggaagcccaggccggcgagggtcaggatggcttcggacgagttcagcgtcaggatcaccggcaacgtgcgggtggagttcttgaacaggtgcttggtcatgatgcgccaggtggaggcgccgaccacgcgcgcggactcgacatacgcggattccttgatgcggatcacttcggcgcgaattgtgcggaaatactgcgggatgtacaccacggtgatggagatgccggaggccaggatgccgctccacaggccggactggccgtgggagatcatgatggccatcagaatggcgagcagcagcgaggggaaggagtagacggcgtcggcgatcatcaccagaatgcggtccacccagccaccgtagtagccggagaccaggccgagcagcacgccggcgaagatggagagcagcacggccacgacgatggcgatgacggcggtgcgtgcgccccacaccacacgggagaacacgtcgaatccggcggcggtggtgccccagatgtgttcggcggagggtgcggcctgcgccgggaaggacgtgccgtcggcggccttgatctgggcgtggccgtagggggcgatcagcggggcgaagagggccacgagcaggaagaacgcggtgatcgcgagaccggtgatcagcatgcccttctgccagccgaccgccacgcgcagttccttgatgatcgggatcttggtccagaacggcgtcttggtgctgacgttgagcttggtgaggcggtcgtcaccggggacggtgatcttgtcttgggatgcggtggtcatctcagtacctcactctcgggtcgataagcgcggcgatgacgtcgacgaggaagttgacgacggccacgatgatggcgataaggatcacgatgccctgcacggccacgaagtcacgggccttcaggtactgggacagcatgaagcccaggcccttccattcgaaggtggtttcggtcaggaccgcgccggcgagcatcagggcgatctgcatgcccatgacggtgatgatcgggatcagggccggtcgccaggcgtgcttgttgagcaggcgcttttcggagacgccgcgcgagcgggcagcctcgacgtagccggaattgtaggtggagatgacgttggtgcgtaccagacggatgaacacgccggcggtcaggaggcctagggcgacggccggcagcacggcgtggcgcagcacgtcgacgagcacgttcatgtcgccgagctggatggcgtcgatgatgtagaagccggtcggcgataccagacgggtgaactgcatttcggagttcaggtcggagcggccggaggctggaaggatgttgagccagacagcgaagatgagcttcagcacgaggccgaggaagaacaccggggtggcgtagcacaggatggcgaaggtgcggatgccggcgtcggcggcacggtcgcgtttgcgggcggcgagtcggcctaggccgatgccgacaatcagcgccacaatcagggcgaggaaggccagttcgaatgtggcggcgccgtagtgcgtaagaatgctgatcaccggctggttatcggtcagcgtcgtgccgaggtcgccgtgcagcaggccgccaagatagtcgacgtattgcacaatcagcgggcggtcatagccggccgcgtggatgcgctgctggagttcggcgggtgtcaggcggccgcccagggcggcggaaatcgggtcgccggtggcgcgcatcacgaagaacacgatggtgaccagaatgaaaacggtgggaataatgagaaggaacctcgtcagcacgaagcggaagaaactacctgacagtcggttcttcttcgtcttggctttcgccggagtggtgctggaggtcgctatggcgctgtctgacacgcgatgctccttggtgttggtaatcggtatataaagcaataaaggctcccctctccgaggggagctggcggcgaagccgactgaggggagtcatacgagttgggctcccctcagtctgccgtcggcagacagctcccccccctcaaagaggggagctcatgctggatcagcccttggtgacggaggcatagcggaagcggaaggaagcgtcgagggtgacacccttcacggaggtgccggtgacggcgacctgggcaccctgcagcagcgggatggtggagaggtcttcggtctcgagcttctgaatctgcttgaggatgtctccacgagcggactcgtccttctcgccggcctgcttgacgatcaggtcgttgacttccttgttggagtagccgttgttcacgaagttaccatcgcggaagaacggggacaggtagttgtccgggtcggagtagtccgggaaccatccaagctggtagaccgggtacacaccgtcggaatcgtcggtaaccacacgatccttgttgtactgggtccattcggtggactgcatgtcgaccttgaacaggccgcctgcctcaagctgggacttcagggcagcgtactcgtcggcggagacggagccgtagtggtcgttgttgtactggagcttgaggtcgaccggggtggtgacgccggcgtcggcgaggaccttcttggccttctcggtgctcggcttgccgttgccgtcgccgtaggcggacttcagcgtgtcatcgtgaccggccaggccgtccgggatgaaggagtacatcggggtgtaggtgcccttgtagaccttggtggagagctcttcgcggtcgatgaggttggcgacggcctggcgcacggccttggccttgttggcgtcggcatcgggctgggattcgccgtagggctgaatcttgaagttgaaggcgatgaagcgctcctcaccgcccgggcccttgacgaccttgaccttggagtccttggagaggtcctcgatgtcggtcgggctcagggagcggtaggccacgtcgacctggccctgctggacggccatcttcaggttggaggcgtcggcgaagtacttgacctgcacgacggagttcttggccggggtcagacccttgtaggagtcgttcttggcgtaggcggcggactcgttgatcttgaaggctgtcagcgtgtacgggccggcgaaggccttcttggagacgatggtgtcggcgtcggcgagcttgtcggcgtcgaaggtatcctcatcgacgatcgggccggcggggctggacatgacctgcttcagggtcacgtcgaagggcacggaatccttgaacaccacggtggtgtcgtccttggcggtcacggattcgacgttggcgagcagggagctcgggccgttcgggtcgttgatcttcttgatgcgatcgtaggagaacttgacgtcggaagcggtcaggtcgttgccgttggcaaacttcaggccgtccttgagcttgacggtgaattcggtgccgtcatcgttccaggtaccgtcatcggcggcgatgtccgggctcagttcggaggtgttgtagtcctgggcgtacaggaacgggaacacctggatctgcacggcgtatgaaccgttgtcgtaggagccggcggggtccaggctggtgatcttatcggtggtgccgatggtgatggcgttgccggaatcggcgcctgcggcggtgtcatccttcacgccgccgcaggcggtcagggatgcgatggcggccacggagacggcggcggccagaatcttcttggaattcaacaggaatcctctctcataacttgtttccacgtcatcactgcgggcgtggattaccgcctgactatggtgcggatgtgttacctctgcgtttccatagtcatcgacttatgtttcgcttgtggcgaccaaggccggttttatgcggtatcgagcagtattacggattcttgtattacgacgtgaataacggtcacatggtgagacaaatatactatcatctcaccatgtgaccatgttcgtagacgaatgccttccattcgtcaaccggtcggcctactgctacttgagcttgcggcccgcgcaccacacctgttcgaccgtccagtcggccgggtccgcaaggttgaaatcggcggcgaagccgggggcgatgaggccgatcggcgccccggtgaccgggttcggccggtcgaagccgaacgccttggccggcgtcagagtggccgcctcgaccgcgtccaccgggctgaagcccagttcgtccaccgcacggcgcacggcgacctccagcagcagagtggagccggcgatggcgccgttggagaccaggcgcgcatgcccatcgaccacgttcacgtccagcgcgcccaacttgtaggcgccgtccgggcagtcggtggcggccatcgcatcggtcacgaaggccgtgcggtgaggcgcgaaccggaaggagaggctcaccatcggatcctgcacgtggaatccgtcgttgatgagctcgatggtgacgcgcggatcttccaccgcagccggaatcggaccgggttcgcggtgatgcaggccgttcatcgcgttgaacatgtgggtcatgatgcccgcgcccgcgtcgaagccggctttggcggtctcgtagtcggcgtcgcagtggcccacggccggcaccacgccggcagcggcgaactggcggatggcggagatgccgtggggcagttcgggggcgatggtgatctggcggatgcagccaagcttgccggaggcggggtcggcaccggaggcatcaagcatcttatcgacgatgtcaggcaccggatccttgagacattccgggtcatgtgcgcctttgcgcgccagggccaggaacgggccttccagatggcagcctaggatgtcggggcggccggactccatcttggcgcggacggtgcggatgttgcggcagatcacgtccacggggttggtgatcagcgagagcacctggcgcgtggtgccgtgcacggcgtggccggcccgcgccacgtcgatgccgtccggcccgtcatcgaagctcttctcccatgcgccgtgcgcgtggatgtccacgtagccgggggtcagaatacggccttcggcgtcgatgaccgcgttgcgatcggccgggtcgagccccaccgtgcggcagtagtgctcgaaggtctcctcccccgtgccggccgccacgatgacgccggcggcatcggagacgacccaatatccgcgccgttcgccgcgcgcatccaccttgcgcgcgttacgaatcgccaccggagccggcttgccctccagtgccgcggtcacgcgcgagactatctcgttcctatcagacatgttgttctccttaccgctcatgcgctcccgctggcgggagccagcacacgataactcagatgccctgccaggccggcttgtgggtgtaggcataacggtagtagtccttgtggcgcaggcgggacgcggcctcctcgtccacgataatcgtggcgtgcgggtgcatctgcagcgcggaagccgggcagaacgctgacacgccgccttccaccgtctcctcgatggcttcggccttgccggcaccgaacgccagcagcacgaggtgacgggccttcatgatcgtgccaataccctgcgtgatgcagtgggtgggcacttggttgatgtcgttgtcgaagaagcgcgcgttgtcgatgcgggtctgttcggccaaggtcttgacgcgagtgccggaggccaacgaggaaccgggctcgttgaagccgacgtggccgtcggtgccgatgccgaggatctgcacgtcgatgccgccagcggcttcgatggcacgatcataggccgggccggccagcgcgactttgtcgccgtcttcgagcggagtgccgttgagtacgtcgccgggcacatggaccttggccgggtccaggccaagcggttcgaccacggtgcgatggatggtcgcatgataggactcgggatgggtcagcggcagcccgatgtattcgtcaagcgcgaaaccacgcacgcccgaaacgtcaatggcctcgtccttgacgatcttggcgagcgcctgataggcggccagcgggctggagccagtggccaggcccagcacagcgtccggctttgctttgatcaggtccgccacgcaacggccgtagatctcgccggcctcggcttcgttcttgacaatgatgatttccggcatcggtttcctccagttccgtgcggcccgcccgatgcgagtcgctgtaccgccgcccgtcttgcggataatggcaacatccttgtcacgtccgggtgccgcgcggcgttccaaccaccgttcggcgtagcgccgattggtgattcgctatttgttaatgatactaacaattttggaccttatgaacactcacggtgtttcctgacgcttcacacaggtacactggaatttattagtgaagtttcataacagtttcaacgacgaaattgcgcttcaccgtctaagctgtgtatggaacaacaatcgccgtccactcgctcaccatcaggcaggaggaaacatgtcatatctcggtctcaacacaacgaccgacgaccatgcggccaaggcttcccccgccgatgtgcgccgcaagaaccgccaacttatcttcaggttgttgttccccaccaaccagtattcgcgcgccgagctcggccgacgcaccggattgagccgcgtggccgtttccgatgtggtcggtcggatgctggaggaaggattgctgcgcgagaccggtcaggcacccagcggcggcaaaggcaaacgaggcacactgctgagcatcgatatcgatcgactgcgcatcatcagcatcgacctgacgcaggagcacctgctgcacggcgcagtcaccaatctgctcggccagccgctgcgtcacgccgaagtcaccctgaacaccggctcattcgtttccgtggatgtgatcatcgagctcattgagaagatgctgggcatgtccgatggcgaggtcatcggcatcggagtcgcctcccccggcgtggtagacaacggcgtggtccgctcctccacgatgcgcggctggaacaatctcgacctgtccacgccaatcgccgaacatttcggacttgaagtaaacgtcagcaacgacgccaccgcagccatgctcaccgaacgtttctttggccaaggcgggccgaatatgcttttcgtgcgcatcgaaagaggcatcggttcggcgattctgctctcggacacgccggtaatcggcgaactgcacgcggctggcgagctcggccatatttccatcgatcttgacgggccgccgtgcccttgcggcaagcacggttgcttggagacgatgatttccggaaccgcattgaagaagcaactcagcgcagcagacgtggagcagcatcagaatatccttgctcgggcgggccgctatcttggccaagccctggccatgcctgtgggccttttggatatggcagacgtatgcgtctatggccagccgaacatcatcaacgcgacgttcatcggcgcggcccagcaatatctggatgccgccacatcctcgtccttccacaaacacacggtgattcggcgctgcgaatgcggacctgacatcaccgtacagggcgaggccatcgccgtggtcttccaacacttggccaaataaaagccggtcaccccggcaacgaaacgcgcaagaccaagcgcggcacagcacgacataaagcgatataggactgcgtgggagatggggcctcggagacaaatctgaggcctcatctcccatgccccggcactatgccaggctacgccgccatggcggcaccgatggctccgactggttggccgacaggtgccagacgcagccgggccggcaggtccagcgtttcgaggaatcggcattgcgattcgcgccggcgcagctcagccgtgatcacctcgaccaatggttcgccggttttggccatgccaccgcccaagatgatgagtcgcggatcaacggactgagccaggatttgtatggtgtcgccgatggcgcgcactaccatgtccagcacatcgacggcctcggcctcccgctttttcgcgcgacgaatcaggtcgggcatcggcgggtcggcgttgggccacagacgtcccacggatgcgcccgagcagacggtttccaagcatccgtattgcccgcaagggcacttgaggcgatgaggttcgactgggatatggccgatttcgccggccgcaccgctatagccatgcatcagcacgccgttttcgacaatgcccgcagccagtccggtgccgaagttcaggaacgcaatggtaccggccatgccatctgcaccgcccaacacggtggccgcgccgacggcggcggcgttgacgtcgttttccacatgggccggcacgcccgaacgctgcgagatcaacggccccatatccagcgagaccacgtcgagattcacgatattgcccacatgcccgctggccgaatccaccgtgcccggggtaccgacaccgatggccctcacctcgtcaaaacgctcacccgccgcctgatgcgctacagcgacgatgtcttcgatcacggcatcgttgccatgtctggcgggaatacgggcggaacccaataccgtgcccattgcgtcaaccagcacagcttcgatttttgttccgcccacgtcaacaccgattttgagattgttcatagtgttttcggacatcagtcctcccctgttcttcatcgaacgtttcgcttgatatcagtgtacatctgactattgacaactatcttaacaaattcacccaagacgacactcacatgcacgacacgccgaatgacatattgattgcgtcaatcaattaacagcgttaatatcttaatcaagttcagattcaaagacgagcggaacaactcgcagcagtgcagacaaggaggacttaagaccgatggcaacaaacaccacccacgccacttcccaggccagtgtctccgaatccaaccgctcccgcatcgtcaagcacctgtatcacaacggcatcagttcccgcgcgcaaatcgccaaggcactggaactcacccccgcggccatcaccaaaatcaccgcacgccttatcgaggccggcatgattgaagagaccggcgatctggaaggctccaagaaccgccgttccatcggactcaagctcaacaccacgcacttccgcatcatcggcatcaaattcgcccgctcgctggtgcagatcggcgtgttcgacctgtgcggcaacaccctgagctttgaaaacctgcccacggtgtgcgacaacaccatcaacgactccatcgtcaccatccaccagcgcgtcgaacaactgctcgacaacgacccatccatcgtggccatcggcatggcagtgcccggcccctatctgcgtaacgtaggccgcaccgccgtggtgtccaacatgcagggctggcgcaaaatcaacttcatcgacgaattcgccaccgctttccgcgtgccagtgttcatcgaacaggacgcccgcgccggcgccctcgcacattatctcttcgacccgtcggtgcacgccgacgacaacctcgcctattatctggtcggcgaaggcgtgggcctcggcgtcatcgacaacggtcgcctcatcaacggcttcctcggtgccgccaccgaaatcggacacatctccattgacgtcaacggccgcccctgcgattgcggcaacatcggctgccttgaacgctactgctccacccccgccattcacgatacgctcatcgccgatggcaccgtggttcccggcgcggccgatatgacccacaccgaagccgcccgcgccctgttcgccaaagccggcgacggcgacgaagcggcaatcgccattgtccgcgaagtcgcccgatacgtcggctacggatgcgtcaccatcttcaatggatacaatcccgagcacatcatcatcggcgacatcgtgtccgaagccggcccgatactgctcgatgaggtgcgcgccacggtggccgaacgggccatccccgaaatcaatgcctccacttccatcagcctatccaccttgtccgccgacgcggcggtctccggtgccgcagcagtgacagtgacccaattcctcgaacacccctcggtgttcttcgacgtctcctaaaccaagcgccgacatcacaagattttccatacgaaacacccgataaaggaaacaaaggaaaggaaaccaaccatgactaccccgatcgttctgagcctcggtgaactgctgtgggacatgctgccgagcggcaagcgagccggcggcgcccccgtcaacttcgcctaccacgcgatgaagaacggcaccgaaggctgggccatcagcgcggtcggcgaggatgaactcggcgacgaactgattgccaaggccgacgaggccggcatcaacaccgttcttcagcgcaacgcctggccgacctccaccgtcgaagtcgcactgaagaacggtatcccggagtacaccatcgtcaagggcgtggcttgggaccacatcctgtacacccgccagctcatcgacgtggtctccaaggccgacgccgtctgcttcggcaccctggccctgcgctcccccgaatcgcacgccaccatcacggagctgctcaagcacaccaagccgggcgcgatgaagttcttcgacatcaacctgcgcggcgaccactactccaaggaacttatcgaggaactcctcaaggcggccaccgtcttcaagatcaacgacgaggaactcctgctgctgcgcgacatgttcgacattcgcggcacctccggcgaagacgcctcccgctggttcctcgaggaattcgacctcgactacgtgattctgaccgccggctccgcctactccaccatcatctcccgcaagggcgaggtctccacgctggacactccgcacgtcgaggtgaacgacaccgtgggtgcaggtgactccttctccggcaccttcaccgcacgcatcctgctgggtgacacgctcgccgaagcccaccgcaaggccgtcaacaccgccgccttcgtctgcacccaggccggtgcctggcccgagtacccggccgagatgcccgactatctggctgaaatcggcaagtaatccactcccaccccattttcccgatggctttgccgctctataccggcaaagccatcttgttcagaggagtcaccatgtccattcgcgacaccgtcaccggcgtccagcatgtcggcattccgaccacggacctcgaaggcaccatcgcctactacgagcgtctcggcttcgaatgcctcggcatctatcccaacggtgaggaccgctgcaccttcctgcgcctgaacaacctgaccctcgaggtgtggaccatgaaccccacgcctatggaaaacggcgccatcaaccacttcgcgctggattcgacggatatcgaagcgtccttcgccgaagcccagaagctcggcctgaacttcgtggaaggctccatccagcacatcgacaccttctggagcaacggcatccgttacttcaacgtgcttgggccgaaccacgaggtcatcgaattctgccaaatcatgtaacgccatgatgacatccgataacggaaccatcactattcactagtcatcatccattgaccgatagatctgtcgtacgtccattcatagagaaaaagggaattcaaaatgagtagcgaaaccaccaagaccggcaacgccggtctcgtaaaaatcgcgcctgtgatgttcgcgttcttcgtcatgggcttcgtcgacctggtcggcaccgccacgaactacgtcaaggctgagttcaatctggccaacggcaccgcgaacctgttcaccaccatggtgttcttctggttcctgatcttcgccgtgcccaccggcatgctgatgaacaagattggccgccgcaagaccgtgctgtggtccattctcgtgacgctggtcgccatggcactgcccatcatcgcctacgtggccctatccggcaccgcacgtctggtgctcatcgtcatctccttcgccttcctcggtatcggcaacaccttgatgcaggtgtctctgaacccgctgctcaccgtgttcgtcaagggcgacaagctcgcctccaccctgacgctcggccagttcgtcaagtccttcgcctccctgttcgccccgtacatcgccatctggggcgccacccagctcggcatgtggtggatactgttcgtgatctatctggtcgtcggcatcgtcggctacgtgctgctcgccatcgacaagatcgacgaacccgcccccgacgccggcaccaccaccatcggccgctgcttcaagctcctgttctccgaccgcatcgtgctgctctgcttcctcggcatcgtggcccacgtgggcgtggacgtcggcatcaacgcccaggcgccgcgtatcctcaccgagcacaccggcgacaccttcaccgaaatcgccgccaccgccaccatggtctacttcgtggcccgtatgatcggctgcttcaccggcggcatcgtgctctcgaagatttccaaccgcgtcggcattctggtgtgcggcaccatcatgaccgcctccaccgtctgcttcgccatcttctgctcgatcacctccaacccgccggtcgccctgttctgggtggccgtggccctggtcggcttcggcaactccaacgtgttctcgctcttcctctcccacgcgctgatgtaccgtccggagcgccagaacgaaatctccggcctgatgctcatggccctgatcggcggcgccatcttcccgcccatcatgggtgccctggccgacgccatgagtgcccagctcggcgccatcatcgtgatgtccgtcggctgcatctacgtgctggtcatcggcgttggatacaaggccatcattgaaggcaagaaggcagccgtcaaggcctgacgatcggcctggctgcggcttcctgaagccgatatacgaaaagccctgtgcgaatgatccgcacagggcttttcgtatatgtacttgtcgcttggctcagcgggacccgtcaggcatatcagtttcggtgtcgatgacgatggtcaccggcccgtcattgaccagtccgacccgtatatgcgcgccgaaacgaccttccttcaccggcactcccccggagcgcaacgcctcgttgaacttgatccacatgagatcggcatgctcgggcttgccggccttgatgaagctcgggcgattgcccttgtgcacgtcggcgaacaacgtgaactgcgagatggagagaatctcaccgccgatgtcctgaatcgaacggttcatcttgccctgcgcatcctcgaacaccctgagattcagaatcttatgggccaaccaggcgatctgcttgtcgccgtcctcatcggtgacgcccaccagaatcatgaatcccgggccaatctgctgcggctcgaacgtgggatccagcgtgcccaattcattgaccacgtccacggacgcttcggatactcgttgcaatacgactttcatggttccctacagtacaacgtgtgcagtcaccagccggtaacgtacacgaccgactggtgaccggtaatatctgcactgcagttcatcgtttaccgcttcattcgacgacgagaccgatagtcatcacgaacaccaccaagaaagtccggcgcgctgaggtcatcaaggtcagcacctccgcgcacggcggtcgcggcacaggcaacggcctcaaacgaggctttgattccctgtccatcggcatgaaaatcagtggcgcatcgcggtgagataccaaaatcaccagccgtctgttcggcgtcgatgttcgcgcccagaaacacaaactcccaatgatagcgttcacgctcataggtaatcatctgcttgatctgatgcaacgaatatcgacgactcgcgttctcatacccgtcagtaatgatgacaaacagcacatgttgagcacggtacgctgccgcagtatgtcgttgcgtcacgatcatgcggtcaatggccagcccaatcgcatccaacaacgcagtgctaccgcgcacccagtaatcccggctcgtcaaatcgttcacttcgcggatgtcgaggtgattatgcaaggtttcgattcgatgatcgaacagtagggtcgttaccctgcactcgccggcaattgttcgctgcttggacagcatgctgttgaagccaccgatggtgtctgattccagacctcccatcgatccgcttctgtcgacgacgaacaccagttccgtacggccgttattgccattgtcgttcttgcccatgatgaatcctttcgctcattcgccagccggattgtcggcgatatcaatgagcttcgcatcatgggaccagtcctaggtcgcttggcaagcgacaatatgccgcgtatcggcagcaggtcaggagacgagcgtaccgctccgcatcattgcccaagcaacggctgatcgtatcggaacaacatctcgttaatagtgaatacatcaaacatctcatggacgatgaagaattccacgatcacatcgaatttcacgctgtgcgacagcgcatacccggcgcacgccaatatatcttgcgtctcgtcaatattcagccgtaaggcaatggccagtgccaaaaccgttttcttgctgggcatatagccatcgccacagcgaattttagagaacagtttacgattgatattcgctcgtttatatacctccacgtcggaatatcctttggcgtcgataagcctcaagagaatgatgttaaaaggttcatccagattggagagcaccgcatcatccacatgcccggcggatttcggcgatggagctgccgacggcgccgagtagacaggcgtttcacccatatcgcccaggaaatccggcatgtccaagacgccggaaggtacggccctatccgccttcggcttattatccgaaaaccgttggagagcaagcagctcatacgttctgcttcctagcgtatcttcatgctccgctacataataatcatcaatatatgcgcgaagacgtttgtcaatactgctgcttatttcgaaagcggttttgtcgaatacgcataggtatacgtcgagatcgtgtccggagtcggctgcgtcgcccaggaatcggcgaatctcatcgagggccacatgaagggcctcggctttcggatatccatagataccgctggaaatcaaggggaaggcgatgctggcacacccctgccgtgccgcgagttccatcgaattgcgatagcacgaacgcagcagacgttcttcatcatgcttgccgtctcgccatatcgggcctgcggtatgaatcacatagcgtgatggcaaattgaatcccggagtgataaccgcctcaccggtatgaatgggagcaaaccgatcgcaggcagcagccatgcgcgagactcccgcagcgcggaatatcgcgccgcacactcccccacccatggcgagctgcgtgtttgccgcattgactatggcgtccaccttcatcttcgtaatatcctgtcggaccaattccagcggcatatatcctccctgattacggcgtagcataatagcctctacacatcgtgcaatcggcagccctgaactaagtctaaatcgtttcttccccgcaagttcgtccaactgacatatccgacacgagagaatagcgggaaaacaaggaatcaacggagcaataacagaaagccgctcagccttactttcgtaaagccaagcggcttgtttccgccgaggcggattggtggaggcgcggggaattgaaccccggtccgatgaccgagcccacagtcttctacgtgcgtagtctgctggccaagttggcgatttttctgcccccatcgatgtcgcagacaactgatggcgagcatatccgcagttaaagtcccgatgcagccctgaggctcaactgcatcagcaagtcttctaaacgacgctcagcatcctcccaaagacgaggaggagtgaacggagcggctgctcactggttaatcctgactaaaaatcaggcagcgagagcgaactcagtgcggttagatttagcacttattcttttgccggggtcatccacgagcggacccggcgttctcggcacgcttccctgcagcgaacaggtcaccgtcgaaaccgatcgcccccaatcttgagttatcaagcttccggcttttcggccggacttttcagcatacaccctatggcgctactcgcgcaaatcgccagcagcgaacatcgccccggaaccaacgaagccaacgaaatcgccgtcacttgatgatgggcttctgggatgaggaaacatcaatctgatgtttcccggcaaagccagccgtgccagcggtgatgttcttgtcgatttcctcgacttccgccaacttcagcttcagttgcgaagagtcgccccaaatgattacgcggtcaccgtcgttaagcgtggtagtcaccgaatcctgcgtctcagcggtgaccttggtaatggacttacgcatcgattccggcaacgcgcccagaatcgtcagcgtctccttcaccgaacggttcttgagactggcgtctatatccttgacctcgatcaccgggatgccatccacgttggcgttcttcaccgagttcaacacacgcgcctgggaatccaccgcggtcagggtatcgcctcttttcagcatggccgcgggccgttgcgccttgacttccacgctcatcgacttggggaactgtttggagaccttggcctcgctgacgccgggaatggacttgagttgctctgtgacctcatgggcggagaccaggaacaacgactttccagcctgcttatcggcgatgacatggatggtctgcgcactcacccattcgttggcaccggatacgccgatctcgctggtttccagacgaaacaccgacgagaaaagcagcagccatgccagccccgccactacagccacactgacgaccgcaatcaacacgcgtaacgcaacgacgcgcacgtttgcacgcttgcgttctttggcgcgttcggtgaaattcaccactttcgggcgtgatgcgactcctagggagccggtggtctgatgcagcgtttcggcaacgtaatcctcgctgtgcaaccgccgtgcatcgacgaaggcaccggcctggcccttggctaccgtcgcatcgtcgatgatctccggctcgtcgatctcatgaccggaagacacggaccggggagcgcgagacttcgacgagcgacccgtgtttccgcgtgaaccgatggtgcgcggcttgcgggagctcccagacgaacgacgtgagccgttgtcattgcccccggatctgaccgtgcgcccggacatcactcgcagctttcccgatgggcctcaagtgcggtgagcagcacctgatccatgtcggtgatgtcgcccgcgcccacggtgaagatcacgtcgccgtggtgggcgcgcatggccatcatcttggcggccaggcacatatcctcaaccggctgaatccacgtgcctgcggaagcatccttgagtcccgcagccgcgtccacgatggtggaggggctgatgtccgggaaatcggcctgcttttcacgggccgggaagatgccggtgataatgacgtcatcggctttggctaaggatttggcgaactggtgcgcgaagaacttggtgcgggagaacaggtgtggctggaagatcacacgaatggtcgaatcggggtaccggcgtcgggccgcatccagcagggccgcgatttcggtgggatgatgggcgtaatcgtccactacagtgacctgcttgaccgtgccgcgcacctggaagcggcgtgccgcaccgaggaatgtgccggccgccttggccgcgtctgcggggctcacgcccagcagcacggcagcgctgatggcggcggccgcattgcgcgcattgtgcacgccaggaaccttcagggcaacgctctgagacaccggctcccccgccgtcaccgcggccggcagatgcagggtgagctgttcgacgccgctgccagcggtctcgctttccgaagcgatccagacatacgcggcaccgcccaaatcgggcagggattcacgcgcggtagtgccgtaggcaacggtatgggatttcacgtcggcgggcagggcctccagcacggcaagtccgtcggggtcgtcgatactgatgatcacgtgaccggtggcccggccggcgtgggcaacgaacgcggcacggtagtgggcttcgtcgccgtaatggtcgagatgatcggcttcacagttggtgataatggcgatggtcggatggtatttggcgaagctgccgtccgattcgtcggcttcggccaccaggatgtcgcctttgcccgcgtgtccgccgtccagcgtggtgccgtccgggccttggataaagccgccgatggcgtagcttggatcggcaccggcgttcaccagaatgtgggacagcatggagctggtggtggttttgccgtgcgctccggccacggtgacggctcgtttgccgttcatgagcagggcgaggatgtcactgcgatgcacaatgcgcttgcccgccgcgtgtgctgcgacgatttccggattgtccggtttgatggcgctggagtagaccacggtctcggcctgggcgacattttcggctcgctgcccgaattcaacggtgatgcccagcgtttcaagtcggtcggttttggcgctgtgtgcgcgatcggagccgtccaccgcgactccttcggtgtgcagcatttcggccagaacgctcataccggcaccgccgataccgatgaaatgggtggcgccgagatccgcagggcgggccgcagcatcgaatgaggcatacgtagggtcaagcactatgggctgatcttgagacaattcaaaactcctttagggattccagcaccctatattatgaccgtatctcgtgctgcggaacggaattggtcagtatcgcgcacggaatgatatctgaatactacttggatggttcggctaattgcagaacgtgccgggccatgatttcggcagcgtttctgatgccgtattcccatgccttgcggccgaattcggcaagtcgttcgtgatcggcgagcagatcgggcacatgctcatgcacccactgcggggtcaggtccttgtctgcgaccagaaggccgccgccggcgttcaccactggctcggcgttgaaacgctgctcgccgttgccgatgggcagcggcacgtaaatggccggcaggcccagtgcagccagctcggataccgatccggctccggcacggcaaatcaccaagtcggcacaggcaaaggccagatcgattcgttccagatattcggcggtatggtagtcaccttgtccggccgattcggggccgatgccggtaagcacgtccgcgccggccgaggccgtgaccagttcgcgtacttcgctgattttgcctcgcccggtcaagtggatgatttgtgcgtgggccaacaggtctgcggcggaggaggcgatggcgcggttcaggctttgcgctcccagcgatccgccagtgaccagcaccagcggacggttcggatcgacgccaagctgcgcggccgattcacggcgtacggcggcacggtcgtcaccgatgcgtttggtcagggaggcgatggccgggcgcaacggcagaccgacgcgctcgacgtcggctccggcacgcggtttgagaccggtgccctcgtacacggtaccgatgaaatcggcccaacgagcgcccagtttattggccatgccggcacgcgcattctgctcatggatggcaatcggaatgcccatcttgtgtgcggtggcgtagacgggggcggaagcatacccgccgaatccggccacgacatccgcatgccgcgtttcaagaatggagcgcaccttggcggtttctcgcttccattttgccgggaagcgcagcatgtacaggttagggcgacgcgggaacggcactttttcgatggtgtcgagctcgtagccggcctccggcaccaaatccttctccaaacccaccgcagtgccgatgacggtgacctgtgccgtgggttcgatgtcgcgaatcgccccggcgaccgcgagcagcggattgacatgtccggcggtaccgccgccagcaagaacgatatgtggtgtgccttgattcatgattaccgagtctacttacgcgctctgacgcgactgttttatctgcggttgagagcgcataagtcccacaaccagtccggccgccgtcaagcacataatcatggatgagccacctgcggagacgaacggcataggcacgcccaataccgggaacacacccacgaccacgccgatgttgaccatggcctggcccacgatccaaatggcgacgcacatcagcaccatggcaacataacgatcggtgacctgcaatgcgatgacgatcatgcaccaggcgagaatcgcgaagaacagcaatacgatggcgcaaccgacgaatccggtctcctcgccgatgatcgcgaaaatgaaatcgttatgggcggccggcaggtagttccatttctcccgcgaattgccgatgcccaatcccagaaaacctccggaggcgatggcgtacttggcgtgaatggactggtagcatacgctctgcgcgtcagcggccgagcaatcgccatatgtggccagaatacgacgcaagcggttcgggctggaaaccgccaatgcaccgaccataaccaccgcgcccaatacgccgactcccatccatttgccggggaacccgacgatcagaaaggccacgcctccgatgaagaccagaatcatggccgtgccgaggtccctgccgcccatcaccagcgccacgcctatcgcatacaacaccaacggcgcggcatatgctttgattcccttcttgtggtacatcttgctgcaggcatgcaacgacgagggcagccatatgcacatcgcgaacttcatgaattcagccggctggatagtggtgaagccgaggttcagccaacctttgttgccatagacgtcgatacccaaaggagtaaaggtcagcgcctgcaacaggcaggcacccaccacaaagagcacgccggtccgtttccagaacgtcaccggcatcatcaatgccacgaagcccagcaccaagccgatcaggcaaaacgcgccctggttcagaagctgaaggaacggcgacttgcccagtgcggccatggtgaccgtggagctggagaacaccatgatcaggccgaagcatgtcagccccaccacggccatgcggaagccgtggtagcaccatagcgggttgagcaagcttcgccaacccgtgtagtcagtgatttcgagtgcgggcttgtcagggactctgtatgccttacgcttatgggtatcagtggaggccatgcacctcgctccacgtcttggctgcggcggcgaatcgattgcctcgatccgcgtaggacttgaactggtccatggaggcgcaggccggagccataagcacgatgtcgccggcggcggtatacgtgccgcaggcttcgacggcacgatccatgacggtatcgttgtcttcgggatcgatgatggtcaccgggatgtccggagcttggctggcaaacgcttcgatcatcggctgctggtctttgccgatgatgacggccgctttgatggtgtgtgcctggtccttgaccaggtcctcgaatcgactgcccttggccagacctccggcaatccagatcacagacttggccgggaagctggacagcgaggcgcgtgccgcatggccgttggtggctttggaatcgtccacaaaacgaacagagccgccctcgactgcggcctcagccacggtttcgatgcgatggccgcccggcttgaacgaggtaagcgccttcaacgcggtatcgcgatcagcgccaagtcccagcaccaacgccaatgccgtcaatgcatcggccaccagatgcgggtacagtgagccgtccggctctgccagatgcgtgaaatcggtgatggcggccagtctgaccgactctcctactgcgccgccggccacgccgctcctgtccacgatccagccatcttcaatgccgatctggccggcttgaggggcctcgagcgtgaatcccaccttgcggcatccttcggcagtctgagcctcggccgccagttcgctgactttggcgtcctgcgcattgtagacgatggcgcgtttggcgttgtggaacaccttggatttgtcggcggcgtaattctcgcgcccgccatgccagtcgaggtgatcgtcggcgatattggtgatcgccgcgcagtcaagtgccagcgaatcggtgaagtgcaattggaaggagctcagttccacgcacagtacgtcgtgctgcggattggtggcgcaacgagacaggctcatgctcatgtctccggaggcgatattgccggcggtcggcgcgtcgagtccgcaggcggtgagcatttccgaggtcatctcggtggtggaggttttgccgttggtgccggtgatgccgatccatggagccggagtaccggtgcgctcgttattcacacgcagctgccatgcgaattccacctcgctcatcacggggatgccacggcgttgggcttccagcacgaacggggtgcgggggttgaacaccggggacgacatgacgtagtccacgtggtcccagtccacgtcatcaaaggagtggagatcggcctcgggcttcctctcgtcgacgccaatcacgtgggtgccgcgttccctcaatacctccgccaacgaggtgccggacacccccagtccggcgatcaccactgtcttatccgctacttgcattgttcctcctgatataggaattccgtgggtgagcataatccacccagatttccgctagctgaacagcaggccggagcgggtgacccagtcgccgtagaaaatcgtcagggcgagcagcacgaagatgagttcgatcatccagaaccgcaccaccaccttggtttcggtccaaccctccagttcgaaatgatggtgaatcggcgccattttgaatacacgtttgtgggtcatcttgaagtacccgacctggatgacgtcgctcatggcttccatgacgtacagtccgcccagaaccaccgccaggaattcggtgtgcgtggcgatggacagggctgcgaacagaccacccaaggccagggaaccggtatcacccatgaaaatcgatgcggggttcgagttgtaccacaggaagccgaagcaggcgacggccgcgcatacggcgatgacggtcagatcgagaggatctgacacggcataggaatatccgccatggctgccgcccttgatgtggtagctttcccagaatgcgatgatgccaaaaccagtgaaggcgatcatcgacgaacctgccgccagaccgtcaagtccatccgtcaaattcactgcgttggtccatgcggtcatcaggaagttcacccagatgacgaacaggatgatggctacggcacggccggcgaagtcgaagttgaagaacggctgttcgatgaagctgatgcctgcctgcgcactggggaatcccgatttggtgggaatcagcagcgcaagtaccgcgtagatggtggcgaagatgaactggccgatgaacttgccgcccaccgataggccttcgttctgcttcttacgcaccttggcgaagtcgtcgataaagcccagcagacccatcgacagcatggcgaacagtacgagcgccgcggaccaggagggcacgtcgcccgaacgcaggtatcggtacagtgcggaggatgcccaaccgagcagaatcgcgaagttgatgaccacgccgcccaacgtgggggtgccgcgcttgaccagatgcgactgcggcccatcctggcggatgtactggccatagtgcagcttgtggaccagccgaatcagcagcggggtgccgactaaggtgacgatgagcgacaccagcattccaatgatcagagcaatcacgtgcagcttctctttcttgtcggtttcttggggtggttatcaggtcagttctttgcccagcgttcagccaaagcgctcaggcctgacgcgtgcgatcccttgagcagtaccacagcgtcgggatggttgcgagccaagtcgatgaccagctgttcggccgcatcgatgtcgtgtacgcaatccaccgacgcggattggctctgacgggcaccgtccgccagagcctgtgccagtgcatcgagatgttggtcttgggcggaaccgaccgcgatgatcgcgtcgatgcccaattcgtccgcatacgtgccgatcgaggtgtgcaatgccgtttcatcggcgccgagttccagcatggcacccagcagcgccacgcggaacggctccttgccgtcatttgagttccaggccttcaacccgttcaggccggctttcatggagtcgggattggcgttgaaggaatcatcgatcagcgtgaaggaagtcccctcgcgattcaccgtggacaatgccatgcgatgagggctgatggtgtgctgcgaggccagaatccgtgccaccgtttcgggtgccataccgtaacgcatcgccacggttgcggcggccaacgcgttcatcacattgtgacgtccaggaatgcccagatgcaccggcgtatggttgccgtccgcatcgaccaacgtgaattcagcatgatcggaccggtcggcagtgacatcaatggcccgcacctcgggctcctgcgacgatcccaagccgaaccacagcacgtcgccgttggccaggccggccatgggaaccacgtgttcgtcatcggcgttcagtaccgcggtgcctccgggaagcaatccctgcacgatctcgcttttcgcctgtgcgatgcgttcgcgggagccgaattctccaaggtgagcgacgccgaccttcaatacgattgccgtgttcggcggtgcgatacgggtcagtcgcgcgatttcgccgatatggctggcacccatctcagccacgaagaaccgggtgtgctcatcgacccgcaacgcagtgagcggcaggccgatctcattgttgaacgatcccaccggagccacggtcggacctacggtggcaagcagggaggagagcagatccttggtggtggtcttgcccaccgaaccggtcaatccgatgatgtcgaagtcgccgtccagctcgcggcggcgaacgatgttgtatcgggcgagttcgccaagggcgtcgaccgtgtctttcactacgatctgcggaaggccatcggacttcacctcatggtcgacgatggccaccgtggctccctgtccagcggttttcgccacaaagtcatgcccatcgacacgctcgcctcggatggccacaaacaccgatccggggccggcctgccgcgagtcgctgaccgtattggtggctcgagactcggaaccggcgtctccgatcaatcgaccatcgacggccttggcgatctcctccacgctcatcggaaccatggtgtttcaaactcctttacgattacgcttcgtcccgtatccacggacttaattgagattattggccacatgcagggcactgcgtatgttgtttttcctcacgccggcggccagcaccatggcgatggccaaggacatgtgcccgagtcggacgcggtcatacattgccggtgaatccgcagccatttcatccgattcgggtgtcgacgaggtcatggacatgtcatgttccgcaacgaatgcgtagcgtgtcttcaattcgttcaagcttgcgcttgcgttgacatcctccgtgcccagtacatccacgttcaccgattccaacgcatgctcggccaacgtgcggtcatccatggcgatgatcacggccgccacaccgtcttcggcgcacacggacagcgcgcgctgcatatcgaggatgcccagaggatagttcaggttcatggtacgtgtcatcgacgtggacccggatgcggtgattaccgccaccggattgcccagcatgtgcaggaattcggagagctgggacacgcctgcgtcgacggcctgctcatccgcaccggtcaccgcgaacaccgccatggcattggacggtccgccggccagaccgctggccagatcgccgagtacgcgatcgtcgaaatcgccgtagagcaacggtatatcggcattggcgatctgccctttggacgcgcgtggcagcaacgccgcataggcaccggcctgtgcggcatgcagtacatcgggttcctgctcatgcgtgcagatgaacagcgagccgggaatcacggtgtccacggcatcgctgagtgaggtaatggtgacattggtggcgaagggtggatcgacttcaaaaccgtaccgttcgaccagcattcccagggtcacccgctgggcgatggattcgctcactgcactcatgggctatcgcctttctcccctgatccttaccacgtgactggaatagcatttttgcgtggactggagacaggcacctcgtatttctgcataaggaactcacaaatctgtgcggaaacagggccggccgtcagaccgccgaacacaccattcggatccttcatcaccacggtgaccgcatagcgcgggttgtccgcgggaatcaccacggaataatcggagataatggacgagagcgtaccatccgagccctgcacctctgcggtaccggacttggcggccatgcggtaaccatcgaccttgacgaacttgttgtagccttccgccactgattccatcgcattcatcatgtccgatgcgaccttttcatccaccacgcgggtggcttcgcccttcttggtctcagtggtcttgccattggcatcggtggttgatttgatgatcgactgctgctgcttgacacccttgttcgcgatggtggccaccacgttgttgagctgcagggcgttgacggtgtagccctgaccaaacaggatggtgttgcgcgtacgcagatcccacgccgaagggttggtgagcagaccgctcgattcaccgggcaggttcagtccggtcggttgtccgatgccgaatttggtcaggtactcgtagcgttgctcatccggatagttctccccggccataatcatgccgacgttcgatgagttctgcagaatgccggcgagcgtccagcgctcagtgccatggtcgaatgagtccttgtaggtctggccctcctgtgtgatgtggtccgggaccgacaattgatcgctcatcttatgcagtcccatctgcagatagccggacatggagataaccttgcccaccgaaccaggctcgaaggtttcggacacggcccgagacgggctcatcttcgccgcatcggtaccagcctgtacttcatcgctatcggccagtgcgcgaatctccccgctctggacatcctgcaccacggcgatcgcccacgctgcaccatacttggattcggcctccttcaagacctttttgacataccattgcacatcacggtcaatggtcagggtgacatcgtcgccatttttggccgccaccgattcggtcatggtgccgggaatctcttcgccgccattaccacgctggtaggtttcatggccatcggttccggtaagcgtcttgttctcgacctgctcgatgccggcgacgccatcgccgttgtcgttcacgccgccaagcagcgcgcccatgagatcgccatccgcatacagtcgttcactgctcagctcaccccagacaataccgcccaggtgcaacgactcgatgctgcgcttgacctgcggagtcacatctttcttcagaatcacatactgcccggtaccggacagatcagcgcccagttccatggcgttcatatccaggactttggccagcagtcggcccacggccgccgctccggtagcgcccacgggtttgccgtcaatttcgtggcagtaatcacgggtgttgtcattgcaagtaatcggctcgaactcctgtgcagcctccggattggcgacgatagtataacgctccacgctttgagcgagcacggagccgttggcgtcgaggatacgcccacgcttggcgctcaacgtcacggtcagggtgcggttagccgtggccgcttgtgcggtttgacggccgccgatgagctgggtggaggccagctgaatcacgcatgccgacgccaccaacgccaatgcggcgccgatggcgatgcatttgaacgcgaaggtcttgaccttggcgaactctacgatgcgacgaatggtgttcactgggttccgcctttgttggactggtatccgcttaagtcgatggacactgatccctgctgcgggaccatgcccatgtcgctggccttgtcgggcaggttcgcgaccaattgatcgagtttggcctgatcgtcttcgatatcttgggtaagtctgttgatgttggtttcgatctgtgccgcctcaaacgagttctgcaccatctgggtacgcagcatcagcgcgccgaacaaggtgccgacgaggaagatcactgcgatggccacgtgcaccagcggtgcgcttcttgttctggtccattcgatgacccgtccgacgacattgccctgctcgtttccacgcgggttggagaccacccgcagctcaggtcgggaggaggactgatgcttggtgtgcggtcggttcgaggctggagccgcgttcgatcgaatgctacgtgcagttgccatatgctgttatcccctccttgtacgaattcgtgccgtgtttttggctctgcccggagacgcggagccttgtatcttgacgtcattcaggccctgcgcggtttgcgtaaagcgtttcctccatcgtgacggaatctcacggctgacttccaccgcccgcaaccgcaccgaagccgatctcgggttggctgcgatttcatgttcgtcggccttgatggcacctcgcgtgagatccgtgaaaaacggttgggcatccggcggtatgacaggcaggccagccggaacatccactcgcagcccttgtgccatgaacgatttgacggttttgtcttcgagcgaatgataggactccaccaccagtcgtcccccgacatgcagtcggttcgcggcctgcggcaatgtggaggcgagcttgtccaattcgccgttgacttcaatgcgcaacgcctggaagacgcgtttggcgggattgcccgccgggcggtgggcttgcggcaccacttcatcgaccagacggttgagctgtgcggtggtggtaaacggctccttgtctcgacgcgccacgatggcgcgggcgatctgacgcgagaaacgctcttcaccgtattccttgaatatgcggaccagttccgccgcatcataggtggcaagaatccgttcggccgtcaacggctggctgacgtccatgcgcatatccagcggcgcatcatgcgaataggagaagccacgatcggtttcgtcgatctgcaggctggataatcccagatccatgaatacggcgtccacgcgttcgatgtcttggtccgccaacacctgatcgagctgatcgaaggcggcatgcaccggaatgaatcgatcggcgagcccctcccgttccatacgttcggtggccagccccagcgcttcactgtcacggtcaatgccgatgagccgagcctgaggcgcggccttgaggaaggcgatggaatggccggcaaggcccagggtgcaatccactgcgatggcgttctcatgttccagggcaggtgccatcaggttcacgcaatcgtcaagcaataccggcagatgaatattcgccacatcaaccatcagaattccacctccggcaacacatcgtcagcaatatcggaatatccctcttccttctcggcgaggtaggactcccacgtgtccttattccacagttcggcacgggtgccaacgccgatcaccacgacgtcggaacccagattggcgtaatcgcgcagcatctgcggcaccagcacgcggccctgcttgtccggctgctggtcgacggcaccggaaaggaacacacgcaggtattcgcgggcggctttgtttcccaccgacacacgctgaatctgcgaggcgatacgtcgaaattcgtcgaacggcagcaggtacacgcaccgttcctggcctcgggccatgaccaggccctgccccagctgggagcggaatttggccggaagcgccatacggcccttggcatcgatcttcggcgtatatgttccgagaagcaatggcggcagaccagccatgagatcggccatagtggtggagccttgtgcgttggcatcagcgtcgcgaatcgtctgatcggcaaccatggctccacctccttcatcgttacgtgggatacacttcggccaactggctcaccactctaccccacgattccccatttctccccactcatgcacgatttgctcacccttttagggcaattaccgatggattgcgcgtgtcggccacgactgtcgcacgaatggacgctccgcacattcaatccacgtcgcgcaccccaccgaccgagcagcatggtgaattcacgctgaattcacctattccgggttgtccgcatcactgacgtagggggtgtgcggtaaatttgaatgccttaagtttttctgccccacggaaatggaacgaagagaacagcatgtcgagttacgcctcccagctgcatgaagagcagcaggccgtcgatcgcgcctatggacgattggatgatctgcgagccgaaatgtggcaacgcctggacaccgtacgcgccgccggctcccacggatcccccacgcaacgcagcgaacgagactcctttgccacaatgtacgaaaaccgcctcacgcaattgcgcagcgttgaggatcggctggtgtttggccgcctcgatgccaagaacggcgaccgtcattacatcggccgcatcggcctgtcgagcccggaccatgagccgattctgaccgactggcgtgccgaagccgcacgtcctttctatgaggcgaccccttccaatcacggcgacatcgtgatgcgcaggcatatcaccttgagtttccgcgaagtcgtgggcgttgaggatgaggtgcttgacgtgcattcagaccaggtcggccaggcgtcttccgccggcacattgaccggcgagggtgcgctgctggcttcgttgagctcacgccgcaccggcaagatgaccgatatcgtggccaccattcaggccgagcaggaccgcatcatccgctccgacatgaatcgcgccgtggtggtgcagggcggccccggcaccggcaagacggccgtggcgctccatcgcgccgcctacctgctgtacacgcaccggcgcacgctggaacgttccggcgtgctggttgttggccccagctcggcgttcctgcactacatcgatcaggtgctaccctccttgggcgagaccggcgtggtctcacgcaccatcagcgatctgattcccggcatcaccgccacggcggtcgactccccttatgcagccaagctcaagggcgatcgacgcatgacctccgtagtggccaatgccatcgccgcacgcgtgcgtgttcccgctgctctgccgacagtaaccattagcggcattcaggtaccaatgctggccactgatatcgagcaggcgcaggcggacgcgaagcgcacccgacaacctcataacaaggcccgcgagacctttatccgttcgatgctgaccagcatgcagaaccgttatgccgaacagcttgattacacgccggatcaggcggagctgaaccgcgcgatgtcgctgctacgtatgaacgagcaggttcgcaagaccctgaacctgtgctggctgccgatgaccgccccatggctcatcgatcagctgttcgcccatcccgaacgtctgaagtctctggctggttggctgaccgacaacgacatcgcggcacttgcccgccccaaaggctccccgttgacccgctccgatattccgctgctcgacgaagcaatggatatgctgggccccgatcccaaggcggtggcccgccagtccgccgccgacgcacgtcgtgccgccgaagagcagtatgccaaagacactctggccgcgaccggtctgggtggaggcatcgtctccagtcagatgctgctcgaccagatgaacggggacgacgctgagctgaccgcgcagcgggccgcggccgaccgtgaatggacctacgggcacatcgtggtcgatgaagcgcaggaattgaccgccatggactggcgtatgttgatccgccgttgcccctcccgctcgttcaccatcgtgggcgatgtggcgcagacttcggcgctgggtggcacccgacgctggagcaaatcgatgaaccgcctgttcggcgaaagccactgggatttgaacgagttgaccatcaactaccgtaatccgcaggaagtttccgaacttgcctcacgatttgccgaggaggaaggcctctacatctccacggtcaatgcggtgcgcaccatccccgattcggtgtcccgcaatgtggtgcccgacatgtcgtccttgctggaaacgacggccgagcaggcggcgcagcttgccgaacaattcgtttcggcagacggcaccggccgcatcgccgtcatctgtccggataatctcatcgccccggtgcgcgatgccgtgcgccgcaaactggctgtcattcttgacccggccgaatacgcaaggctcatcgagcagcccgaatgggatgagcaaatcagcgtctgcggcactgaaacggtcaagggtctggagttcgatgccgtcgtggtggtcgagcccggtctcatcgaggatgacgcgccgagccgcctggtcgccgcctcggacctgtacgtggcaatgaccaggccgacccagaaactggttatagttcggacaaaagcggacgaaaagtccctgaacatctaaggtatgaagcatgcccaaagcactgttattggaaaacattcaccccgatgcggccaaatcgctgcgtgatcacggtttcgaagtcgagaccatgaagggagccctgagcgaggacgaactcatcgatgcgctggatggcgtggacttggtgggcgtacgctccaagaccaacgtcacagcccgcgtgctggatgcgcgtcctacgctaagcgccatcggctgcttctgcatcggcaccaatcaggtcgatctggcacatgccggcaagcgtggcatcgccgtgttcaacgctccctactccaacacccgttccgtggtggaattggtgatctgcgacatcatctgcttgatgcgccgcattcccgcacacacgcatcacatcaagcatggcctgtgggacaagtccgcttccggctcgcatgaagtgcgaggcaagaccctcggcatcatcggctacggcaacatcggctcccagctgtcggtactggccgaggccctcggcatgcgcgtggtgttctacgacattgaggagaaactggcactgggcaatgcccaccgttgcgacaccctcaacgaactgctggaacagtccgatgccgtgaccctgcacgtggatggccgcaagtcgaacaccggattcttcggcgaagaccaattcgcccacatgaagcaggacgcgattttcattaacctttcgcgcggtttcgtcgccgatctgggagctctgaagcagcacctcgattccggccatctgtctggcgcggcggtcgacgtgttccccgttgaaccgaagaagagcggagatccgttcgagacctcactggccaatgaagacaatatgattctgactcctcatattggcggctccaccttggaagctcaggaatccatcggccatttcgtctctcagcgtcttgaggattactggttcaagggttctacctccttgtccgtgaacctaccacagatcaacctcggtgagtgcaagggtgtgtgccgtatcgcccatctgcacgacaatcttcctggtgtgctggctcatgtcaatcatgtgctcggcgaggagaacatcaacgtttccttccagtcgctggcaaccgaaggcgaacttggctatgtggtcaccgacgtggctcagacgcccagcgccgccacgcttgaagcactgcgcaacatcgaaggcaccattcgcatgcgtgtcatcagctgacgcagctcatcctcgattgatatgaaagagacccgtcatcatgacgggtctctttcataagtgctgggcttcatgattggctcgcaccatggtttgcgaatcactcgcatatcacggtgcatggcattcgcatattattcacgcaaaccatcaatggcgctttggaaatcctccagacctgcaaagttctggtacacactcgcgaatcgaaggtacgccaccacatccaagtcacgcaacggtttcaggatggctttgcccacttcatctgaggtgacttcggcaaggcctcgggagcgaagatcctcttcgactttctgtcccagcagcttcagatcctcttctctgaccggccgcccctgacaagctttgcgtacgccggaaatcactttgtctctactgaatggctccacgccacccgaacgtttagtgaccagcagcatactggtttccaccgtggtaaaacgcttgctgcatttcgggcatacgcgacgccgacggatggaatgaccgtcatcgctaatgcgcgtatcaatgactttggtgtcggggttctggcaaaaaggacaatgcatgctccccagaataacgtgtacgggcggaaaaaccatgccgctcgggtttcatttactcaaccggaacaataatgcgctgcccggcctgcaatgatccggactcaagattgttcaacgcaatcagctcatccaccgtttccgatacatcatgaccagcaggcgtgatagccgaagcatatgaccagagcgtatcccccggccgcacgatataactggtcacctgcgtggcccccgtatccgattgggcccgctgagcggtaagcgcgccgaaaccacaccaggcctgtatttagtcaagtcggtgtttcgtgtttcgtcactaatttttttcggttttcggcatgaggagtgccggccggtggtttgttttactggttgtccgtcttgccgaacatgagggcctggctgacgcgtcggctggggccggtgaattcgatgaggcgtccgtggtggacgatgcggtcgatgatcgcggcggcgagtttgtcgtcggcgaagatcgtccccatttgctgaactcgatgttcgtggtgaagatgatgctgcgccgctcgtagctgccggcgatgatctggtagaggaggcgggccccgtcgatgtcgaagggcacgtagccgaactcgtcgaggatgatcaggtcggcacgggcgaggtctttgagcaggttgtcgagggcgccgtcgcgtttggccttgccgagctggagcacgagctccgcggtctgccggaacctcacgctcctgccttgctcgatggcgagcatgcccagggcggtggccaggtgggtcttgccgcgtcccgtcttgccgtagaacacgaggtcctgcgccttggccacgaaatcgaggccggtcagctgctccttggtgtatccgtcgggcaggcgcacgttcgcgaagtcgtagccgtcgaggcttttgggcaccgggaaccgggcctggcgcatgagccttgcccgtttggaggcctccctgttggccagttccgtggcgagcatgcggtcgatggcgtccagttggcggggcgtggcccattcgagcgtttcgtcgatggtggcctgcgagatgaacaggctcctcgcccgctcgcgcagcgggccggggtcggtccgtccgttcttctggttcactcgtcctccttggtgtaggcgatgtcgtattcgctcaggtccacggggtcgtcgtaggccacgggtcccaggcccgaggcgtggcgtgccgcggccagacataccccggcccggtccgtgcctccggtggattcgaggatctcgagcatgccggccacggccgcccgccagccgctctcgccgtcggcgtgcagcagggcacgcaggctgtcgcgccgcgtggcctcgtcctgcgcgtcgatccattcgcgaagcgggtcgggcatcgcgtcgcgcacccggctgttgcgccaggccgccggccggtcgcacaacagcccgagctggctcgacgggtcgccgctgtcggtcggcttgtccccgtaggacctcggatgcgtgatcacgcgtttgccttcggcatcgaggatctccacctccagggccctcaggccgacgatcatctcatggccggcgtgttcgggtccggccgcgtaccggtggcggccctggacggtgacgtttccgtatttgtcggccttcatcctcgtccacgtgaccacgtcgaacggcttggcgggcaggggcagcagcgccttgcgatcatcctcgaacaggccggcctggctctcgcccttcctgtaatggtccttgtcccccagctcgagacagcggtcgggaaggcgcaggttgaagttgtcgaggctccacacgctgggcaccggcacgaacagccttcggcgcacggccccgaccctggcctcgaccgcgcccttctcgtggcccgagtacgggttgcagaacgagtactcgaacccgtaatgggcctggaacgcctggaacaggcgggtcaggcggatctcgtcgaaccgtcggcggcccacgccggcggcattgtcgtacacgatgcgccggggcaccccgcccagccattcgaacaggttaagcaaagcctgacacgtgcattccgcgttctccccgggcatcagctggcacggcgagatgttcgagtacgggaaatccaacacgaaatgccgcatccgcgtcacgacgccccggtagcgcacgtcgacctggccgaagtccgcctggcattcgcccggatgccacgacaggtccaggaaacccatctcgcgctccgccatgaactcacgcttcaaccgggccaccgtccgggtcaccgtcgacaacgacgcctccaccccgtactcgtcacgcaaccgctcgtggatgcgcgtcgccgtgtgacgttgcttgtgccaggtctcccggtcctcggcgagcatgccctcgatcacgggaatccactcgtcgagcaccgagccacggcgtctccttaccggaggcctggccgacaggtcgtcggccttgagatacttgcgcacggtcggctcgctgaccttctcgccgcgcgcgatcgaggcgacggactccccattcctgcgcctctgacggatagactgtattttgggcatgctgatcatttgcctttccggccctttcccgaatggattcgaagcaccatcaggctaaggcccacgggtggtcggcatgcctttctgcctaaacccgaaaaaactacgtgactaaaacctcaactccctattgaacacatacaccaggccagcgccaaggcgaccatcactgcgataatcttcccacgcacattccggtggaacgttccagcatgctgcatagctacacgtgcgctacgggccggggccatcaccattgaaccagtcatcacgaccacctctctcgaacagatgttctatcgaacaactgttcttataatgacacaaacgttcgacacggtcaagtcgaaactcgaacagatgtttgatttcacacgaacaacacgttatgctggtgacataacgaaaggagccctgacgtgagcaccattcccttctccccaagcagaagccggacgagtccaccctgaccgaccgccagcgcaaagtgttggacgccattcgcacgcatatcgacgaacaaggcttcgctccctctttccgggaaatcggaaatgccgccgggctcaaaagtccgtcttcggtcaagcatcagctacaagttttggaagacaagggcttcatccgcatgaacgcgaacaagggtcgcgccatcgaggtggtggcaggatccgccccgaatgccgaaaagccctcccaagccagcgaagaggcaaccagcaccagtaatgtggcggagatataccaattccccgccgaagccattgccgaatcacacgatgtgccgctcgttggccgtattgccgccggcgtgccaattaccgccgaacagcatgtggacgacgtcatgcgtctgccggaacggctgaccggctccggcaccctgttcatgctggaagtccacggcgattccatggtggatgccgctatctgcgatggcgactatgtggtggtgcgcgaacagaattccgccgtcaacggagatatcgtcgccgctctgctggacgacgaggccacggtgaagaccttccgcaaggaaaacggccatgtctggctgatgccgcacaaccccgcatactcgcccatcgacggcacacatgccacgattatgggcaaggtggtcaccgtgctgcgcaaattgtagcctgttcgccaccagctgatcagcgtgcaccgaatcgcgctggtcgtgctatagtcacgcacagcttacgaaaccccggcctcgcgccggggtttcgtcgtattcagaccatatcgcaaatggaaatgagaagcggtttcaactcgatagagcgaaggagtacatatggctcatacccatgcacccgcaccatccacatccgtaaaccctgccgcgcaccagcgtaggctgattgccacgttgaccgtaaccggttcggtcttcctcatcgaagtggtgtcggctgtcttaaccggctcattggccctgctggtggatgccggtcatatgctcaccgacatgtccgtgctggcggcatccacaatcaccgccatactgatgcgccgcaagcccagcaacactcgtacttggggctgggccaggcttgaggtgctcaccgctgccgcaggtgccgtggtgctgctcgtcgttggcatctatgcgttgatggaggccggcatgcgtctgttcggcggttccaaagcggaaatcgacgatatcggcttgctgctgttcgtgggcattctgggtcttgccgcaaatatcatctcgattttcatccttgcctcgcagcgcgaagacaacatgaatatgaaggccgcgttcctcgaggtgatgaatgacgcacttggctcggtggccgtggtggcctctgccctggtaatgatctccaccggatggaatggcttcgacgccgtggccggtgccgtcatcgcactgatgatgattccgcgcgccatcaagttgctgcacaacgcggtcaaggtgctgctggaggaaacaccggatggacttgacctcgataaggtacgcgaacatctggaagacgtgccgcatgtgcttgccgtgcatgacctccacgccagcacggtgtccaccggcatgccgattctgatggcccacgtggtagttgacaaagacctcaccatggaagatgccgccacaatcctcacccaactgcaggattgcctgcgcgagcacttcccggtctcggtcccccacaccaccttccagctcgagcccgagggctatagctccccctcctccaacgaaatccacgaataaaaaatgctcccaacgggagcattcagcagggtataaaaaatcgctgtacgtgtgcgattttcgtgccgcacaagttgaaggcctacaaaggtaggtcgagtcttgtgcggtgcgaaaggcgctccgtacagcgattttttatcagaagccgaactgggcggcggtttccttcagcgtctcggcagagcgcttcagagcggcgagctccttgtcggagaccggggtgttgatggtgttgttgacgccctgacggttgaggagggtcggcacggacatgcagatgtcggagatgccgtggaagtccttgagcatggagctcacgggcaggatgcggttggtgtcgtgcaggacggcttcgatgatgtcgacgccggacatgccgatggcgtagttggtggcacccttaccgttgatgatcttgtaagcggcgttcttgacttcctggtggatctcctcgcgcttgtcggcgtcgagcggatcgtggccgggcagcggggtccagtcgcacatggggacgccaccgatggtggcggactcccacagcgggacttcggagtcgccgtgctcgccggcgatgtaggcgtgcacgttcttgacgttgacgccggtctgctgggcaatcaggaagcgcagacgagcggagtccaggttggtgccggaaccgaagatctggttctcgggcagaccggtgagcttctgagccacgtgggtagcgatgtcgaccgggttggtgatgagcatgtagatggcgttcggagccaccttgaccaggttcggcatgatggccttgaggatgttgacggtagcgccaacgagctcaagacgagactgacccggcttctgacgcggaccagcggtgatgacgaccatgtcggcgtcgcggcagatctcaggatcgtcggaaccgtcgatggacacggtcgggtagaagctggagccatgctgcatgtcgagcacttcggcttccacgcgctccttggcgatgtcttcaagcacgatctcgcgagcgatgccacgctgggcagcggcgaaggcgagggtggagccaacggcaccggcaccaataacagcaagcttcgtgggcttaacggtagtttccgccatgatggatgaacctctcttcaaaggcggtctgctgatgaatggcaggccttgtaactaacgtcttcactctataaacccgctaagacgttttgctaccagcacaccaccctgtttgataaccgtatggtaatgttttcaacggttgttagcgctcacgaatatactgtgatgtttatcacgttagtcaatggactgttcgaccacctgagcggcaagatgggcgtcaacgtccgcttcaagctgtatgccatcatcgcggtactccaccttgtctaccttgccgtattcgcgtacacgagagatcagggagccagcggtatacggcagcagagcgttgacatgcacatgcgggaccggcagcagactttcgaccgcggtacgcagctcgtccaatccctcaccggtataggcggagacgatgaacgcatctggctgcagcgcggcgagtcgttcacgagtcgcctcgtccgcctgatcggccttgttgaatacgagaatacgcggaatcgaggccgtgccttcgatgtccgccaacacgtcattgaccgcgtcgacctgagagaacgggtcagggtgggagccatcgaccacatgcaggatcacgtcggcctcggccacctcttccagggtggatttgaacgcctcgaccagctgggtgggcaggcggcgcacgaagccgaccgtgtccacgtaggcgtaagcgcgtccgtcgcgggttttggcgcggcgcacggccgtgtccaatgtggcgaacagcgcgttttccaccagttcggccgaaccggtcagacggttggtcaacgaggatttgccggcgttcgtgtagccgaccacggccactgtgggcaggccgaagcgacggcgtgaaccgcgcttgacctcacgtgccggggccatctcacgaatctgacggcgcagtctggcgatacgcgtgcgaattacacgacggtccatttcgattttggtctcgcccgggcctcgcgatccgatgcccgcatccgcgccggccgcgcgaccgccggcctgacgggacagcgaaccaccccaaccacgcagtcggggcagcatgtattcgagctgcgccaactccacctgcgccttaccttcacgcgaggtggcgtgctgggcgaagatgtccagaatcaccgcggtgcgatccaccaccttgactttggcggcgtcctccaatgcacggcgctgtgacggcggcaggtcgtcgtccacgataatcgtatcggcttcctcacgcgccacgatgccggcaatctccttggctttgccggaaccaacgtacgtggctgcatccggcttggagcgatgctgcagcaaaccatcgcataccaccgcaccggcggtttcggcgagcgccgccaactctctcaatgattcctcggccttggcttgcgtggtgacggcggacgaccagacgccgacgagcaccacacgttccagacgcaccttgcggtattcgacttcggtgacgtcctgcagctcgccgagaccggcgacatgcttgagctcgttgcgggcctcgcgctcctcccattcctggttggcgtcctcatgccagccggtcgcgcgctggctgtcgtcgagcaacacttcggactgctcggccagcacaccttcaggggtaacgtcgttgttgccgcggttgatgtcggtgtactgggtgttgtcggtcaagtgcgcctcgtttggttggaatggttcacgattcttctatggtcctttattatcatcacatgaggtgacatgctggcatagatcggcacgtaccggcataggccggctgatacaggtcggcatacgagagcggcgaatcccgcagaaatggagcgaccatggcagaacagtatttctctgcggaacccgcatcgaaggatgtgcgccgcacattgaacgtaacgttgcgcggccatgaggcgaccgctcaggtgtcgaacggcgtgttctccggctcgcgcgtggacctcggtacgtcggtattgctgaagcatgcgcccgagccgccgcttaccggcgattttctggatttgggctgcggctggggccctatcgccctgacattggcgtttgagtcgcccgaagcgaacgtgtgggcggtggatgtcaacgagcgcgcggtggacctgacccatgccaacgcacaggcgaacggccacacgaacattcatacggctcaggtggacgagtccagcactcccctgcctgccgagaaccagccggcgttctgcgagacggtgccgagcgacctcacgtttgatgtgatttggtcgaacccaccgatccgagtcggcaaggaagcgctgcatacattgcttatggcttggctgccgaagctcaaggtgggcggtgccgcctatctcgtagtgcagaagaatctcggttccgattcgctgatcccctggctggacgatgcgctcggcgaggggttcactgcgagcaaatacgcgagctccaagggcttccgtatcattgaagttcgtcatgaaatatgagtatcccgcagaacttcccgtatctgccgcgcgtgatgagatagccagcgcggtcaaacgttcccaagtcgttattgtgtccggccagaccggttcgggcaaaaccacacagctgccgaaaatcctgcttgagcttggccgtggcacgcacggcaagcagatcgtgcacacccagcctcgccgtatcgccgcacgcacggtggccgaacgtatcgcctcggagatgggcgtgaagctcggtgacgaggtcggctatcaggtgcgtttcaccgacgaaagctcgcccggcacacgattgagggtcgtgaccgacggtattctgctcgcccagatccagcgcgatccgaaactcacccgatacgatacgatcatcatcgacgaggcgcatgagcgcagtcttaacatcgactttctgctcggctatctgacggcactgctgcctcagcgccgcgatctgaagctcatcattacctccgcgaccatcgattcggtcaagttccaggagcatttcgagcacgccttgcatgagaaggtgccggtaatcgaggtttccggccgcaccttccccgtgcaggtggtctacgagccgcttggcaccgcgcccgcgttgatgcgcgaagtgccgggattcgcggtgggcgcccgccccggcgacgccgattacgacgagctggccagcgccatcgcggaatccgattccgaccggccccgcggccggtccggtgcctcctatgccgatgacggcatcaccgatatgcctaccgccgtggctcgagcctgcgccgagctggtgattcactcctcccacgagcgcggtccccgcgatattctggtcttcgcctccggcgagcgcgacatccacgagttcgaggccgcactgcggcatcattacggcccgcgcgccgacgacatgcgccggccggatgccatcgagatcatgccgctgttcgcgcgactgtccgccgccgaccagcataaggtgtttgaatcgcaccttcaccagcgcatcgtcattgccaccaatgtggctgagacctcgctgaccgtgcccggtatccggtatgtggtggaccccggttccgcccgtatctcccggtattcgaagaccgcaaaggttcagcgtctgccgatcgagccgatcagccaggccagtgccgaccagaggtccggccgatgcggccgtgtggccgacggcatcgcgatccgcctgtattcgcgtgaggattacgagacccgtccgcgcttcaccgagccggaaatcctgcgtacctcgctgggtgccgtggtactccacatgctgtcggtgggcgtggcccgcacggccgaggacgtcacgaacttcgggttcatcgatccgccggatatgaaggccgtgtcggacggtttcaatgagctcaccgagctcaaggccatcggccgcaagcgcggcgaggtgacgctcacccataccggtcgtcagctggcgcgcatccccatcgacgtgcgtctgggacgtatggttatcgaggccgcgaaaaccggttcgccgaatcttctggcccaggtgctcgtggtcgtggcgttcctgagcttgcaggacccacgtgaacgcccggacgacaagcgtgaggatgccgaccgcatccacaaccggtatgcggatgagacctccgacttcctgacggccctgaatatctgggaccgcgtgttccaagcagacggcgacccgagcaacaacgcgctgcgccgtatctgcaaaaccgagtatttcagctggctgaggatgcgccagtggaaagatctcgtctcccagctacgccagatgtgcaaggagctgaagttcaaggtcggcgacccgctgcccgcctcccgcccaggcttggagatccgccagctgccgttgaatcagcaggccgcgcattcgctgtgctgcgcgtgggatgcggacggcatccacaagtcgatgctcgccggattgctgtcgatgatgggcatgcaggtggtgcgcgagcccaaggcctccgatttcgcggggctgaccggtgcggcgcgcgcccgtgcgatgaaacgcgcccagaagcagtcgaagaacgattatcagggcgcacgcggcacccgtttcgccctgttccccgcttccgccgtggccaagaagaccccgtcatgggtgatgagcaccgaactggtggaaacctctcgcctgtgggcccgctattcggcggccatcgaccccgcgtgggccgaaccgttggccggccaattgacccgcaccacgtatgcggagccgcactggtcgggttcgcgtggctcggctgtggccaccgcgcgcgtgctgctgtatggtctgccgatcgtacaggaccgtgccgtgcagtggggacgcatcaatccacttgaggcgcgcgacttcctgattcgccagggtctggtcgagggcgatattcagcagcgtttcagttacgacgacttcgtgggcaaaaaccgcgacattctcgaggatgccgccgatgatgcgagccgcacccgccagctggcggataccgtgtccgacgaggatctgttcgacttctacaacgcggtcattcccaacgatgtgaccagcgtggccgatctggcgaaatggtggaagtccgagcatgaccgtcagccgaatctgcttgatttcgacccggccaaggtggagcgtctggcatccagcgattcggtgagtctggacgattaccccgaccattggcatacgaccggatcggacggccaacccatcgacctgcgtctgagctacgtgtacgatccggccgacccggccgacggcgtcaccgtgcatgtgccgttgaaggcgctctcgcgtatcacgcccgaccagttcacatggaatgtgccgggtctgttggatgagctgatcctgtcgatgatcaaggcgctgcccaagcagctgcgcgtccagttcgtgccggccccggatgccgcgcgtgcgattcgtgactggatcgacgagcattacccggatctgccgggctcgggctcgcagcagaagccgaatctgccgccggtggatgaggatggcacgaccgttggctggcccgatctggcacatgtgttcaccaaggcggccatcgccaccaagggtgcgcagattcatcccgaagtgttggggccggaactggtcgagcgtctttccccgtatctcagagtcacgttctcggtggagcagcaactgccggccggcaagcaccctcgtggacgccggcatgcgcgcggccccatcaaggtgctgggtgtgtccaaggatctgaaggcgctgcaacgcaagttcgccgcgcaggcggaggcgtcggcccgtcaaatggtcaagaagcaggccgatcaggctggagaacagggcaagctggtcagtcaggcgaacctgttgcataaggcgggtgccaccaccgagtcccgggccacgatgctctggcgtggcgcattggatgcgttgcgattgccggccgaacgcatttcgtcgcgctggctgggtaccgaggcgttgatgctggcttctgctccgtacaagtccaccaaggatctggtcgaagacctgcagctggccacggtcaaacggctgatgccgaatgtcgacaggctctcggacgatgaggcgttagccaatgcggtgctcgatgtgcgcgaagtgtacgaggacaccgtctatcaggtggcgcatgacgtgatcgccgtgctcaaggcttatgccgaggtcgacaaggccactggcggcaaggctgatctgccgatgctttcggtgttgcagtcgattcgcgaccatatcgccacgctcgtctaccccggattcatcgggcgcactcccccggatgcgctgaagtcgttgagccgatatttgagagccgatctgagccgactcaataaggcgaaaaccgataagaaccgtgatgtcaagtgggcttggcaggccgacgaggcccgtcaggtggttgataaggcgttggcccgtgccaaggcggagccggccggcccgaagcatgaggcattgatgaagcaggccgaacaggcccgttggatgcttgaagagttctacgtgtccctatgggcgcaggagcttggcaccaaggggccggcttcgctcaaccgtatcaagaaagcgctggcgtgaccggacggcaaacaagtcgccaggccacgcgccagcgcacgcgcaagccgtcatcacagcgtgggcaagtgcgcggatgcctcggcaatcggaacaggaaacgcaatcgtaggcacggtccgatcaatgctctgaagcgttcctggcgtaaggcgaactggccgacccgtatcaagatggtgctgattcccacggtggcggtggtcgttgtcgtagcgctggtggccgggctggttcgtttcacaaactggcgggcacaggttcgcgcagccgaggcggcacagctggaactgacgcgaacatacgatttcaatccgggcaatattatttcggatggtcagttcttcaacggttcggcgatgagtcaggccgaagtccaatcgtttttggacacacaaggtggctcgctggccgcgatgaccttcgacacatcgaacgagtcaggcgaaggcctgtgcgcggactatacaggcaccaaaggcgagtcggcggcggcaatcatcgaccagtcggcccgcgcctgcaaggtgagccagaaagtgctgctcaccgtgatgcagaaggagcagcatctggtcactgccgtcgatcccagcgactatcagcttatggcggcgatggggttgaactgtccggataccgccgactgcgatcccgcctatgccggattctttcggcaggtgtatggcgcggccaagcggtaccgttactatctcgagcacgaggaacagtacgggtatacggcgcacaatctcaactacatccaatatcatccgaacgcggcatgcggcggcgcacaagtgtatatcgagaacaaggcgaccgccctgctctacatctatacgccctaccagccgaacatcgccgcactggccgctggcaacggtaccggcgattcctgctccagttatggcaaccgcaacttcgcgcttatctacaccagctggttcggttcgccgcgaagctgataacggcagctgaccggtcttgtccgattggactcggccaacactgtcagcgttcgacgtatggacgcagcagggtcgtggcgccaaccgccagcagcgaggcgaaagccagcagacacaggcagacggcctgcacgcagtagatcggtcgaatgtgggtcaatggttccacgccatgacctttgtcggccagcttgccgccgtacaggttgctccacaggcaggcgcagccgtaaatcaccaagccgatgctgatatagcgttcgggcacgccgatttcgtcgcgcatgatcggcgaaagatacgtgtagaagacataggaggcggctgcgccgaagaccacatccgccacgccgagctggatgcggcggtcgaagaacaggcggaattgcctcaggaaaccgatcttcgccggatgcgagttgcgtggcagagacactgccatcgatgccatcagcacggcggtgagcaccgagaccaaggcaaaggtgacacgccaaccaaaggtatcggccacccaagtgccggccggtacgcgcggtgttcgcaggtgcgttcgtcatgggtgctctcttgagtgctctcgctcgtactacaagctgattcgtcggttatgtcaatcgttttttcgtatcaactcagcgacaacgttattcccacctctgcccactacccaccaccacgacacgccatagaaaaccccgccgatgaccaatcatcgacggggtttggcacatgtgcaacgcttgcgattacagcttcggcagatacttcttcagctcgtaaggcgtgacctgctggttgtactcctcccattcctggtgcttgttgtccaggaagtagccgaaggcgtgttcgccgagcacgtcggccacgaagtcggatttctccatgatcttcagcgcctcgtccagcgagcgcggcagcggctgaatgcccatagcctgacgttcgccgtcggtgagctcccacacgtcatcactggtaggctcgcccaactgcatctgcttatcgataccgtcgagaccggcggccagcagcaccgagtaggcaaggtatgggttggccaccgggtcgagcgcacggaactccatgcgcgcggagttgcccttgcccggcttgtactgcgggatacgcagcagcgcggaacggttgttgtggccccagcagatgtagcttggtgcctcgttaccgccccacaggcgcttgtacgagttgacgtactggtcggtgaccgcgcagatttcggccgcatggtacaggatgccggcggcgaactggcgggcggtcagggacatgttgaactcctgaccggcctcgtagaaggcgttggaatcgccttcgaacaggctcaggtgcgtgtgcatgccggaaccgggcgcgtcggccaggggcttgggcatgaagctggcgtgaatgccacgctccaaggaaatctccttgaccaccgtacggaatgtcatgatgttgtcggccatggtgagcgcgtccgcgtatcgcagatcgatctcgttctggcctggccccgcctcatggtgcgagtattccaccgagatgcccatttgctcgagcatgttcacggtggcacggcggaagtccatgcctgggctgcgcggcacgtggtcgaagtagccgccctcgtcgatcggggtcggggccttggaccagtcgtcctggctttcgaacaggtagaactcgatttccggatgcacgtagaacgtgaagcccttgtccttggctttggcgagcgtgcgcttcaacacgtgacgtggatcgccgagcgaaggctcgccgtccggggtcagaatgtcgcagaacatgcgggcggtaccttgcgggccaccgcgccacggcaggatctggaacgtcgagggatcgggttgaacgatcatatcgtcttcggacacgcgggtcatgccctcgatggcggaaccgtcgaagccgagaccctcctcaaacgcggcttccagttcggccggagcaatcgccacggacttcagtgttcccaacacgtccgtgaaccacagacgaataaagcgcacgtcgcgttcttcgaccgtgcgcagcgcaaactcctgctgtttatccatagtcgcctatcgttccataaccgtgttacgaagggcgttaacatctcactgttcgtcacctgcgagtcgcgagatttcatcaacatgccccggtccgcatgtcaggcatggttcaggcccatgccggcacggcactatggtagtgactatgagcgaagatcatctcaccccatccgccaatccgcccgtcgacgtgaccagctggacgcaggccaccgacccgcgcgaccgttcgcgcgccggcatcgccactcgtaccaaggcgccgctggacgcacatgccatatggaaggtcaaggagggccggcgtgaggcgatcagccttttggaggagcagtccgcgattcgcgtaccggatctgattccgctgcgttacaagcgtatgagcgccagccccttcaccttctaccggggcaccgtgctcatcatgaccaatgacctggcttccacgccagtcactggcattccggtgcagtgcgtgggcgacgcgcatatcggcaatttcggcattttccgctccccttccgcccgtctggtgttcgatatcaatgatttcgacgaaaccgctatcggcccgtgggaatgggatctgaaacgtctcgccgcctcggtggagatctgcggacgcgccaacaaaatcaaggagaaggaccgtcgcgccgccgtggtccagtgcgtacacacgtaccgcacacgcatgaagtggttctccgaaatggattaccttgacgcgtggtatgagcacctggacgtggaggagacgctcgaccgcttcgagaccaccggttccaaacgcagccgtgtgctgcgtgaggcggccatgaaggcgctgctgaaggataacgacgcggcggcggccaaactgtgccgttatgagagcggcaagctcaggttcaaatccaatccgcccgagctggtgccgatcaatcagctggatgattacgccgacttggatgcgttgcaggcacgtatagacacgctgttcgagagctaccggcattccctgtacgacgatcgccgttgggtgttcgatcatttgcgctatcaggatgcagcccgcaaggtggtgggcgtgggctcggtgggccagcgcgcgtggacgtcggtgtggatcgcgcgtgatatcgacgatccgatgatgattcagatgaaggaggccacgtattccgtgctcgagcattactgcggcgcgtcgccgtacgccacgcacggtgagcgcgtggttcaggggcagaagctgattcagaatacggccgatgtgctgttgggttggtcgagctttatggccgaggatggccgaccgcgcgactattacgtgcgccagttgtggaatggcaaggggtcgattgatatcgacaatctcaacgcttcgggattgagcgatctgtcacgcatgtgcgcatggtcgttggcgcacgcccacgcccgcaccggcgattcgattgcgatcgccaattacatgggtggcaccgacgaattcgatcaggccatcgcctcattcgccgtcagctacgccgaacagaatgatgaagactacgccgtcttcaaaaagctcctcaaatccggcgacctcccttgctgagccgttaagcggacagcccattgggctgtccgtaggaggggtctgagtgaagcgatagctgagcgaaggtagattaacagtctcgctaaggcgagtcctttgcctacttcgctacttcaagcgcttcctggagcgtgaacgcacgtgcatagagggacttgccgaggatggcagaatcaacaccaatttcagccagttccttgatggcgcgcaaatcgtccagcttggagataccaccggaagccgtgaccttggcgtcggtgcgttcagcgacttcactcagcaattgaatgttcgggccggacatcatgccgtccttagccacgtcggttaccacgtaacgcgagcagcccacggagtcaaggaacttcatggtctcaaacaggtcgccgccttcgcgcgtccagccgcgcgccgccagtgtgtgaccgcgcacatccagaccaacagccacgcggtcgccgtacttcttgatgaccgaggcggtccaatccggattctccaaagcggcggtgccgatgttcactcgggcggcaccggcctcaagggccgcgtccaacgaagcgtcatcgcgcacgccgccggacagttcgatgttcacgcggtcgccgagctcatgaacgatttctcgcagctgatcgcgattgttgcccgtaccgaaagcggcatcaaggtcgaccaggtgaatccattcggcaccggcctcaacccaagtacgggcggcctcgaacggcgaaccgtaatcggtttcggaaccggattcgccttggcgcaggcgcacggccttgccatcgcgtacatcgacggcgggcagcagagtcaacgacataagaagagcctttcttcagttacttatacacaatttgagctccctcgtcagagggagcttcatgcttttttacagcgtggcgatccagttcttgaggagctgggagccagcgtccccggacttttccgggtggaattgcgtggcggacagcgggccgtgttcgtaggcggccacaaagcgcgatcggccgtacgagcaccagctcacgcgttcgggcgaatcgctcagatcgatgtcgaagcgggacgtatccgccggcttcacttccatcgcggcgtaggagtgcacgaagtagaaccgttcgttctccacgccgttgagcagcaccgaatcggggacggcctcgatcgtgtcccatcccatgtgaggcaccacgtcggcgtccagcaggttcaccgaaccgccgatcagtccgatgcctgcggcatgggcaccgtgctccagaccgtgttcgaacatgatctgctcgcccacgcacacgccgagcaccgggcggccagcgcggatgcgatcatagatcacacggtcgccgtcgaccttcttcagtccttccatacatgcggcgaacgcacccacgcccggcacgactaggccgtcggcctccaacgactgccggtagtcggaggtgagggtggtgtcgacgccaagattggcgagcgcacgcaccatggaacgtacattgccgaaaccgtaatcgaaaacaaccgctgtggtcatctgctctcctatcccctactggtttggttggcgtctattcgatgcgggagccgcgcccgccacgtccgcgcctagtgtggttggcgagaatctgcatcgcctgatcatggtcgagtccagcggaatccaccacttcgaacccttgggtcttgagttggttcagggttacgatgccgagcatcaggtcctcgacgaagcgcggtgtggaggtgaacagcacgggcggcgcgaaactctggccggcctctccctgcacgtacatggccacttcgagcttgtcggcacggttgactgcaagaatcacggccatgccggataccacggtggtcaggtccttggctgcggcttccgggccgtcgccgttcagattcttcagcaccgcgacggccccctgattggcaccgatgcatgcggcggagatgtccgacagctggcagaacgcggccaacagttcggcggaggcaagacgggtaacgatcagcgccaccttcgccttgttacccaacagtccagcgagttcgttgtcgaagccgagcgaggggtcgaccacgtcggccatggcctcgttcaccgcatccgcaacggacccggtgacgtcgtcggtcataggctggccggaatcagcggaagccttatcagccgtatcatcattcgcgtcggaatcggacttcgctgaagcagcgtccgctgttttatcggcatcactggtatcactgacatcgccggataccgaatcgtccgcgaattctttctcgaatccggcgagcgcagcctcaagctcctcgtcggagaagtgcgattcgtccggatcgaacttgtcgtcggtcatcacagggctcccttggtgctgggcacgccgtctacacgcgggtcgatttccacggcgaagcgcagcgcacgggccagcgccttgaattcggcttcagcgatgtggtgcgggtcgcggccggcgagcacctgcatgtgcaggcagatgccggcgtggaaggcgatggattccatgacgtggcggaccagcgagccggtgaaatggccgccgatcatgcagaattcgtagccttcgggctcgccgctgcacacgcagtacgggcggccggaaatgtcgaccacggccttggccagcgcctcgtcgagcggcacggtggcgtcggcgaagcggcggatgcctttcttgtcgccgagagcctgcttcagagcttcgccgaacacgatggccgtatcttccacagtgtggtgcacgtcgatgtcggtgtcaccgtgggcgtggatggtcaggtcgatcagcgaatgcttgccgagcgcggtcatcatatggttgtagaacggcacggatgtatcgatatcggttttgccggtgccgtcgaggttcagttcgaggtcgatgtgtgattcgctggtttcgcggacgatgtgcgcggttcttgccatcatgtctcctgtgtgattcgtcatattggattgcggcgggactcgaatcgcttcgggtctcgccgcaatcggaaagaaatgtcccttatgctgcttccactatacgaagcacttcaacaagggcgttacggaaggtttccatctcctcgtcggtgcccatgcacacgcgcagccaaccgtccggtccgaccacacggatgagtacgccgcgcttcaggagctcgtcgaagatggcttcacgcttgtcgaagtgcccgccgaacagcaggaagttcgagccggattcggccacttcaagcggctggtccttgtaggtctgttccttgagccatgcggcggtggcctcgcgggtttcgcgcaggtgctcgacacggctcagctgctcgtcggtgtgttcgaaggcggccagtgcggcggcctgagtcacggcggacaggtggtacggcatacgtacgatacgcacgcagtcgatgatgcccttggacgcggccaggtagccgactcgcgcaccggcgaaggcgaaggccttgctcatggtgcggctgacggccaagttcgggtggtccttgatcaggctcacggcgctcggggtgccgggcttgcggaattccacgtacgcttcgtcgatgacgagaatcgggtgcacgccctcgcccgcgccgaccacttcagcggtttcgcaggcggcgagaatacgttcgatatcctccatcggcaacggggtgccggtcgggttgtttgggctagtgagcagcaccatcgagggcttgacctcggcgatggcctcaagtaccttgtcgacgttcagcgtgaagtcggcgttgcggtgggcgagcttccaaccggtgaaggtgtcgcgggcgtactccgggtacatggagtacgtcgggtcggcaccgagtgcggtgcggcccgggccaccgaaagcctggaacagctggagcatgatctcgttggagccgttggcaccccacagctcgtccacgtccagacgggtaccggattcgcgggccaggtaatcggagaatgcctgacgcaattcgatgtgctcacggtccgggtatcggttgagtgtgggggcgatttcacgcacacgcttggcgatggtgtcgcatacggccgggtccggcgcatacgggttctcgttgacgttcaggcacaccggcacgtccagctggggagcgccgtacggctcctcaccgatcaggtcgttgcgcagcggcaggtttgcaggaatcgagctcatcgcagaccggcttccttctcctgctcgcgcagggtggccttgtcatacggatccttgacgaagcgggagagcacgcactcgccgtgggcgggcaggtcctcggataccgcgaaggcgttgatgcgggcggcgagggccttgaggccttcctcgtcgtattcgatgacttcgaccggcttcatgaaggtgtgcacgccgaggcctgcggcgaagcgggcggtgccgccggtgggcagcacgtggttggagccggacatgtagtcgcccagcggcaccggggagtacggaccgcggaagatggcaccggcgttcttgatgcgcttgacgaccgcatcggcatccttggtctgaatctcaaggtgttcggcggcgtaggcgttggccgcgtcgatggactggtcgagaccgccggtcagcacgatggcagactgggtgccggacagcgacgtgtggacacgctcggcgtgctcggtacgcggcacgcggtacttgaggctctcctgcaccttgtcggcaatctcggtggagtcggtgaacagcacggaaccggcgagctcatcgtgctcggcctggccgatgaggtcggcggccagcaggctcgggttggcggtttcgtcggcgatgatgccgatttcggtggggccggcaaccgcgtcaatgcccacgaatgcggagaccagcgacttggcggtggccacgaagatgttgcccgggccggtgatcttgtcaaccggatcgcacaggatgtcgccgtcctgcggctcgctgcccttggcgccgtatgcgaacatggcaatggcctgagcgccgccgaccgcgtatacctcgtcaacaccgaggatggcgcaggtggcgaggatggtcttgttcggcaggccttcctcattgtcgcgggcgggcggggtggcgatggccagcgattcgacgccggcggcctgggccggcacagcgttcatgatgacggagctcgggtagacggccttgccgccgggcacatacaggccgacgcgctgaatcggaatccagcgttcggccacgcgggcgccttcggcgaggtcggtgtagaagtccttcggcacctggttggcggccacggcgcgggcgcggcgcaccgattcctcgatggcggcgcgcacttcggggtcgagcgtggtcagggcgtccttgatcgcctcgaccggcacgcgcaggttcttgggacgcacgtgatcgaacttctcctcgaagtcgcgcagggcagcggcgccgcgttctttgacatcgtccagaatcggacgcaccaaatcggtggcttcggaagtacccattgcagcacgcggcatcgcggcaagcagttcggcacgggacaggttctgaccacgcaggtcaatgattcgcatgatgttctcactcataacgccccatcgtagcaatgtgcgaggcctaagcggcgaggaacgcccatgttcacccgtatcgtgagattatcgtgcgtgatgtgggttcgtgatacaggttattgacgcacgccaaatgcccgagcggtctcatcgataatcggcatgtcatgcacggcgacgtgactcacttcggaccatcgcgggccaatggctaattgctcaaccaaggcttgcactgcgtcgctgctgccttgtgcttccagctcaaccgagccatcgcggcaattacgcacccagccccgtacaccaagccgacgtgcctgagtcaccgtaaaataacggaatcccacgccttgcaccagtccggtgaccactatatgtttgcggaccaaattcgccgattgcctcatgatgctcagttcctaatccatcgttcgcagcattgggtagaggctcaggaatcgccggtatgcgtcggcatatgtgcgtgcggtgtcaggattcggctggtatacagtgcattcgcatactgattgcagcaggtctggtacattgaataccaacgaggccattgccactgctggcagaatatcggcattggcgaacacttcaataggatgctccaacacatcggccagaatctggcaccacgcattttctctggctccgccgccaatcagggaaatctcggtgggtttggcgtcaaaactttccataccttgacgaatggagaaggccacaccctcaagcgcggcacgcatcatgtctgccttggcggtgtctggatcgaggcccacataggcaccgcgaatattcggattcataacagggaatcgctcccccaccagatatggcaggcatagcacaccgttggagccgggtttggatgtttcgataagacgatgcgcctctacgtaatcgccatcggagaatacgccggtaacccatttatgcacgtcaccggcgttgaggaatggcacggcattcacgaagccttcttccacgccaaatgccagattcgcagcacctggcttgtcagtgaacggctcgggcgaaacggtggcgatccagcctgaggtgccgatattgatgttgtattgaccagggtggctgacaccgctggcaagtgtggtggcacccgcgtctccaatgcccgcgtataccgcagttccggcggaaaaaccggtgcgttgtgcagcggattccgtcactgtgccaatgttgtcttgcggattgtgcaggtgtggcaatatggtcatgtcgattcctgcgacctcgcataattcggcattccactggccattacggatattcatggccccagctgtggaacacgccgccacatcgcccacgcattcgccagttaattgggcgatcaagtagtccttggaactgatcaatacatgacgaatgcgcgcgtacgtttccggctcgtgttcacgcagccacatcaacttgggcaacggcaagcagccttcgagccggttaccaacggtgttcaggaaacgttctgcaccgccctgatatgtctcggcgagttgcttggcctgttcctcggctcggccatccgaatacagaatggcattgcggacgggattgagctcgccgttcaaagcaataacatcctgcatctgaccgctgaaaatgatgccacgaatgcgagtcacattgaattctgactcggattgccgcgcctgctcaatcatgtgcctggaggccgagcagaaagcttgccaccattgatcggggctctgctcccgatagtcgccgttgataataaggtcaagttcgctactcgcactagctacaatgcaaccctgcccattaactaaggcacccttcaacgccgtggtccccgcatcaaatgcagccacatattccgtagtcatatcgttcatcgtagcgctgaaaaaaaaagaatcattctttgccagcaaaacgcggcttattgcatcgtcttgtttctagaatgggaaattgaacgaatactacgactagtgaggcattatggcaattcaatcgacaatcatgctgaacaacggcactgtcatcccgcaggtgggcttgggcgtattccagacaccggatggtgatactacagtgaacgcggtgcagacggctctggagaatggctaccgccatatcgataccgcaatgatttaccacaacgaggcttcagtgggtgaaggtattcgccgtgctggtgtgccgcgcagcgatttcttcttgaccaccaagctgtggaatgacgatattcgcgcacgccgcggcaaggatgcattccaagaaagcctcgaccgcttgggcgtggattatgtggatctgtatctgattcactggccggcagacggctggcagcaggcatgggacgacttgcaggagatttatgcctccggccgcgccaaggccattggcgtcagcaacttccaaaagcatcatatcgatgagctactgacccatagcgatgtggtgcctgctgtagaccaggttgagtcttccccacaattcaccaatcaagagcttattggccagctgcgtgccaagggcattcacactgaagcttggagtccgctcggcggcaccggcggtaacctactcagcaacccagtactggccggaatcggtgccaagtacggcaggtctgctgcacaggtagtgattcgttggcacatccagcgcggcatcgtcgtgcttcccaagtccactcatgccgagcgcatcaagcagaacttcgaggtcttcgacttcaacctatcggtcgatgatatgaccgccatctccgccatcaacaccggcaagcgcaacggtgctgatccggacaatttcaatttctagacctttatcggtccagatacgcaaagagggaactctccgtcattggagggttccctcttctatatgctttcgattcggccacaccctaggtgcgagagcctatgtcttgtcggtgtcttgtcttgttggtttcgggtatgcgaaagccccttggggcgtgtgctccaaggggcttcctgtacgtgtggtgcggcggcgtgctactctcccacaccctgtcgggtgcagtaccatcgccgtgccaggccttagcttccgggttcggaatgggaccgggcgtctcacctgggccatggccgccgcaaatcttctcttatacggtcagacgctggggtctgccggcctgtggcggcctgggaaccggacagcggacgcggatatgtcgatgtttcgtcttgtggccagacaatgctcattgccgtctggtgtcgtttgcaggaggaagatgcggtccaaccgccaggggttggaatgttagtgttgcctttcgtccgttagtaccggtcggctccacccctcgcggggcttccacgtccggcctatcgaccacgtgttctgcatggggactacaggaactcgaaggttccacggaatgcttatcttggagcaggcttcccgcttagatgctttcagcggttatcccttccgaacgtagccaaccggccgtgccactggcgtgacaaccggcataccagaggttcgtccacccaggtcctctcgtactatgggcaggcctcctcagcattccaacgagcgcagaggatagagaccaaactgtctcacgacgttctgaacccagctcgcgtgccgctttaatcggcgaacagccgaacccttgggacctgctccagccccaggatgcgacgagccgacatcgaggtgccaaaccatcccgtcgatatggactcttgggaatgatcagcctgttatccccggggtaccttttatccgttgagcgatgccgcgtccgtacaccggcaccggatcactagtcccgactttcgtccctgctcggaccgtcgtcctcgcagtcaagcccgcttgtgcacttgcactcgccacccgattgccaaccgggctgagcggacctttgggcgcctccgttactctttgggaggcaaccgccccagttaaactacccgccaggcactgtccctgaacaggatgactgttcgaggttagacatccaatgcgaacagagcggtatttcaccttacggctccgcgcgatctggcgaccgcgcctctcggcctcccgcctatgctacacaatccacaccgaatgccaataccaaggtatagtaaaggtcccggggtcttttcgtccttctgcgcttaacgagcatctttactcgtactgcaatttcgccgagctcctggtcgagacagtggggaagtcgttacgccattcgtgcaggtcggaacttacccgacaaggaatttcgctaccttaggatggttatagttaccaccgccgtttaccggggcttgaattcaccgcttcacccgaaggctgacggatcctcttaaccttccggcaccgggcaggcgtcagtgcatatacagcggcttgcgccttcgcatgcacctgtgtttttggtaaacagtcgctaccccctggtctgtgccacccccaaaagctcccacagcaagtgtgttcaccatcgggggtctcccttaaaccgaaggaacgggagtgatttgccgagttccttgaccaggattcgctcgatcgctttggtattctctacctgaccaccagtgtcggtttggggtacgggcggctttgagcctgacgccgaagcttttctcggcagccgggatcaccggatatcgggccataaggcccccatcatcgcacctcggacccatgcgggacggatttgcctgtcccacgccctgcgtgcttgaccacggaagaccacctccgcggccggctacccttctgcgtcactcctgcgctgacctactacaaggatcggtcccaacaggccagggcatcccgcccccgaaggagcagtaagcccggacccggaggttagtactccaagcctcggttttggcggctgaaagccggtacgggaatatcgacccgttcatccattcgactacgcctgtcggcctcgccttaggacccgactcacccagggacgatgaacgtggccctggaacccttggtcatccagcggacgggatcttcacccgtctctcgctactcatgtctgcattctcactcccatgaagtccacggcgcgttcacacggccgcttcgcccctcatgggacgctctcctacccagtacaaaatactgccgcgtcttcggtggtgtgcttgagccccgctacattgtcggcgcggaaccactagaccagtgagctgttacgcactctttcaagggtggctgcttctgagccaacctcctggctgtctatgcgactccacatcctttcccacttagcacacgcttcgggaccttagacgacggtctgggctgtttccctttcgacgacgaagcttatcccccgccgactcactgccgggatacgcgtcaccggtattcggagtttggttgctgttggtacccgatacgggcccgcaagcatccagtagctctacccccgggacgtaatgacccgacgctgcacccaaatgcatttcggagagaaccagctatcacggaatttgattggcctttcacccctagccccaagtcatcccccggttttcaacccaggtgggttcggtcctccacgcggtcttacccgcgcttcaacctgctcagggctagatcatcccgcttcgggtccaggacacgcgactcaaacgccttttaagactcgccttcgctacgcataccccacacgggttatgctcgccacatgccactgactcgcagactcatttttcgataggcacgccgtcaccccacaaaagggctccgacggattgtaggcgcacggtttcagagactgtttcactcccctcccggggtacttttcacctttccctcacggtactcgttcgctatcggtcagacaggaatattcaggcttacccaacggtctgggcggattcgcacggggttccacgggacccgtgctacttgggagacgcgatcggcagaccatgcgcgttcaggtacggggccctcaccctctgcggcccggtattcaacccggttcccctgacacatggttttctgcaactgccggccggcccgtcggagccggcgcacgcgatcccgcaacaccccgcgcgcaacccccgacgggtatcacacgcgcaaggtttggccatcatccgctttcgctcgccactactcacggaatatcctttcctgcaggtactgagatgtttcacttccctgcgtacccccggccgaagccggtaccgacccatgacggtcggtgggttcccccattcggaaatcctcggatcaaagccctgttggcggctccccgaggcatatcgcagcctcaaacgtccttcatcggtcctgtctgccaaggcatccaccatacgcccttgcaagcaacacacaccacgaaagtgcatggccgcaagattcctctagcaaattcccagacgacaaatcatcacactaaaaatgatcacaaaacgatcgaaacgaacaatagagttcgattcgaaatcaacagcaaaacaaagattcaaaaactcttgttttgctcgcgtccactatccagttctcaagccaccacgcaccgccacgccatcgcgccggcacacggccggcccccaggcacgacgggcatcgaatcgcgccaggcaaaaagcctggggtggcgatccgggagcccaaaagcgcatccataccaccccggcacccaccgcacgaccggcagggcaaagccaacgacgtcttccacaccagcaaccccgccgccatcgcaccatgcgacgcgcggggcgcacaccgtcggacgaacatccgactgaattctccgtagaaaggaggtgatccagccgcaccttccggtacggctaccttgttacgacttagtcccaatcacgagcctcaccttagacggctccatcccacaaggggttaggccaccggcttcgggtgctgcccactttcatgacttgacgggcggtgtgtacaaggcccgggaacgcattcaccgcgacgttgctgattcgcgattactagcgactccgccttcacgcagtcgagttgcagactgcgatccgaactgagaccggttttcagggatccgctccgcgtcgccgcgtcgcatcccgttgtaccggccattgtagcatgcgtgaagccctggacgtaaggggcatgatgatctgacgtcatccccaccttcctccgagttaaccccggcggtcccccgtgagttcccggcataatccgctggcaacacggggcgagggttgcgctcgttgcgggacttaacccaacatctcacgacacgagctgacgacgaccatgcaccacctgtgaacccgccccgaagggaagccgtatctctacgaccgtcgggaacatgtcaagcccaggtaaggttcttcgcgttgcatcgaattaatccgcatgctccgccgcttgtgcgggcccccgtcaatttctttgagttttagccttgcggccgtactccccaggcgggatgcttaacgcgttagctccgacacggaacccgtggaacgggccccacatccagcatccaccgtttacggcgtggactaccagggtatctaatcctgttcgctccccacgctttcgctcctcagcgtcagtaacggcccagagacctgccttcgccattggtgttcttcccgatatctacacattccaccgttacaccgggaattccagtctcccctaccgcactcaagcccgcccgtacccggcgcggatccaccgttaagcgatggactttcacaccggacgcgacgaaccgcctacgagccctttacgcccaataattccggataacgcttgcaccctacgtattaccgcggctgctggcacgtagttagccggtgcttattcaacgggtaaactcactctcgcttgctccccgataaaagaggtttacaacccgaaggcctccatccctcacgcggcgtcgctgcatcaggcttgcgcccattgtgcaatattccccactgctgcctcccgtaggagtctgggccgtatctcagtcccaatgtggccggtcgccctctcaggccggctacccgtcgaagccacggtgggccgttaccccgccgtcaagctgataggacgcgaccccatcccataccgcgaaagctttcccagaagaccatgcgatcaactggaacatccggcattaccacccgtttccaggagctattccggtgtatggggcaggtcggtcacgcattactcacccgttcgccactctcaccaccaagcaagcttgatggatcccgttcgacttgcatgtgttaagcacgccgccagcgttcatcctgagccagaatcgaaccctccacaaaaaaacttcatgaaaagcatccgaatagatgactctcaaaacaaaaaattgacgagcacgtccttaaggaaggacgccctcaaaaaacctcacccctcatcaaaccctcccgggtacccaaccaccacgacaggcaatcaggcgaggaatgaactggcaatcattgactataaagaagtagtacaaacacgctcttgagttctcaaaccaccaccactcacccacctcgcagctccccggaggagaaccactcgctgagcggcagcaaggaaataacttacacgcattcacggactcgcgcaaaccgggcacgaaaaaacacgccagaatcgttgcaacgacagcgttccatcggcgtgtcgaaatcagcttgaatcacgccgttaccatcaggatacgccggctttttatggggctcacgtaacgaaatcagatgttcaccggcgtgtcgcaacaatttattccacgttcaactcccctcagtccgatcacgcggacggctcacccgcaaaaagctctcgtccttatggctcgactatcgtctcgccttcgtctaaaaaaacagtccaccggactgtttttttagacgcctcagcatcaaagaggggagccaaagggggattagaaggtcaggcgcatctgatgccagaccacgtcaccgtgagtggactccgaaatgccctcgtcctcatacccaaattgcgcatagaatccgaccagccgatctttgcaggtgagcaccaggcctttacgtccagctgcacgagtgtcttcaatgactttcctcatgagtgtactggcgcaaccgcgatgctgatacttcggcgcagtatccacgccgaaaatcatttgccagtcaccttgagggttgtgctgcgcggcatcctcgtacatgtcatcggtcaagtcacgccgatcggtcgcgaaaccgttgatgaacgccatgacgatctcgccatcaatcaatagccagaaacattccggataggtctcgattcgggcgcgcagggacgagcggtcggcggcctcggcggccgggaagcattcggattccatggcggccagcgcgtccagatcgtcgatggtggcgtggcggattaactggggatcagaatcagtcatgtttttgtccttctcttaacactccgttgtgagcaactctcctcaatcacgcttcgcgtgctggctcccctcaccttgaggggagccagatggatgtcagattacgcggtattcgcgtaacagggtggcaatatcggtgccgtcgagtttcttgagcaccttcttgaccacggccttttcaatgaagttgagcttcatatcggtgaccggtgcaccgtcacgcaatttgacggtggcgttgagcaggttgcgcacgtcatagacgctaccccacacttcaggcacgccgcggtccacgccgagcaacgtgtagacagcttccataccggtgcgcatcgagtattcggtggtgaaaatcgtgtcgcgcggggtctcggcgaactggccaaggaatgcgaagttcacggcaccatcgggcaccacgtccgggcggtcgccggccgcgcgcggcatgaagaacgcggtgatgtacggcatcatgaccggcacggtgttggcgtggtgctttgcgagcgcctcgatcttgtcggtcggcacgcccatgtggtaaagccactcctcgcaaatctcttcaccggtgcattcggtcatcggcttcttcacatagttgccgggcttgtccgggaacaggccgtagacccatacgcacagctggtccttgggctggtcgcggaactgctgctggcggttcagggtccaactcatgagccagttggagtcctgcacggtgacgatgccgccggtgacgaccttgccggagaacgggtcgcgcttgcagatcttctggatgtacggcggaatctcgccgtccagggtggtgacggtggcgctcatccacttggtggcattcggatcggagcagaacttctccggatggccaaagctcgggtcctggtcggcgatacgcttccacatatcccagccgccaccgggcttcaggtctgggttccatgcggcgggcgagttctgggaacccatggtggagttctccacgcaaccgccgttggtgatgaacaccagatcgttctcggtcaggtcgatggaggatttatcaccctcgtgatccacgtcgatgcgcacggcaagcttcttggtgggcgtgctggcagggttgcgcttgaagaagccggaggtggcctgaatcttctggatggtgtcttggcctacgccggtgtgctcgcgcttggggccggctcccccgccaatcgcgaattccacgttctcgaccttggtgttgtagcggaattcgacgccgtgcgattccagatacttgaccatcggcagaatcatcgactcgtactggttgtagcgggtgaaacgcagcgcggaaaagtccggcaggcctccgatgtgatgaatgtagcgcttgatgtacagcttcatttccagcgcggagtgccagttttcgaaggcgaacatggtgcgccagtacagccagaagttggagttcagcacctcatcatcgaagaaatcggtgatcggcttgtcatacaggtcttcgtccggggtgaagaacagcttcatgatttccatcgaagccttgtcggacagcccgaacttgcccttgagccccgcgtccttgccgagattcttggtggcgcggcacagcgagtagttcgggtcctccttgttgagccagtagtactcgtcgagtacgctgacgccttcggtttcgatggagggaatcgagcggaacagatcccacatgacctcgaaatgattgtccatttcgcggccgccacgcatcacatagccaaggccgggaatatcaagaccgtcacaggcgccgccgggtaccgggtccttctcaaggatgtggatgttctcgccaggcatctgaccatcacgcaccagataacaggctgcagacaatgccgccagtccggtaccgatgatgtatgcatgcttgttgtccacgtcggccggcttcttcggacgtgcgaaagcctcataattgccgctgctgtagtacatattccgcctccttggggcagagttgacacttcatcaactcttcttgaatagacatcatgtcgcattattgacgaacgcgccataggcaacgttcggcgttctgccgcattcgccaataccttgcatctacggttttcgaggcctatgttggctgttggctcataactattgaaggcatacaggcatactgaggatgcggggtgcttcaccgaaccggatgattgataaggtcccgctcaatccatgccatgaccaaatcggcaagtcggtttacctccgcttcggcgagttcacggcctttgggcagatgatgccatttttcgatgcatccgcggcagcatgtggcggtagcatgctgagcggtgaataccggatggccgcgccatggcgtctgcctgccgtcgttcttcggttcggctgcgcctatgcggtctcgcaacatttctcgcgcatgacgatcgatggtcgccttgcctttggtgcgggcataggctcggtctttgtcggtcaaagcgaatttggcgcggaactgcgaatgagacagccgttccagcatcgtggcaatccattgttgctcgtcatcgttgttaccagtatccgccatctccatgcccatacgttccacagtagtcgcgcacatcgtatggtggcacacgccttagctccctctgatgaaggagcccccagcaaagccaggtgagggagaggccaggggcgaaacccgccaatcaggcggcaggcaagcagctggggccaaacagaatcttgatctcagcaaacaacgaagtatctcgcttgacgcggaaacgatcgccaaacgtgagcacctgagcgttacccttctcatccagcaccgcaagatgtacttcgcagtaaccaggatgattagcgagcacctgaccgagttgcatcatgcgttggcgctccaacgccaccggcggcagcgtgatgaccaacggacgttcatcctcggcttccaaggtcggaatctgcatttccgtggctctcagagaaacggtttcgtcgcgcaactccacttggccacgaatctgtacgatggcgtccacggcaagttcggcggcggccgcttcatagaccttgccgaagaacatgcattggatggagctttccatgtcttcgatggtcacgatggcccaggggttgcccttcttggatacgcgccggtccacattggtgaccaaaccagccaacgtgacctgctgtccttcacccatcgttttggctcgatcaaccagatgcgcgatggacatttcacgcaaggacgcgagaatcgactgcataccggagagcggatggtcagacacatacaggcccaacatttcgcgttcgaagttaagtttggtcttcttgtcccattcctcaagatcgggtacggtcacggaagcgtcgcccatggcctccgctcccccatcctcggcatcggagaacaaatcgaactggccctccgcctgtttgcgcttcagactcaccaccgaatcgatggcggcctcgtgcacggtgagcagcgcgcgacggttcgggtcaatcgagtcgaaggcaccggccttgatcaacgattcgaccaatcgccggttcagcgcggtcaggggcacgcggcggatgaagtccatgaagttcacgaacttgccgcgcgggccttcgcgttcggcgatgatatcggccacggccttgtcacccacgttacggatggcaccaagaccgaatcggacgacgtcgccgactgccgagtactcgtacaccgattcgttgacgtccggcgagagcacctggatgcccatgcggcgggcctcgcccaagtacagtgcggtcttgtctttgttggtggcggcaccttgcaacagggcggccatgaactcgaccgggtagtgcgtcttcagatatgcggtccagtaggagatcagaccgtatgcggcggagtgcgctttgttgaaagcgtagccggagaacggcaccagaatatcccacacggcctgggatgcctcttcggaatatccgtgctccttcataccggcgaagaacggcaccttctccttggccagcacttcgggcttcttcttacccatggctcgacgcagcacgtctgccttgcccagtgaataaccggcgaggattcgggcggcggactgcacctgctcctggtagatgatcagaccataggtctcgtcaagcacctgcttcagaggctcctcaagctcagggtgaattggcgtgatcttctgcaggccgtttttgcgcttggcatagttggtgtgcgaatccatactcatcgggcccggtcggtacagggcgataagtgcggaaatatcgttgaagttatcgggcttcagggttttcagcagtgaacgcatgccgtcggaatcgagctggaacacgccgagcgtgtctcctcgggacatgagtttgtaggtttcggcgtcatcgagcggaatcttggtgtagtcgatggcgggtttgccgttggcctcgatgttcttcagggtgtcgtggatgatcgtcaagttggacaggccaaggaagtccatcttgaccagccccaacgtttcgcacgtgtggtattcgaaggtggtggtgatggtgccatcggtgcgttccagcaacggcgaggtgtcggtgatgggtgcgctacccatgatggtggcgcaggcatgtacaccggtctgtcggatcaggccttcgatacccttggcttcctcggtgatgcgcttggtgtccgggtcggaatcgtagagttctcggaattccctggcctcggcataacgtttggcggcagggtcgaagatgtcatgcaggctgatgtctttgccgccggtggccgccggaggcagcgccttggtgattttttcaccgactgagaattcataacccatgatgcgggcggagtctttcagggcctgcttggttttgatggtgccatagatcacgcactgggcgaccttatcggtgccgtatttttcgccgcagtattcgatgactcgcgcacgaccttcagggtcgaagtcgacatcgatatcaggaaggctcactcgctcagggttcaggaacctctcgaaaatcaggccatgcttgagcggatcgagctcggtaatgcccatggaataggcgaccatggcgcctgcggccgaaccacggcccggccccaccataatgccgtggtccttggcccactgaatgtagtcggcgaccacgaggaagtatccgcagaactgcatctggcagatcacaccacattcgtagtcggcctgcttcaatacgtcgagcggcgggttgccgtcgtaacgcttctccagaccttcctcgacttttttgaggaacagggaggtctcatcccagccttcggggcaagggaatttcggcatgaacgcgccgtcttcgtggtcgtcgaacatcacgttgcagcgttcggcgataacgagcgtattgtcgcaggcgtccgggtggtccttgaacagttcgcgcatctcttcggcggttttgatgtagtagccggtgccgtcgaacttgaatcggtccggatcgtcaagacgggaaccggagttgatgcagagcatggcgtcctgcgcctgtgcatcttcggcgtgtacgtagtgggaatcgttggtggccagcagtggtgcgttgagtttcttggcgatggtcagcaggtcaccggtcacctgagtttcgatgggcagaccgtgatccatgagttcgatgaagaagttgtctttgccgaagatgtcctggaattcgccggcggcgcgcagggcctcctcgaattgaccgaggcgcagacgagtctggatgatgcccgaagggcatccggaggaggcgatcacacctttggaataggtggcgagcacctccttatccatacgcgggtagcgcatgacgcgaccttcgaggttggccacggacgaggctttgatgaggttgaccaggccttcgtcgttttcggcccacatggtcaagtgggtgataagaccaccaccggagacgtcgtcgcggcgctgggcttcggtgccccagtgcacacgggacttgtcttgacgcgcggtttccggggtcacgtaagcttcgatgccgatgatgggcttgacgccattggccacgcagttggtgtacatctcgtaggcgccatgcatgttgccatggtcggtgataccgaccgcaggcatgccaagttcggccgcacgcttggccaaatcaggaatcttcgacgcaccatcgagcagcgaatagtgcgtatggttatgcagttgcacaaagttgttcccgtaatcagccatgcgctccaccataccgtgtggtctgggcgggaaatatttatcgatacgtactataaggcgctattgctgtttttgtgggtggtggttcgtcgttgagccgttgagggagtaagtggagagcgctttccgggtaggatgttttcgaccaagataaacaaacaaccgcaaagcgcctgatgaacagcatattcaaccagctcctcaacgtcaaaggcgtggtggtcgagaccgtgcggatcgtcgattcgcccctgcgccccgagcccgtgctcgaggttcgtgtgcgcccgcgcaggggcatgctccgatgctcaccgctgtggcagacgtcgtcatggttacgaccaaggtggcggcgtgcgtcgttggcgtcatcgggatttcggctgctggcgggtcgaactggtcgccatgatgccgcgcgtggactgtcccgggtgcggggtcgtggtcgcgtccgtgccgtgggcggaaccgggcagccggttcacgcgcgacttcgagtccgagtgcgcgtggctgatgagcgaccaagccaagacggaattgaaccattgggtgttctgggcgtcccacaaccgtatccccgagatagtcgaactcgcgaggaggatcaggagacggcgcccggacatcctcaggaccatccaactcggctactccaacgccaggctcgaggcgtccgacaaccgcatcaaggtcaccatccgcatggcctacggcttccaccacgtcaccaacctcatagcactcgtcatgctccgttgcggcggactcgacgtccgactcccacaacccgcaatctaacccacgaaaacagcagaagcctcaaaagtaatgagtaaatatgatagtctggtcaagtatatatgtatccttgacggagatagttttggctcttgggttattgaccgtgaaaacgatggaacgctcgaacatccaattcagatgccatatgtaagctactctgatatggtgcatcattttatcgatgatatatatgattttatcgaccataacaaggacatggagctgaaccgttacggtgacattctgaatcagaatggccttaaatggggaagcaagtctatgagcaccgcagatgtatcgaatctggatgcacagtgcatcatggcattgatcaccggagctgtccgggcagaacgattctgtgatggtgctttgcttggatttttcaaagatggcagtatccggaaatggctggagcgactgaaagaacttgataatggcagcggaaccgaggtgagataaaggcatggctgaaattaagagcgtaaatgaactgttgagcatgaatctgaatattccggactatcaaaggccgtacaagtgggatattcaaaacatcgacgatttattcctagacatcaccaatgcaattagtgatgcggacagatacagaactgagttcaaataccgtatcggaacgatcatcctgcacagaacaaagaatgacacctacgatgtggtggatgggcagcagagaatcatttctctggtgcttctaaagcaatgccttgaaccgggatttgagtgttcgattctccagatagatttcaccaacaaggtgagccagttcaacattcacaggaactatgcgtttatcagagagtggttctccctaaagagcgaagatgtaaaacgggactttatccatgcctttgagcatattttagaggtcgtcgttgtttgcgtagacaaagtaaccgaagcgttccagcttttcgattcacaaaatacaagaggtaaggcattagacccgcatgaccttctgaaagcgtaccacctccgtgaaatgaaaaagtatccctatgaaatggaacacgctgttacaaaatgggaagcaaaggatactgagaagatcaaagagctgtttgatctatatttgtttccaatcttgaattggagccgaggcattaaaagcaaaccgttcatagccaaggaaatcgacacctataaaggtatcgcagaaagctcaacctattcttacgcacgacgggcaagccgagctatgccgtatttccagattaccgagccatttatttccggcaacgacttctttgaaatggtcgagcattatatgtatctgctccaggatattaagtcggagatctgcaacaatccccgtttcaaggagattaagctggttatctgcggcggcaaggatgtagaaacaccggaagaaatggacaaagtaaagttcggctctgccggtttcggatacacgaagaatctgttttattgtgcgctgctttgctattacgacaagttccataacttcgatgaaatggcagtcaagaagctattttcctgggcgtttatgctccgtgtagatatgaagaccctggggtttgacagcgtaaacaagtacgctatcggtgacgaaaattccagatatacaaacacaatcggtattttctccaagatcagctttgcccggatgcaccacgaaatatccggattgcagataaaggtacggagaggaccggacagcccatccaatagatggatagacttgttgtatgacacgatcaaagaaatcaatggatatggaggtgcggaatgagcaaattagtaactgaacttcatattattggtgaaaacggcaatatgttcgacacagatatggagtacataatccctctataccagagagcctatgcgtgggaggacaagcaactcacccagctgattgaggatattaacgatgttgcggaggactccaattactacattggctccttgatcgtttccaagcagttcggacgatatgaagtagtggatggccagcagcggcttacctcgctgtatttgctgctgaactgccttggaatcaaaacaaagcccacactcacatttgcgtgtagagaaaaatcgaactataccctaagaaacattgaagaactactgctcgaaaaccgcagcaagatcgatatggatcggattgaaccgggaatccaaaggggcatcaggatactatctcacgaattgacaaaggatcatttcgacagggaaagctttatggaaaagctggctaaaattatcgtctatcggattgaggttccggagaataccgatctgaaccgctattatgagataatgaacaccagaggtgagcaattagagcaacacgacattctaaaggccacgcttatgagctatttgagtgatgattctgagaagggcttgtttgcgaagatatgggatgcttgtagcgatatgaccggctatgtgcagatgcacttcatcagcaagaacaatgcggtaagagaggctattttcggctccgaatggaacagtatgccgcctaacagctggcagaaatacaaaaaggctataagtggaacgacacaggaaaccaccggacataaaatctgtgacctgatcgaaaagaacttcaaggttgaagatgatgaaggctatgtggatggtgatgtgcgtgttcgctttgaaagtgttattgagtttccatacttcctgctgcatacgctgaaggtctatgtgagtctttacggtgtcacccatgaaatagcaacttcaaaaatcgtggatgaactcttggatgataagaagctccttgatgcgttcaacagagttgtatcctgcggcataacggataccggcaggatcgcagacagcaaagaagattttgccagagggtttattatttgcctgctcagaaccagatacctgttcgataagtacatcataaagagagagtacgcaaatgacagcgctgatggcgaatggagcttgaagagcctgtatgtttccggacagcaatcgaagaagaaagcatattacgggaactccgagttcacccgttccggcgaatggacatgtacaaatgattggcgaaccaagaccaatattatgatgcagtccgccttgcgtgtttcctacacttccccaaaggtaatgcactggattaccaaactcttgatatggctttcggaagctgattgcaagaatatcaaaaatgatgccattacaaagtttgataaagttgccgaaaacatcgctattgatgcagtaagggaaaacttctttcaggtttgttcgaacggcgtgtatgcgatgggtgtcaatactccgcatattgtctttaactacctggattacttgctgtggaatgacgaccggaacggaaagaagaagaaatacagcgactttgtttttgaatttagaaattccgtagagcattggtatccgcagaatccatctgagggaacattcgagcaatggaaggatggtgttgaccagtttggaaatctctgtatcattcagagaaatgtgaactccaaattttctaatatgtctccggaagcaaagaaaagtacatttaaggatatgatagtcaaggggagtattaaacttcgcattatgagtgaactgacagaaaaaaacggcgacaaaccagccagcctttactggaaggaaagggcgtacaaggcgcatgaagaagaaatgcttggccatttgaaaaaagcttgcaacattgagtaagcaaagaagccatagcgacaactccaggcgagagagtgacagctatggcttttctttacacttcagcgttgaaatgccaaaccttggcgggtatttctctgttgttgccgctgatcttaatgtggtcggtatagatgttcaatttccaatggttgtactcattggcgttgtatcttttacattcctgagttagatatgatttcagaacctcccactttaccatgaggatgttcctactcttcaagcggagcacaacaagggctttatcggtttcgctcagaacatgggcttgttcttctgtaatatcaacccaataaaaaccttgcggatgcatcttcgactgaggggtgaagaatgtgatggtttcgccattctgttttctccctctaaacaagattttgaggcttctgctgttttcctgagttctaaatagaagcgcaacacctaaacctcaactccctattgaacacatacacggatccgccgctacctgcccaagaggaccagtctcgacggcctgacggacgccgacctgcaggccatcgtccaggagatcaacgacacccccatgaaggtcccggactgggaaacacccaacgaggcttggtaccgcgagctcggcaagctaatgtcgaggacaagccacccaaagacgagcattgcacttacaaattgaatccgggccagccactcgccaacaacgtatcggtccattatatgtcagcaacattctgaactatcatgaaccatcaagtacaactaactactgagaaaatccaatcttgcgagaggaaattatgcggcggtgatgctatttctgatcatcgtgcgccattgaacgcggctaataggagaaacagtctggaattgtaaagacctcaggatcgtaagggcctctctgtccagggtcaacaaactacaaattctgcgatcctgtatcatacaatcaaagttaattcgttctaaaccataatgatcgaacaatctctgtaacaaaccgccccaccggctaagcatctctatcaggttgctcggcgacgccatattccacacagtcatatatcttttatccgaatacagaggtatgcactgtgaagctctgactatttccgccttctttatgcccgtttctttggaggcatccgctatatgccaaacatatgcgtatggcggatcatgcaggatacatcggattagctccaacatatcataaaggcgtttcttggaccctttatcgcattccagagccgcgctagcgaacccagatctttcaccaccttcacaatgtataatccgaagctcatgtctttcggtatccactttgggccagctccgattggctttcatcaaaaggtttagaccgtcaataatctcattgatacagaactcagacacatccttcgtcaaatcactgagcactcgtatatgaatatcgcaatccgtcttctccgtgaatatatgattcacccaacgcgcgccagttatcttatactcagagaaacgaagcatacaatcatctatatttcttcgtgcactactcaactgagcgagcatctttaattcatctaatccaatgcggcaatgagtgcttccacaactaaattgtattgtcgatatcccatatttaggaaatacataacacaagcggtcagaccaagattgaaagcgagcgaaagtgccaggaggcaatgacctagcaccaacgtcacctccaacttcaagaggacagcagccaacccctctcccattctcatcctgcagatcaagaccattactctcatttagatagctttgaaacgcatagcacaaagacatcaaaatggcgatggccgcacggtcataagcagattgaaaatcagcagtcgcctttccgttcacatcggcctgcaacacgcagcaatcagcaacatattcattcgcgctgtcagaaggacgaagattaaactgacatagggccacaccaaaatgctccatatatgtcaggtgctcaaaatacttctctattgcaacaccgatttcgccataaagcgttcgcgcaagctcaatgggaattcttttaccttcatcccggattacgttcatggtcacggacacggctaatcaactccttcattaggcaatcagcagctgcagaatcaaacactgtccgagcatcgaccgaatccgattactgtgacctctccgcccgaatcaatttggccatcgaacatcatgccccaaacaatcatggcatcaggttgaacgcaggcacgtatctcatccacagcacgcgttactttctggagtttttcatgagccgaacaagcgaaagagatgcagacggcgttcatcatcttcaacgaatcatttgagaatgatgccattgcgcgcttcgcggcctcaactattccatccgtaccttctgcttggccagcgccggaccaagccagatcgttgccgcccatcgccgctttgatatcggaccaatcaacatgtatgtacgaagaattcatatcagatatatcatccaatacccgaaaaccagcgtttaactttttcgccatctgcaactcttgcttgtccattttgactccttatcgagagctatcaatactcctcacaatatgcacgacaagcaatcaacagtagatatctaccggaatattgaagatgaacaagctactaacgtttagctgaaaacgagtcagttaccgaggccccggcattgatcacgaaatgtgaataatcctgtgtccaatgagccctacaagccatcgccgtactacagcatatccagaatagcgatgttctagggcctcggcgtagagagcttgttgttgagcgtattcggtgcggagacgctgagaccagtctttgactgtttcacccgggcgcattttgtcggttttgtagtcgaagagggtgatggtcttggcggttggatcaaggaaatagccgtctatgatacctcggaccacgattgtgtcgtcacattgctcagcaacgttgccgctgtcattcttcgtgttgggcacgccaccagccatgccgctaccgttcaccttggcattaagccggttacgttcaatcaacatcgagaatggctcttcccggaacagagtatcccgatgagctcgtatttgcgccgatagcgggcaattttctccagtgacaaaccagagcaagccttccagctcgcgagtcagcacaatatgagccacttgcggcgtgatgacatgattcgcttccagacggtcaacaatgtttctcagctcggcttcgcactgctcacggaacggctcagtaccccaatcaaagagttccagtacattgtggaccgcagtacccacctccgaagcagatggctcaacgtcggataccttcttcataaagtcaggaataaagaacccactatgcgcttcccgcctttgcttccaatcatctagattgtcttccagcatggcaattggcgcagccgcgtcatcagacggcaatacagccagcgaatcagtgtcatcagatatagattccgcatcatcaatcatccagctgcgagccttggaggaactcactaccactggcatgcgcggaggctcatcaggcaatcgcaaaccagtcacatcaatacgtttattgatatagccatacccgtccgttcgctcattcatagtggtcgtcggctcaggcgcagcactgcagaatcgaatcgtaatggccctgcccgtcgccgccatagccggcgctgtttcctgtagtcccgcagcaagattccacgcacggacctcattagggcgaagaatcgcagacgaatcatcatccgcatctccagacgccagcaatgatcctagaatccaatagagataattggggctaccactattcttgaccaccgttcgtggatctatggtgcgtccatcgccgcttagcgcgatgccttgagccatcgtacgcaaattcagattgccatcatcgttctttcctggacggtacgatcccgcgataatcaacttgcgttcggcacgagtcatcgccacatagagcaaacgaagttcctctgccgcctccaactccttggcccgcgaatcaatcactgcgcgctggaaagtatccactcgaacatggttacgttggtcaaccaacgataaggcaccttcgccatattcggcaacagccccatcctcattccttgtctgatgagcaatcgtgcgaacgacagcggttctcgatccggtcagcagattattgctggcacccatgagtatcacgacgggccattgcaatcccttggatttatgaatcgtcatgatatgcacggcgtttttggtaggcactgttgaagcttcttcaccggagccactcgcggaccacattgttacggcatcaaggaatggttgcaatccacgctcctgagctacagcaaatgcatcagccttttctacaagcaagcgcaggttcgcctgccgtcgctcaccttcaggcatattgcctgcgaaatcgaacaagccagaaacggcatagagatgccacaacgaatcagacagagagtgaactcgcgcataatcgcatgcggcatcatagattcgcaggaatgccgatatctttgcaagcaacacatcagaagaaagaacagccgattcatcagcttctcccccactctcagcaatccgccgcataacgtcaaatagccagcctctgttatgcagacgaatccgcgccaaatcatcatccgtgaaccccatagtccgtagcaccgcaaccaacggcacatcctgatgacgattggcgataatacgcaaccaatccaaggcgatctgtatctccggctgacgatacaggtctccaacgccctgtacttcgactggaatgccgacacgatatagtcggtcagccaggtcggcaaaatgagtagcgccacgagccagcaccgcgatatccccatatgaatactgcgcgcgaggcccctcgcagagctcctggacacggcgcactatcatgtccacctgtaattcgtccttgccggcgcgaactgtcggtgcagtgtcagtgccgttttcatcagccacaacatcagcactcaagtcaggtgccgcgttactcaccaacaattcaatggcttctgcatcgaatggtttaccggcttgctttgccgagccgatttgcaactgttccttcaggtaatcggtcgcacccatattcggcgtcatcagtcgggcaaataccgtattcacaaaagtgatgatttccggcaccgatcgatagttcacccacaattcccggcgatggctcgcatccgtaacactattgcagatatcgccgaactcctccggcgaggcatcacggaacccataaatgctttgcttcacatcaccgaccatggtaagtttggctgcatttcggctgatttcgcgaatgaatcgattctgcagggcgttattatcctggcattcatccacataaatatatcgccactgagcaccgatacgcttggccacgtcaggctgctgcatggcatccaatgcccagaaagccacatcactgaactccgctacggactcctgctgtttcacaagcgcatactgctggtcgaacgtggtgatgagcgcaatcaatccttcgagtcttcgcgcagcgacctcatcaagcgagtccacttgttcagcggtaaaggccagtttcgattgcaaatcagaaacgatccctttaatgccccgcaccgtttccgccaagcgacggcccagttcactgtctttgggtacggcgattgccgtactcttaagaatggcagttttgccgacagtaatgcgcttgggcagtacgtccaatggattggcatcgataacacgagcacgaactgcattccatgattcgctacgcaagtactgaggcaaatcgcatatcatccgcaatgatttgactaccgtatcttgctgcgcggtgtgcgcatcgtggcagctggcgagcgcctcatcaagacacgatcgcaattcggcaagaggatgttctgccatatcaatccagcctcgaaaataacggtccaaatattcattgccgtattcaccaccaacgacctgattcagcgacgcaatgttgaaccggtatggttcggcgagccggctaagccaaccgatgcggttgggcttggtgagtgccttgtcatacaggctcatcatggtggcgcgcaagtcaccatcatgccggggcccttgcatgttgtccaacacatccatgaaccgcgcgtgcattgagttgcgctcgtcataccacgattcgaataacgcgtcgagtgtttggcctctcagccggttcttcatggcatcatcagcaagaatctggaatcctggagccaccggcaatgtatcggcattgcgatccacgattcttttggagagcgcatcaatagtgctgatttgcacggttggcagatcgttcaaggcaacggagaatacggtttgcgcatggtggcaatcgtgcagaatcgtacgcgccagttcgctgtcgtctccacctaattgatagtccgtatccaagagcacgagtgaacccggctggcatccatgattgcgccgcgcatacagaatggcgtactgcaggttctgttccaagcgccggcgaatttctgcggctgcggcaacggtgaaagtaataattaacgattcgcggatggatgaatgcgcttcgtctgcattacggttcagcaagtccagcagaatatcctgcaagagttgagtggttttgccggtgcctgcggatgcgctgatgacgtaaggcatggtgtttgtcggaaaatcgtccgagagattatccgcatcttccgacctaggtaatgcatcaacatgttctaccatgccttgcctccttcagatgtattattcatatgaagagccgcttctttgagctccagcaatgtcactgctgtctccacctcgaatatgttgctattcaacacatcccacgccatgatgtcggccacatcgctgtaggcaagaccatcacggccgtcaaccaaagaacgataagggcgcaccggcagtttgccgtccaatatgttctggcaggcacccactattttcccgtgcacataatccgctatgccacgaaattcttccgcactcagttgttcgataccgatgccggtttcgtcggattctcctataagcacgccactgttcggcatatcaaagcctcgccatacgtttctgatgcgcatgttctgagcacttgaatcgtcacttggctcatcgaacagactcgttgatccatcgtctgcgctcggcaacatgttgtattggttattcagcgcgatgcgttctcgaatggttgcgctgggtttaatcgggagaaagaacatgcctgctactggcattccggagttgtgctgggcggcagaagcatacgtaaacagctgaagttcatggccgtagtacacatttgaagcgcggccgccatcattgcgagacggtttgccgaacaacgtacgggcagaagacttatagtccagcacaacaatgccggcgctctctcgcgaaatattggtatcgcgaattaccgtatcaatgcggtcgaccttgccattgatacgcaatgcaaccgggatttccttgtccctcgccctaccgattaattgttcccctgaatatggcgactgccatgcaccggtcgttcctccaacgttgccaaatacttgctctacacacgtaggcgtaagcatcgtctgtgcggacgataatgcctcacgttgcgcagcagcatcgacggcaaaatccatcagcgtatcgaccagctgacgatgaatcatacgcatacgattactggaccgcagcacctccatacgcgggtcttcgttcagcaccgtccactgattgcagcctcgatccagtctggaatagtcggcgataagctcttgcatgtctgttgcagtgggctgaggtggtaagccgttcaaatctcgttcgttcttgtgtcgctcgatccaggcattgaccgcatgttccagcactgcatgatagaacgtgccttcaagcgcggcatcaaaagcgaacgcatttgccacgttaactttcaatccgtatttcaggaaatactcatacggattgcgatagtacgtttctattgccgaaaccgatgcattgaacacacgagtcgagatcgaaggatctgcaccatgagtgcgataaacgcgatgcacataatccggcctagtgaacaaccgatatgccagttcgcggtcaaggggacgatactctgtttcaacggtcggcacagcgcgtttgctcgctccgatgatttcgctcgtatccgatgtacccgtctcccattggctgatatatggcgagcatgcttgtgcagcgttacgcagactctttggataggtcatagacaactgctgcgttgcgctggcaacaacaccgttaaaccatagcggttcttgcccggacctacgttccaccgtaccggaaagtacattccacgcttccaaagttttgccttgggaagtcaggaactgtgacaaatccagccgctcgccgtcatcgagcagaccggtctcatgcggaatcgcaggcaattgagattcactgcaacccagaacaatcacatatctgtatggatgtaaaggcgatgacatcggcaatacgtccacggcgctggcggagaccggacgcgaatcgattgactgcgcggcgagcgtcgaagctagatttctagcaaagattcctacatattcagcaaaataatcgttaccgagctgttgaaccatgtcgtcaaacgcattcatgatgacggtccaaactggcgcggatccttcaatggtttgggcgtattcggtaagaaaaccaaccatcccgcctagagcctcccgcacggttgcgctaggccgcggccgaaacacatcagcggcttgctgaatcagcgaacgaatcttctgcaaatgtgcagcgaacggtatgtctgtatcgatccataccgttgccggattgttggagttcagctgattttcaatgtcatcgattgccgttggagtcaagttcagataccggctgaagataccggaacgcagtatgcgcaggatggactggggttgaagttcgtaggtcgcggaatcaagcagtcccagaatcgcatcagcgaacggatggtcaagcatcgtactggacgcggcaatattaatcggtatcccctgatacgtgaattccgatgcaatttgggcttgatatgaaccaaggtctcgtgaggtgaccagcacatcaccgtatgaaatttctggattgtccgcgatgaacttcttgatggacgctgccgcatagcgcacttcggcagtagtatccggcatcgcacacactgatgtagaagcggatgaagcgaaaatactggacagcgtatttcggtttccatcatcgcgtctctgcaatgcttccagataatccggatcagaaccggcaccaaccatcaccgtcagatgcacgtattgcgcaagtgtatgaactatcctcatctccgaagcgttgaggtgtgcgaaaccgtacagatagaaccagcgattactcccatgccgctgtgcccatgcacatatggtttcatgggcggctccggggaatgtataccgtttacctaaccgttgctccaccagttgcagcaaagagccaagcaccgaaagtcgagcattcgactgatgagcggccagagcaagcacctcttcagcactgaccccatcattatgcaattcaacaatttgcttggtgaactggtcaatagcctcaaacgagtcaccaacctgattacgcaacgattcattatcattcagacacttcgctacgtaatttctcagcgacatcatgctgattgatgggcgaatgtaccttccataatcctggttgccgataatcgagctcatcatgcttgccagagaatggacacccacattcatccccggttccagacgttcgcggaattccggtcggaccatcgactgcagtacttgcttttccacatatgcgcgcaagcttgccggtgtcagaataacgaatcgcccacggcaactatccggaaaatctgcttccgtacatccggcaccatcagaaaggacatgatcaatcagggcatgaatgtcatcacaccctcgctcgggccgtatcaccatgacactcataccttaccctccccagtgagttgtatctgttctcagcatataactgacgcaacaaatatccgggacttcgcgcatgacactttgcactcttacgcaagcctagtgatttcgtagtatcacattgccgtctaagcacacacatattgttcaatcgcacgtcctattggccatttgaaagactcacactggagctgttgccgagtggtttgatcccaatccgaaccattagggacgacttcatctgtactcttttgcgcacaaggacttgcatccattacatcctgcaataaatcaccctgtccatgggattgtgctgctctgtattgcctttccgcctcgataaggtcattgccacattgggcaagagccttcctgcaggggttgacgcaatcaaaagcaccggctctaatgaggtaattgacattccctgcattgcaatgttccaatgaaacacgacgtataaaatcattaaaactgcgataggcactgcctttattacgggttgaaacgatttcttctgccaattgttccgaaatgccccgtatcgcattaaaaccgagctgaattccatatgccgatttctcatcgtcaccggtactggaatacgctgtcgcataatattgagattgattaatgtttggcattcttacatgaatacctaaacagtacatttcttcaaatatactttccagtttcgctctagcgccatcctcgttataactattcaacattgcggtcatgaattcgattgtgtataacgttttcacataggcgacacggtatgcgaacattgcacgagcaacagcatctgcgcggtcggcacctctgctatggcatatgtcaattagctccgcaaaagaggtaagcttctgctgcatcagttcgctcttcattccatccaagaatggaataccggccgtatagcccgcggacagtaagtcatacacacggctctcatccaacgaactgcaagaatcgtcccatacttgcggcacattgcaatccggtatgaatcgaagggcatcctgcaccacctgcaaaactctcgaacctgcaatacggagacgaggaagcccaagttcatcacagccttttgcatcaaacgcggtgctttctgcccccgaaggaaaacgaacaatggacgttacttcggcaaggggcttgttgcaaagagccaacacatcactgcgaacggaacagtcatatatacagtctttcaacccatccgcaatagacttcttggcgttatcctgcaaccaaacctcagccgaggatgcatcccagaaccgttgatatccgcatacatgcgacacatctttcactgccttggcatcgttaaaacggctgtatgcaattacagcagctgcataaccattcccatatcggtcacatagatattgcaatacccgcctggacagtccccgttccgtttgcaaaacagctgtaggaaagactgaatcttgaaaatcagtaaagggtaaatcgtattcgatgggatcaatctcactaatccccagcgcataggcgacaaggctgcgagccaatatccccttcccgggcccgaccaaatgcccctcttctcgcaatcgattcgtacaatatgcgacggccatcaagtattcttcagcatgggtttcacgaatcacagccatttcgtgttgagcacgattccacactgaatccggtatgcttccatacttcgtttgcagccatccttcaacttccccttgaagaatttcactcgacgctcggccatcagcaccaacatgctgcggcattaatgagccatcttccgctacacaaaatccggtatcgcaccgctctgctatgagcaacgtattgtcgcaggcttcaggcacatcggagaacagagaccgcataaccgcagatgaacgcaaataatactcctcgctttcaaacttgaaacgatgaggaccatccatcacatcacctgtttcaatgcatatacgcacatcatgttttagactgtcatcacgctttgcataatgcacatcactagttgcgactaacggcgcattaattcgtttcgccagttccactagatcattcctgatttggtgctcaatggacaaaccatgatccatgatttctataaagaaattatctcgaccgaaaatatcctgtagttcaccggccattcgcaacgcttcatcaaattgtccaagcaacaatcttgtcggaatggctccagacatgcagcccgacccacaaataagtccttttgcaaatgatgacaagacattgttatccatgcgaggataacgcgagaccagaccttcgagattcgccacggaagatgctttcatgagattgacaagaccttcatcggactctgcccatagcgtcaagtgagtaaacagcccaccaccgctgacatcataaggatcatgaggcacacaagtaacacttcttcgagtattcctctctttccacgaattatcccaagatacgcatctcgtatccgtgcggccagtttctggcgttacgtatgcttcaacacccaaaatcggcttaatgcctcgctgacgtcctgctttccagaactccatcaaaccgccgacactgccgtgatcagtcagaccaattgctggctgacctaatcgttgcgcttcactcatcagctcgctcacagtagagacaccatctgccagcgaatagtcactatgtacatgcaaattaacgaaatcccgcataagagcaccgcctccatagtcatggttgcttcgaattcgaatcggctgcatgttcagtttcctgccgcgctacaatcaacggtaattatctactggttcttgaagcagtctcgatactcagcgagaggaacatgatggccgtctcatcgcaacaagcaacaccttccactgcgcagattgtcatcgagattctcgaactgctggatgcgcatacagaccgcgagcacgggattactgccactgagatcagcaagcgcatcagcgtttcggaaaagaccgtacgagggcatctcaaggcgttgcgtgacatgcaaccattcggccgtcgggtggagcatctggagcgtcgagacctgctctctgctgaaagcgctgatccaaagccgggatggtacattgaaccggtgtttgatacggcccagatgcgtctgcttgcggacggcgcggtaatatcacggtctgacagcgaatatctgagcgaccttatcgccaaaatctatacgttcgcgggcaagtcgggccaattgcgcggtctgaggcagctcactacgccaaagaattacaacaccgagtttctcaacaatatcgaaatgctcaacgatgccatcgaacacgaacgagtaattcgattccgttactgcacctatgacattgatggcaatctggttcctcgccgcgacaatgcgggtgaaatcaaagaataccaagccgatccgtaccatctgatgtacaagaacaacaaatactatctgatttgccacatgcatcagcatgacagtctctcgtatctgcacgtagaacgtttccgcaacctttacgtcgaggagactgatcatgcgctcaatcgctcactggatagcttcagtccgattccgggaacgccgttcaacatcgaagagcatatggacgaacgcccttaccccatggacggcgcagcagtaccgattcacctgcgtattaccggcacgctggagcccttgtacgactggttcgacaacgccaaggtcactcaaatcagcgccaacgaatacgacgtgcatatcatggccaacgaattagcgaccttgtggtgggcattgcaatatgccgattcgcgcctcattgaagtccttgaaccacaatccttacgcattatgctgcgagatactggcgaatctttgctagaaaagtatcgagactagctagtcccgctatattctcaccaacgctcagctcttttgtcgacactcggcaatgagggcggcacagagcaaaatgacctgggcgacgaggttgaaccaaatgagcacgccgatcaacgcggcgaacggggcaagcatcggattccgggaggctccggctaatagtcgcgcaccgagaagctgcattgcggaaaccgtcagagatcccagtaacgcgccgagtatcgtgaatcgtccggctttgatgtgggagaccacgcgcagcagcaacatgaacaacgcgaaattcagcgcgacgccggtaccgaaaccggtcatctccaaaagcacggtgccgggcaacgaactgctggggatgccgccccattgcagcagtcggcgtacgatgccgccggacaccgtaccggccgcggtcgaaagaatgaacagtattgcgatggcgatggcggcaagcgtatcgcgtaaccttgcgacgacgatattgagctcgtcgccgcagtcgtcgaacatggcccgtacggcgtggcgcagcgagttcatccagccggtcactgtccaccagaatatggccaacgtggccagaccggtccacgtcaatgcgcttgacatggcgcctagcgcggaagacgtcagaaacgagtcggccacaccgggaatgacttcacgcaccgcgtcaatcagcatctgctgccaatcaatgttgccgaccatgataaggccgaacacgctcaccgcaatccagacgccggcaaaaaaggcgaacagcagaccatatgccagaccattcgccagcagggggccgctccgcgacacataccggtcgagcacgcgcccaggcagcgaacgtgcccacgcgtccgctcccctgtcaatcgcactcttcaacccatgcatagttcaactgtagctgttgccaccgttgttgaaacagcatggcgcgaaatcgcatttagccagctcaaacgatggcaaccatcaacgcccccactcaattgttcagaatcggataccatatgagtattcaattcatccgtcggagtgcaatgtcagcagtcctcaccaactgatgtcttgctaacccgctggccgccctagtatctactgtttcttgtggtcttcgttcaacagccagtcaagcgcgtatatctgtcggatgccttcgtgggagtagggccgttcgtcatccagcgtaatcagcgtcttgggatagttgtcacgcacggcgcgcagcgaggacggctcccgatccagcgtcgccgaatcgtgcaccgattcgctgacctggtagtaccgacgtccgcctggcccgttcgtgacgaagtcgatctcgctgccggagctctgtccgacatatacgtcgccctcgcggcgcatcagttcgaggaacaccacgttctcgaggaggcgtccgatgtcccgcacgttgttggagcacaggatacgtcgcatccccaagtccacggcatagtacttcttttcctgcttgagaatcctcttgcccttgatgtcgtatcggtgggccgggtagaggatgaacgcgtcgtaggccgcgatcgtcgtcggaacgggcacggtcaacgactaggaaacggtttttatcagcaggagattctgcaatccggatggcatataccgcccggcttcattactgctttggctcatttctgttcacttcacgctggagtaccgagacacgttgagcggaaataccggtaattcacgtacggttaccgaccattggcctgaatggtactcagcatcagcagtcacttggggtatggtcatgacggagagccatcatgaccgatctctcgttattctgggatgaatccggcgaagccggaactgaatctaaatattaaaacgcatgatgcacacgtcgcggaattagtccaccagaacttcggcatattcggcaggttcagcgggttcgatgtgtcgggcacgcatggcatcgagtgcggcagccaagtcggccgggtactgggaccggaccgtggtccagacgcgggtgcggggatgacggaattcgagcttcatggcgtgcagccactgccggtcaagtcccaaggcctcagacagcaccggattggcaccatacatggggtcgccgcacaggggatgcccaatcgaggagaaatgcacgcgaatctgatgagtacgtccggtctccagattcacggataccagagtggcctcatggccgaaacgctccagcacatcccagtgcgtaacggccggtttgccggccggagtcacgcagaagcggaaatcggacactttggcgcgcccgatcggcgcctcaatggttgctttgttctctttaagaccaccctgcacgagcgcatgataggttttctttacctcatgctcggcgaactgccgacgcatctcggtgtacgcaaggtcggacttgcacaccaacatcaagccggaagtgcctacatcaaggcgagaaacaatgccctcacgcccggccgcaccataggaagtgatatgcacgccgcggtcacgcagtgatccgagcacggttggaccggtccagccaaccgaggcatgcgccgccacgcctacaggcttatcgactacaacgacatcatcgtcttcgtagacaacggccatatcagttgcgataggctcaggctcggcctgttcctccgccaaatcaaattcgacggtctcccccgcctgcaatgtgctggaccgcgcaacttcacgtcctaaaacgcgcgcctgcccggagtcaaccagatcggcggctttagatcgtgaaatacccagcattttggccacggctacgtcgaaacgcttacccaccaatgcatcgggagcagggactattcgactcattacttggcgtccgcctccggctcagactgtagggattcgtcggattgctcgatgagatccttgtgtgagaacggctcccccataagaatcagaatcaccaggaccacaccggcgactaccagatagatatccgccacattgccaacggaccagccatagttaaggaaatccaccactttgccgtcgaggaagccgtcagcgtacataacacggtcaatcaggttgcccagagcgcctgcaaacgcgaaagaaatcgccaccgaccatttcatggagacagtgcgcaccccagccacagcaagggccacgcaagccacaacggccaacagactgattacccaagtagcgcctgatcccatgcccaaggacgcgcccggattacgcaccaaggtgaaggacagcagtccgggaatcactcgaatggtctgaccgttggataacgcggccatcgcccaagccttggtgagctgatcgacaatcagcgcagccgcggccacacatgcaaagacggccacgcgggtgcgcagccgtccctgttggttcgtcatacgacctgtacctgcctacgctcagttggtcttggacgaggtctggtcgacgtagttgttcgactcggaaacctgcgatgccagctggccgaggtactcggtgaggcgggcgcggtattcagtctcgaactgcttgaggctctggatgttgccctcgacgaccttggactgagcctgaaggttgtcgcgcacctgctcggcatacgtatcggctgcagagcgggtgttcttgtcgtacgcatcagccgcggaacgagtgttcttgtcatactcggcggcacgctgctgtacttccttctcgtagttgtcagcgtcatcgtgctgagacttggagtagttgtccgcatcctgacgagtcttgacggagtatgcgtcggcctcagaacgggtgttctgggagtaggtctcggcatccgcgtgagtctggtcacggtaagcgtcggcctcggagcgggtacgatccgaataggtgtcggcgtcggaacgagtacgagtggagtagtcgtcggcctcggaacgggtacgctcggagtagttgttggccttggtgaccagatcgttgtacttgttctggctggcctcggtgatttccttggccttgttcttgcccttctccacgtactgatcgtgcagctgcatagccagggtcagcatggcggtggcgcgctcgggctcggtgcccggcatggaagcggcgccagcgatcttctgcagagaaccggtctcggtgctcggctcgaccttagaaacctgagcacgaagctggttttcacgctgcttggcttcttcgagctgacgggacagctcagcgatctgagcggactgctgctgagcggcggaaccctgctgctgagcagcggcgagctgacgggacagctcctcgttggccgcgcggaactgatcacgttcctgctgaatggcggcgatctgctgaccgacagcctcctggtcaccggaggcctgagcagcctgagcggtgagctgatcgatttgagcgttcagctgatcgacctgacccttgagctgctcattctgggaggacagcgcgcggttggattcctcggcttcgctgagcttggcagagacaagctgtgctgcctgatcattgccagcctgaacggcctgctgggcctgagccacagcgttcttcaaaccagcattctccgactcgagttgctgcacctgaccggtaagatcggagatcttcgcattaaggttggtcacgtcaggacccagagtctgggtggcctgaccgccggctaccgcctgacgtccaagagcctcgacggtttccgtgacctgatcaaggaagtcatcgacctcgtcgacatcataaccttccttgaatcgaacagtctggaaggtgtgctccctaatatccttcggcgtcaacagagccataaatcttgcacctcgctttggggcatcgcccgcacttacgttggtctcaagtcagaatgctatcacgaccccatcgtttcagaacattcgacgtgggtttttatgccagatatatgcctccggcgggtcaaaaacggcctcagaacactatcagaacaacactttccagtaccaccagcgcaaaatacagcacaatgaagctgacatcaagataaatcgaaccgagcggcaatgggcgaatatagcgacgtagccagcgcagagggggttcggtaatggaatacacaatattgatcagctgggccaccacaccacgtggataccagtttcgtgcgagaacggagacccagtccagaatcatgcgcacgaacagaaccgtgatatacgcgttaatgagccatgcaagaatgcggccgatcagagagaacactaaggaaagcatgctgacagactaacaaccgcgcatgaaaagtttgctcggagcacaataagaatcggccgactccttgctgggagtcggccgaataccgatataacgtcgaatgcgaaaactactgaaccggtcagtcagcgaacaaatcgtgtgccgaggctggttttgtcggctcttcgaccttgatgttcacctgcgccgggctcaacaggaacacgcgcggagtgacacgctcgagggaaccacgcacgccgaacaccacgccggcggagaagtccacgatgcgatatgccacggcttcggccacaccggtgagattcagtacgaccggaacaccgtcacgcaatgcgcggccgaccagttgagcatcctcatatgacttcggatggatggtggtgattctgttcacacggccaccggggaacggcttggtagtcgacgatgcggcaggcgcggtggttgacgccagcggcgtgaccgtatggtcggaatcaaatgcggacttcgaagccggcttctgctcctcgtcctcctcgatgtagtcgtcctcatcgtccacaacgtcactcatgcccagataggacatcgcgtttttcatgaacccagccatggatcaatcctttcagcgcaggaagtcagggatgtcgagatcgccagccggatcgttcacggcgatattcggatgagcggaagtcggatcatcaaaaggcaacgatgcggagtcaccgatagccggtgtgaatgccggttgggcagtggcagcgggctgtgcagccggtgccggtgctggagctggctgtgccacgggagtcgcaggatcggcggcggttggcacaaccggcgtcaccgtgctctgagtgtcgtcatcttgagcggcgacggggtcaaaaccagcagcaataacagtgacacgcacttcatcgccataagcatcgtccagagcaagaccccaaataatctgggcttcagggtgaatcgccttgcgcaccagttcggtggcagcagaggcctcctgcaacttcaggtcggtcggaccggcgatgttgatcagcgcaccgtgtgcgccttcgatgctttcctcaagcagcggagagctgatggcgatttcggcggcctgcgtggcacgatcctctccccgtgcggaaccgataccaaacagcgcagtaccagcaccacgaagaatggagttcacatcgttgaagtcgacgtgaatataggagttcatcgaaatcaggtcagtgatgccctgaacaccggcaagcagtgcggtatcagcggtcttgaaggcctcaatgatgccgatggaacggtcggaaagctcgagcaggcgatcgttcggaatgacgatcagcgcgtcgacttccttgcgcaggttgtcgatgccgtattcggcggaagcggaacgctgagggccttcgaagctgaacggacgagtaacaaccgcgatggtgagagcaccctgttgatgagccgcacgagcgacgatcgggctggcgccagtaccggtgccaccgccctcgccgcaggtgacgaacaccatgtcggcacccctaagcgcctcttcgatatccgactggtggtcctgggccgccttggctccacgctccgggtcggcaccagcaccgagaccacgactggacttatcggaaagggaaatcttgacatccgcatcagagcgcagaagatccttcgcatcggtatttaccgccacaaattcaacattctgtaatccctcggcaatcatgcgattgacggcattaccgccggcaccgccgacgccaacaaccttgatgttggtcttgtcgttgaactcattctgcgcgatctcgctcacgtttggctcctgtcacttcacggttacacccaagagtagcgcaaacaggctactcttggagggaaattcacgcgcagaatggcgcgtgttgcgtgtattttcagtattttctcagtaactggcgtccattgggtcgtcaccgaagagcgcctcacgctcttcgtgggtggtggtacgcgattccaaccagccatacggcaagtgcaccttcttggcgaaacgcacgcggccgcgcggtttgtcgaccacgcgtggcgggtattcgatagtcgggtcgagcttgccgatctcgcggtccacatcggccaggctctcgcattccataaaggccttgcgggtggagccgcccaccgggaatcctttcagataccaggcgatgtgcttgcgcagatcgtggacggccatcatctcatcgccctcataaaactcggtaagcagctcggcatgacggtgaatcacgcggcagacctcgcccagattcgggttgagccgttcgggattgccctcgaaggcgtttttgatgttggcgaacagccacggccggccctggcatccgcggccgatggccacaccgtcgcagccggtctcgcgcaccatttcgagcgcatcctcggcaccccagatatcgccattgccgaataccggaatgttgaggtgttccttgagctcgccgatgcgggaccagtcggaatgaccgccatagtattcggcggcggtacgggcatgcagggttacggccttgcagccctcctcctgcgcgatgtgtccggcttcgaggaaggtctcatggttatggtcgatgccgacgcggatcttcgcggtgacggggatgcccgccggctcgcatacggcgaccacgcgctgtaatagctcagtgaaaatgtcggttttccaaggcaaggccgaaccaccgcctcgacgagtgaccttgggcaccgggcaaccgaagttcagatccacatggtcggccatgttgccgtcgaccacgattttcgccgcctgttcggtgatggaggggttcacgccgtacaactgcagtgaacggattttttcgcttttggcgaaatgacagaggcgcagtgctttcgggttatgcgccacgagggctcgagcggtgatcatctcggccacgtagagtccatcgggaccatattcctcgcaaatcacgcggaagggccagttggtcactcccgccatcggcgagagcaccaccggggtcggcacggtgatgttgccgagttggaccggggcgatatgcaccggggtcccggggcgcgccggcgcgtccgtacgtgggtcgaggttgtcggtctcgtgatgctcggtgagcactgtttcggattcggattgtgccatgtgattcctaagaaaataagtaggggctcccctgagagaggagccccggcgtctatcgccgccacttcgcctacaaacagcccactgggatgtcttccttacggctcagcccacagaggggagcccaagttgtgcgactccggcttagtacaggccgccggcttcctgaacgccggactcaggccaaggctcaccgcccatttccacaggcttcaggggcacgcgggtgcgcttctcgccgatgcgggcggccacgtaatcggccaccttgtcaagagcgacgcgctcctgggccatggtgtcacgctcacggatggtcacagcgtggtcctcgagggtgtcgaagtccacggtgatgcacagcggggtgccgatctcgtcctgacgacggtaacgacgaccgatggcaccggactcgtcgtagtcgatcatccactcgttgaagcgcaggtcgtcggccaggttctgggccacggtctgcagttcaggcttcttgctcagcggcagcacggcggccttgaccggggccagacgcgggtcgagacgcagcacggtgcgcttgtcaacgccgcccttggtgttcggggcctcgtccacatcgtaggcgtccacgaggaagcacatcagggagcgggtcaggccggcggccggttcgatgacgtacggcacgtacttctcgccggtggcctggttgaagtagctcaggtcttcgccggagtgcttggagtgcgcgctcaaatcgtaatcggtacggttggcgatgccttcgagctcgccccagtcggaaccctggaagccgaacttgtattcgatgtccacggtgcgcttggagtagtgggagagcttctccttcggatgctcgtagtggcgcaggttctccggcttgacgccgaggtcgatgtaccagcgggtgcgggcgtcgatccagtactggtgccattcctcatcggtgccgggcgtgacgaagaactccatctccatctgctcgaactcacgggtgcggaagatgaagttacccggggtgatctcgttacggaaggacttacccatgttggcgatgccgaacggcggcctggaacgggaagaggtcatcacgttcttgaagtccacgaagatgccctgtgcagtctccggacgcaggtagtgcaggctgttctcgtcctcgaccgggccgaggtgggtgcgcagcatcatgttgaagtcgcgcggttcggtccactggccacgggtgccgcagttcgggcagacgatgtccttcatgccgttttccggcatcttgtcgccgtgcttctcggcgtaggattcctcgagcttgtcggcgcggttgcgcttgtggcagttgagacactcgacgagcggatcgttgaacacgctcacgtggccggacgccacccacacttcgggcggcagaatgatggaagtgtcgacaccgacgacatcaggacgggtgacgaccatggagcgccaccattcacgtttgatattgtccttgagagcgacgccgagagggccgtaatcccaagcggaacgggtgccgccgtaaatttcgccggcggggaacacgaagccgcgacgcttcgcaagggatacgacttcatcgagtttggactgagccacaatgcaccttctggtttgaacggtttggggtctaataacaaccgcttcaggatagccgtatatggtgacaggtcaggcggcattgtccggtatatgttccgcgtctcacgagcggccgttcgcagcgattcctatatcgcaacacctccatattgttcctgttgttttacccttcccgaatttgtgccactgacatcgcgtcagcgtcacaaattcgggagatgttgctcggcggaggcgtctatgtatcacgaatggacggggacgcgccagacctgacgacacgtatcgaacaaatccgtcacgataatgtccatgttggcgcatagcgtcggcactgtaatgcaggggaactcgcatgtggttcgcgagttgagaaaggcctgagcctgacccttagaacctgttggttaagaccatcgtagggagcagtaaatgagcaatagtgcatcatcgtttaccggcgtgtccagcggttataccgccgggactccggttccagccgattcacccatccgtgacaatatcgccgatgccgttcgccgcgtacgcgagacgactccgttggcccagtcattcaccaattttgtgaccatcaatttggttgccaacgcgcaactggcggccggcggcactgcggccatgagtttcctgccggacgacgtgatcgaaaccgcgaaaatcgcgggcgcgaactacatcaacgtgggcacgctgctgccgttctataaggacgcactgcccgaaatcgcccagcgactcaactacttggacaagccgtgggtgctcgacccggtggccgccggcatcggccgcacccgtaccgccattcttcaggccttcaaggccgctcccccgaccatgattcgcgcgaatgcatccgaggtaatcgcgctggcgaacatgtgggggctcaataccgaaaccgtgggggacgcttccgagcaccgccccgccggagtggaatccgtcgacgacgtggagtccgcaaccggcgcggcggtggcgctggcacagtatctgaccgaacagcacgccaagcattcctcccatgacgcttccacccgctgcgccgtggccgtgtccggcatcgccgatctggtgaccgatggcgaaaccgtgtaccgactgccgggcggcagcgcgatgatgaccaagatcaccggtgccggctgctcgctgggcggcgtggctgccacgtatttggcggtctccgatccgttgaccgccgccctgtccgcgtctctgctgtacaaccgcgcgggagaggtggccgatacaacttcgcacggaccgggctcgttccaagttgcgttccttgacgcgctgtggaatgtgaccgccgaacaggtggcggaatccgagattttggtgcagtagtttcagttccctctgatgagggagctcataacagttttttccaataagacttccacaagaaacaacaaaagcaggaataataatgagtaatgaatacccatacgcctccatgcgcgacagcttcgacctgtccgcgtacttcgtggtggggccggaggactgcaaaggccgtccgctgaccgacgtggtggatcaggctctgcacggcggcgcaaccttcatccaactgcgcgccaaggaggccgatgcctctgagctgaccgacatggctcgcgacatcgcgcaaatcatcgaggacaatgagaagtccgattccgtggcctttgtgatcgacgaccgtgccgacgtggtgtggcaggcccgccgcaagggcatcaaggtggacggtgtgcacatcggccagaccgacatggagccgcgcgaagcccgcgccctgctcggcgacgaggccatcgtgggtctgtcggctgagaccgaaagcctcgttcggctcatcaacgagctgcccgacggctgcatcgactacattggcgccggtcctctgcacgtctccaccaccaagcccgaggcttccgtgggcggcaacgacggctccggcaagacgctggacgccgcccagatcaacaccatctgcgttgccagcgaattcccggtggtcgtgggcggcggcgtgaccgcagccgatatggccatgctcgccgataccaaggctgctggctggttcgtggtctccgccatcgcgggtgccgagaacccggaagaggccgcgcgcaccatggtcgaaggctggaaggccgtccgcggcgacaagaagcacggctacgctccgcgcgtcgtaacccacaccccgctactgacactcaggctgctcaggaaggggccgcgaagcccggttccgaggccactgagaagaagttcaccaacgccaaggacgccaaggatgcccagaagcttgccaagcagcagcgcgtggacatcgccgcccgtggttccaagcagcgcgacaaggcgcacatccgcaagaccaagtccgtaccgttcacctatcagtatggttcctacgacctggaagtgccgtacaccgaaatcaagctgagcgacacgcccggcgtgggcccgaacccgccgttccacgactacaacaccgaaggccccaagtgcgacccgaaggaaggcttgaagcccctgcgtctcgactggatccgcgaccgcggcgacatcgaagactacgagggccgccgccgcaaccttgaggacgatggcaagcgcgccatcaagcgcggccgcgccaccaaggaatggcgtggacgcaagcatgagccgatgcgtgccaaggaccacccgatcacccagatgtggtacgcccgccacggcatcatcaccccggagatgcagtacgtggccacccgcgagaactgcgatgtggagctcgtgcgctccgagctggccgccggccgcgcggtgatgccttgcaacatcaaccaccccgaggccgagccgatgattatcggatccgccttcctgaccaagctcaacgccaacatgggcaactcggccgtcacctcctccatcgatgaggaagtggagaagctgacgtgggccaccaagtggggcgccgataccgtgatggacctgtccaccggtaacgacatccataccacccgtgagtggattcttcgcaactcccccgtgccgatcggcaccgtgccgatgtaccaggccctcgaaaaggtcgaggatgatgcctccaagctgagctgggaactgttccgcgacaccgtaatcgaacagtgcgagcaaggtgtggattacatgaccatccacgccggcgtgctgctgcgttacgtgccgctgaccgccaaccgcgtgaccggcatcgtctcccgcggtggctccatcatggccgactggtgcctgcgccaccaccaggagagcttcctgtacacgcacttcgacgagctgtgcgacatcttcgccaagtacgacgtggcgttctctctgggcgatggcctgcgccccggctccctagccgacgcgaacgacgccgcgcagctttccgagctcatgactctgggcgagctgaccgagcgcgcctgggccaaggacgtgcaggtgatgatcgagggcccgggccacgtgccgttcgacaccgtacgcatgaacatcgagctggagaaggccgtgtgccacaacgccccgttctacaccctcggaccgctgaccaccgataccgctccgggttacgatcacatcacctccgctatcggcgccaccgagatcggtcgttacggcaccgctatgctgtgctacgtgaccccgaaggaacacctcggcctgccgaacaaggatgatgtgaagcagggcgtgattgcctacaagatcgcctgccacgccgcagacatcgccaagcaccacccgcacgcgatggatcgcgacaatgcgatttccaaggctcgcttcgagttccgttggctcgaccagttcaatctgtcctacgatccggacaccgccatcgccttccacgacgataccctgcccgccgagccggccaagatggcgcacttctgctcgatgtgcggcccgaagttctgctcgatggccatctcccagaacatccgcaaggcattcggtggcgaggccgctcagcagcaaatcgtgaaggaggctgctgcaggcatcgactccgaggcactggctacggccaaggccaatgtcgataacggcgtggtgtccgccaacgtgctcagccccgaagaaatcctcgccggcatggatgcgatgagcgaaaagtacaccgcccagggcggcaagctctactccaccgcccaggagtaaacctctctggctcccctctctgaggggagccaattattatgcccggtggtgtcttaattcgggacgacgctcgactcgctcgaaggcggtgccgaagtgtgcgccatctggaccgaggccgtcggaagtctccaggaccacgccttcgttgagcgcacggcgcacgatgcccacacggggcttcaacggccacacatcatgcggcactttgcgatagaaatccgtaccgacgagcaacacgtcgcccacatcgaacacttcctgacgcggaaatgtgagctgtgtggtgtgtccgttaggcattacgccaaaatatgcggtgagttccggtgatgcgcaccaagacgccgtcacggcgcagtacatcgttatcagccatgtctcctcccgaacatttcatgaatcaatcgcaatcagcaaaccttccccgtctcaccacaggagcggcaaaacatcaaggaaaaccgctccgaaaaacatcatgggccccacttagaatgaacactatggcacaaattgcaacatctacacttcccgctgttctcgcgatctccggctccgactcgtccggcggtgccggcatgcaggccgatctgaagaccatgctggcctgcggcgtgttcggcatgagcgccatcaccgcgctcaccgcacagaacaccaccggcgtgcgttccattcaggataccaaaccggacattctcgccgaccagatcaacatggtgtttgaggatattccgccggtcgcggtgaaaatcggcatggtgtctgccactgacatcatcgacgtcatcgctgaacgactcaccttccatcacgccacgaacatcgtgctcgacccggttatggtggccacttccggcgccaatctcatcagtgacgatgccattgcggccttgaccggcaagctgttcccgatggccacggtcgtgactccgaacattcccgaggccgaagtgctgaccgatacgctgattcgcgatcaggaggatatggaggccgccgcccaccgcctcgtggagcgttatggctgtgccgcgctggtcaagggtggtcatggcaccgaggatgccaacgatgtgcttgccgagacggatggaaccgtgacctggtttgatggcgcgcgtatcaataatccgaacacgcacggcaccggatgcacgctgagctccgccatcgcctcgtatctggcgcttggcgacacattgcccaaggccatcaagcatgcgaagaagtatctgaccggtgcactgaaggcccagctgaatcttggccacggctccggcccgatggatcatttctggaagtatcgctgagtcctactggctctcctctctgaggggagccaagtaataaaaggagaattatgattattgaccgtaatgccgttactcaggaagtgccgatcgacccggaaaccggcaaaccgtacctcaataccgtggccgccattcaggtgtcggccaatggcgtgggctccgaggtttcgccatacgtggctcaggccgtcgaggtgattcgcgaatccggcctgccgcaggaaaccaacgccctgttcaccaacgtggaaggcgatctggacgacgtgctcaaggtggccggtgaggccgccaagaagctcgccgagcagggctaccgcacttctctggtgctgcacatggatatccgccccggcttcaccggccagctgaccgaaaagcccaagctggtggatgagatcctcgccgacaagcaggcgaagtagcaaagcatcgcttccaccagcaagggcatgctttgttattacacgtttcatggggcggtagctcacccatggggtggtaaaaccctcatggggcggtagtcgaaaacggctctattctgcggaaaggcaaaatccgctaaccgccccatgggccaaataccgccccatgagtgttttaccgccccatgggaatcacggttctgccttctttcgacggggtaagagcgtaagtggggcatatataggagcgtcacaacctctgttatcgttcacgatgtgaccgcaacgcggcgtgccacaaaatcgaacctatagttaagccccatgtagtgagctatctcacaacgattggctcgctacgtagaattcaagacttggatcgcaaacgtcgttcatcccacacaatgggagggcgaacggaacacacagtccaatcaagagttcgctcgccgcaacaccattgagcagttgcacgcgggcaggtttgcaagaagagggctcaaatatgactgctgctgaacagcagatttccggcaatcccgcggctatggaaaacgcacaagcacgtaccaccgtgacggatcaagccaaggttcaggatattatctcgcgcatggatcgcgcacatgaaaccccgatgttccatcgcatcgtgacgctggtcgccgctggcatgctgatggacagcatcgacgtatatattggcagcgccgtcgcctccagcacgttggctacccgctggtccaccgttgcgcaaaattccacctttatgtccgcgggcttcctgggtctgctggtcggttcgctgctggccggcttcgtcggtgacctgaagggccgccgcgtggcttaccaaatcaacctgctgctgtttggcggcttcaccttcctcggcgcattcgccccgaacatggctgtgctgtccctgtgccgtctgggtgccggcctgggcctcggcgctgaaatcgtcaccggcttcgccatggtcaacgagttcgcaccgatgaaccgccgtggccactggtgcgcgattgtctcgctcgtggccaactgcggtgtgccaatcgctatgctgctgtgtgcatggatcatcccccgctggtcctggcgtccgctgttcgtggccatcggcctggtggccgccatcatctggtggctgcgccgcgacatccccgaatccccgcgttggctcgccgtgcgcggccgttacgatgaggccgacgccatcgtcaagcagcttgaggccaacggttccgaaccgatcgacgcagccgccaaggccgacaccagcgacacccgcaacgccggaggccgttcgctcggcatctgcctgcttgtggctgtggttgctgtggccgccacgaacgtgtgctcctacgccttcacttcttgggttccgacgattctggtcaagcgtggtattaacctgtccagctcgctgctcacctccacggtgatgatgctcggtgccccggtcggctgcctgattggctctctgcttatcgaccgtatcggccgcaagcgcacgattgtgccggccttcctgttcactggcgtgttcggtttgatgtatgccttccagacctctaccgtgagcgcaattatcgttggcttcctgctcatgatgtgcctgtacgtgcttatggcttccgtggtggctgtgtacgctccggaactgttcgccaccaaggttcgcttccgttgcgtcggcttcgcgaacgccgtggccaagctgctcaatgtgttgatgccgatggtggtgggctggatgcttacctcgcttggtgccacgtccatctttgtggccatcagcgcgattgctattgcatcgatgctgattgtcggcttctttggcgcggagactgcgcagaagtcggttgggtgatcggtttcctcacagtggaataactgctgataatgtccattcggcgtcttgcgtggtgatatgcagggcgccgttttgttgttctagtaattgttggtaacggttgaggccggtgccggtggataggtctgcgtctccagcggacaatcagcgtctgtgatgtcacatgcaatgccaggagcggcatcaacggtcgaatcatgcggagtcactgcactgtgcgccgcttctcccctgccttcaatcacatcaatgacttgatgcgtgcgatccaatgcgcccatagacatatccgtaaccagcacgtcaggccgcttggtggggctcaggcatcggctgatggccacagcacccaaatcgcaggtctatatcacggcaaaatcgctggacatacgttcgattagcgcgccgaacactttcagcgcatatgggtcattgtccacaatgccgatgcgtatgttgcggttgcgcgcttcttccattacattcaccccttcagtgtgcccgacgccgaactactccgtcctgacacgtcatggtcactatgacaactatcattccacatttcctgcgtgatttacgatggaatcatcatcaatccttgacaaggcggtaaaggaggacggcaatgaaccgtgcacaagcactcagcaagctcaacaggagcgatatgcgcaatgccgccgccgagcgcgggatgcaacgactgttcacatggaaccgcgcgcattggattggcatggttgtactgatagcggtgttgctgctactgcagtggagctcatcaatgtatctcatgcccgacgaggttcttgacagggctgccaaaaacctgttcgtatggttccccggtatggttctgcactggccattggtgttgggaatcaccaacttgatactcggttcgacacgatccggcagtctgtctttcccgttggcgagcgcaatcatcggaccactggcattcggctggaccaatcttcgcttacggccggggttcccataccgttcctgggctcaagggaaagccgcaatataatgaaaacagcgatttcatgcaatgatgcacgagccgatccaagcaaaggggccaaccatgagcgagcaactgatggaacagtaccggttgcgcggacaacgcaaatgccgtaacgcttgtatcgccgccatcgtgacagtagtgcttgtccttgccgtcgccggcggcgtatggtggacggccggcgatggcagcgcattggttcgcaatatgttcaagccgaaggccacgcctgccacgcagccggtagtcaacagcaccgcaaccttcgcctaccgcaccgcaccggaattcctggcgatggaagccggcgaccgaggcaccggcaatgtgaactactctcctgcttcgatgtggatggcgttggccatcgccgcgcagggcgccaatggcacgacccgctcgcaactgaacgaactgctgggctccggttcgctgaccgatagcgactaccaatcgctgctaagttcgatcaacgggcaatattcgggggcgaaatccgagatgagcgccgcgaactcgctgtggattgatgacgactactctcttgccagcgattaccaatccaccgtcaagaagatgttcgaggccgaagtcaccacgttaccgttcgacgatcaggccgccgcaaagatgtccgattggatcgccaagcatacgaatggttcgctcaagccgaagattacgctgcgtgaccgtgaagtcctgtccatcatcaacaccgtctatgcggatggccgttggaaggatccgttcgaagagcagtccaccggcaacggcaccttccacggcgaagccggagatgctcaggtgccgatgatgcaccggaccttcagccaaatggcttacggacatgatgagtacaacacttggcagcgggtggagattccgttcgacaacggcggcaatctggccatcgtgctgccggccgaagggcatttcgacgagttggccggcgatgccgagaagctcagttgggcgttcggtacatgctcgacggcttcccttggcgagggcgcaatgggttgcgccgcggacagtatgcccggatggggcgtctccgtcaactcggtcatggtgaacgtcacgctaccgcgattcaccatcgacagcatgttcgactcggaagccaccatcaaggcattcgaaaaactgggggtgaccgatgcgttcagtgcaggcgacgccgacttcaccaagatgatcgacaccggttcgcacggcgagaacctgtatatcggctcgattctgcaaggcacgcgcatcgaggtgaacgaagccggcgccaaggccatgtccttcaccaaggtcggcgcagactccgttagcgcgccggtggacaacgtcgagttcacggtggatcgcccatttctgtattcgtacgtcaccccggacggcataccattattcatcggtgcggtgcgcaacctcggcggagtcggtggagaaaactgatactttcctggcagtccgtcaattagggtgtatcgtttgacgcatggttacgatgaaggaaatcgcgaacaaggcgggggtttccgtctctacggtatcgctggtgctcaacggacgcgacgaggggcgcgtaaagtccaaaattgcggacaatgtgcgcgccatcgccaccaagctcggctaccagtcgaatccgctggccagttcgctgcgtacaggcaggacgcacatcctcggtttcatcagtgaggaggtggccaccaccccgtacgccggcggtatgattctgggcgcgcagaccgctgcaagccagttcggctatatgctcatcaccgtgagcaccgacggcgagaacagcgagagcgaggaaatcgccgcactcaagcgatacggcaccgacggctttctgtacgccaagatgtcgaaccgcatcacccatgtgccttcctcgctggccaagacgccactggtgttggtggatgccaccgactcgcttggcaaaatcccgagcgtggaaccggacgagttccaaatcggctacgacgccaccaccagattggttaaggccggatgcgcacgtatcgcctatgtgggttgcttggagccgctgattgcgcaggacgatcgtttggaaggctatcaggcggcgctcagggacgccggcctcgactatgacgatcatctggtcgtcaatgtgctcaacaacgggccggcactgaccgcagtcagcgatttgttcgatgccgagcatccggacggattcttctgcttcaacgatgcccgcgcctggtatgtgtacgaatgcgccgcacgccgaggactcacggtcggcaaggacatctccgtggtcggcgtggacaaccatcgcgtgttcgccgaaacgctggaaccgatgctcaccactgtggaactgccgcatttcgagatgggctactgggccgtggccaagctggtgtcgattatcgaaggacgctcgatggacgacgtctcatggccagcgaccacctcccctgccgccgatcgacgcgccgattccggcgaagatccactgcacgctgatcgaaaaggcctcggtgaagtaaccgagtcccacacgatttctcaaggcctccgttcagcacggaggccttttgcgtgtcgaacggatacgacacgccgatttacgtcaatcgattgacgtaaatcgattgacgtcgcataataattactacgcaacaacttctacaaaggcacggccgcccgagcagaagcgttacataaccaataaccaaccaagtagtaatcaaaggatgattatggcaagtgcaaccaaatctgcatggaagaatccttcctatctgcagagctctttcggcatcttcatgttcttctgctcctggggcatctggtggtccttcttccagcgctggctcatctcaggcgttggattgaccaatgctgaagtcggcaccatctactccatcaactcgctggccaccctggtcatcatgtttgtgtacggcgtgattcaggatcagctcggcatcaagcgcaagctcgtcatcgtagtctcggtaatcgccgcctgcgttggcccattcgtccaattcgtttacgccccgatgatcctcgccggtggcaccacccgctggatcggcgcactcatcggctccatcgttctgtctgccggcttcatgtccggctgctccctgttcgaggccgtcaccgaacgctactcccgtaaattcggtttcgaatatggccagtcccgtgcttggggctccttcggttacgccatcgtggcgctgtgcgccggcttcctgttcaacatcaacccgctgatcaacttctgggtcggctccgcattcggccttggcatgctcctcgtgtacgccttctgggtcccggccgagcagaaggaagagctcaagaaggaaaccgacccgaacgcagcccccaccaacccgtccctcaaggaaatggtcgccgttctcaagatgccgaccctgtgggtgctcatcgtcttcatgctgctgaccaacaccttctacaccgtgttcgatcagcagatgttcccgacctactacgccaacctcttccccactgaagaaatcggcaacgccacctacggcaccctgaacggtttccaggtcttccttgagtccgcaatgatgggcgtggtcccgatcatcatgaagaagatcggcgtgcgcaacgctctgctgctcggcgctaccgtgatgttcctgcgcatcggcttgtgcggcgtgttccacgacccgatcaccgtctccatcgtcaagctgttccactccatcgaagtgccgctgttctgcctgccggcattccgctacttcactctgcacttcgacaccaagctctctgccacgctgtacatggtgggcttccagatcgcttcccaagtgggtcaggtcatcttctcgacccctctgggtgccttccacgacaagatggctcagattctgccgaacaacgacatgggatcccgcgtgaccttctgggtcatctccggcatcgtgctgtgcgcgctgatctacggcttcttcgtcatcaagcgcgatgatcaggaagtcggcggcgacccgttctacaccgacaagcagctgcgccagatggaagcggccaaagcctgaaaggaccaccatgactgacttcactcccgaaacccctgttctcacccccatccgcgaccacgctgctgaactggcaaaagccgaagccggcgtggctgagatggccgccaagcgcaacaaccgctggtacccgaagtatcacatcgcctccaacggtggctggatcaacgacccgaacggcctgtgcttctacaagggcctctggcacgtgttctaccagctgcacccctacggcacccagtggggtccgatgcactggggccacgtctcctccaccgacatgctcagctggaagcgcgagcccatcatgttcgcaccgtctctagagcaggagaaggacggcgtgttctccggttccgccgtcatcgacgacaacggcgaccttcgcttctactacaccggccaccgttgggccaacggccacgacaacaccggcggcgactggcaggtgcagatgaccgcgctgccggacaatgacgagctcacctccgccaccaagcagggcatgatcatcgactgcccgaccgacaaggtcgaccaccactaccgcgacccgaaggtctggaagaccggcgacacctggtacatgaccttcggtgtctcctctgcggacaagcgcggccagatgtggctgttctcctccaaggacatggtccgctgggaatacgagcgcgtgctcttccagcacccggatccggatgtgttcatgctcgaatgccccgacttcttccccatcaaagacaaggacggcaacgagaagtgggtcattggcttctccgccatggggtccaagcccagcggcttcatgaaccgcaacgtcagcaacgccggctacatgatcggcacgtgggagccgggcggcgaattcaagccggaaaccgagttccgcctgtgggattgcggccacaactactacgccccgcagtccttcaatgtggaaggccgtcagatcgtctatggctggatgagcccgttcgtgcagccgattcccatggaggatgacggctggtgtggccagctcaccctgccgcgcgagatcactcttggtgatgacggcgacgtggtcaccgcgccggtcgccgaaatggaaggcctgcgcgaggataccctcgaccatggttcgatcacactcgacatggatggcgagcagatcatcgccgatgacgccgaggccgtggaaatcgaaatgaccatcgacttggctgcctccactgccgagcgtgcgggtctgaagattcacgccactgaggacggtgcctacacctacgtggcttatgacgaccagatcggccgcgtggtggtggatcgtcaggccatggccaacggcgatcgcggctaccgcgccgccccactgaccgacgccgaactggcctccggcaagctggacctgcgcgtgttcgtggatcgcggctccgtggaggtctacgtcaacggtggccaccaagtgctgagctcctactcctacgcctccgaaggcccgcgcgccatcaagctcgtcgccgagtccggtagtctcaaggtggattccctgaagctccaccacatgaagtccatcggactggagtagctctttcacctccctctgacgagggaggttttttgtgcgccctgtcgttcgccttcgcctatactgatggacggcatataacacgatccatcacacgaccggcaggcgcgcaggctcctcaccttactgttccacgccccggccgcaagcgccaccagcaaaccggactggcgcggaaagcaaggtgacatcccatgtccatcgccaagcgcctcaagcgccgcatgcccaccgtcatcgccgtcatcgtattgctggcagtctgggaaacgtgggtggatctaggacatgtctcccccacgatgatctccgcgccaagcgagattttcgccgccaccatcgaaacatggaacacgctcggcccggccgcggcaatcaccggctatgagggcgtggtcggcttcctgtttgccgtgttcttcggcattatgatcggcattgcactgtactgctcgcacacgttcaacgcggcgttctatccgctgcttgccgccgcacaaaccatgccgctgatttccatcgccccgttgttcctgatttggttcggttttgagatttccggcaaaatcgtaatcgtggcggtattcggcctcttccccatcgccgtgcagactgtgcgcggactagaagcagtgccccagttctattccgacgtcgcattgacctgcggcgcgaccccggtctggacgctctggcacgtgaagctgcgcgttgccgcacgtcagatctatggcggtatccgagtatctgccgcatacatcttcgccacggcatccaccgctgaataccttggcgcacgcaagggccttggcatctggctgcaggctgcctacaattcattccgcacgccgctgatcttctccgccaccatcgtcattatcctgatgacatgcgtactgatgctggcggtaaacgccagcgagcgcatcctgctcggcccggccggcgacgacgaagaccccgacgcggaccagtagttcttttttaccgtcaaaggcacgagccggcagccaggaccgactgaacgaggcggcttctcatgaggtctccaaccctgtctctataatggaacagctttaccagcgtgtggcaaaccggctttcccgagctttcatagggaatgtcgggggcgctggtcgaacggaaatcaaggccctccatatcgttttctgccgacttccgttcgaagcaatcccagagaacgatagagagacaacgaattagggaaccatcattatgaagaaaagccttgtatccaaggccgctgccctcgtgggcgcccttgccatgactttcggtttcgccgcatgtggccagaccaacaccgccgactcctccaactccaacacctccgacctcaagaaggtcactttcatgctttcctgggcacccgataccaaccacatcggcgtgtacgtggccaagaacaagggctacttcaaggacgccggccttgacgtggatatcgtggccgtggcccaggccggtgccgaacaggccgtgaacaacggtgtggccgacttcgccctgtccaacctgaccaacgtgggcgtctacacgctgaagggcgctcacatcaagcaggtgctgcaggtgcagcagaagccgagcgccatttggtgcgcactggcgtccaacaccgccatcaagtcccctaaggatttggatggcaagaccttcgccaccttcggctccaacgagtccgatgccgtggtgcgccgcatgatccaaaccgatggcggcaagggcgaattcgacaaggtgaccgtcggcacctccaccttccagaccatggaatccggcaaggccgatttcggcggcttctacgccacgtgggaaggcgtgcaagccgacatgtacggcccgaagctcaactgcttcaccgagcctgactatggcgtgcccggcaacgccgacaccatcggcatcatcaccaatgacaagaccatcaagaacaatcccgacctggtcaagaagttcactcaggccactcaaaagggttacgagtacgcgtacgccaacccggatgacgccgcgcagattctcgtggacgaagcccctgacgccaacctcaagcccgaattcgtcaagaagagcatgcaggttatcgtcgacggccagtactggggcgatccggccaagatcaaggacggctctttcgtgctcggcaccaacgacttcaagggcgctcaggaatacttcgacttcctggctgaagaagacgcatacaccgacagtcatgacaagataattcatgaggccccgcaggccaaggaccttgccaccgacgaattcatcggcaagtaatttccgatattccgagtttgaatctacgcaaaaatgcgtccttcccatgaggaaaggacgcatttttgcgtatcggccgataaggttattcatagcggatcacgctaacaaggagacgattctatggtccaatgtcctgaccgcattattgccagcatagatacgggtgttgatgatgcgttggcgttggcgtatttgttggggtcgacggatgagtgcgagttgggtggcgtgattgccagttatggcaatgtggatgcgaacacggcttatgccaatacttgcgcggtgcttgatttgtttggtcgggcggatattccagtgtttttagggtctgagcatccttcttgggctgatgcgtttattcctgatgcagggtgtgcccagttccacggggatgatggactggggaatactcggctggcagggtccggggctctggctgatggagctggtgtgcctggtgatgatatgtctggtgatgatatgtctggggatgacatgtctgtggatgtgcccgatgaggttgtttctgttggcgggtatttggcgggggatgttcatgctcatccggcgttgggtgcttgttctcgtgtgaaccgctctcggtcggtgggccacccccagtcgactatgccgacagctctcgccagcgggggcaaaaggagatgctccgttgatgctgcggatgggattgagtatctgattgagcaggttcgcgagtttggccgagacgttaccgtgctggctaccgggccgttgacggatgtggatgcggctattactcgagcaccggatattgcatcgaaactcaggctggtgatgatgggcggtacgcttacccaacccggtaattgttgggatgcggtagctgagacgaatatcatccaagaccctgaggccgcgaatcgtgtatttcattccggcgcagacatcacaatggtgggacttgatgtgactcaccagtgtttgctaccgcaatcggcggccgaccggtggcgtgcgacggggaccaagcgcgggcggttcttggctgatctcgcggacttttccatcaaggcaaatttggaagccgaccccgcactgttctctggcggcatgccgttgcatgatccgttggcggcggcggttgcacttgattcttcactggtcgattgttttgatcttgcgttgcgcgcggagaccaataccggtgatttcaatggagtacgaggccggaccaccggagacccggttgggctggtgaatcattccatgccgcatgtgcatgtggcacttggtgtggattcggaacgttttttggatgagtttgtagagaggatggctgaggtgtgccggtaactcccctcagtccgctacacgggcagctcgaccgcaattacggacaagctgccgctcgcattcttctggcttgactctcgtctcgccttcgcctacaaacagcccaccgggctgtttgctttacggctcagcccgtcagaggggcctaacaaggactatttcacaccgccgaatcggcgatcgcggtggatgtaatggtcgatggagcgccatagcacgtcacggccgcagtccgggaagagttcgggcacgaagtcgagctcggcgtaggcggcctcccacggcaggaagttggaggtgcgctgttcgccggaagtacggatcaccaagtcgcaatcgggaatgtccggattgtacagatggtcggcaatcatcttctcagtcacacggtcgccggaaatcttgccatcgcgcacttcgcgagcgatggcggcgcaggcgtcggcgatttcagcacggccaccatagttgatgcagaacaccacatcgatgaccttgttgttcttggtgcgctcctcggcggcttcaagctcgtcgatcaccgacttccacagcttggggcgacggccggaccagcgcacgcgcacaccccactcgtccatctgttccacacgacggtggatgatttcacgcgagaaacccatgaggaagcgcacttcctgtggcgagcgcttccagttttcagtggagaacgtgtacaggctcaaataccgtacaccggcttcgatggcaccggcgatagtgtcgaacaccaccggttcggcggcctgatggccattggtgcggaccatgccgcgctgcttggcccaacgaccattaccgtccataatcacaccgatatggcggggtaccttgttcttggggaagtcgggaatacgagcggggtcgctgaacggagctgcgggaatgtccaacgacgtgtaatcaacgttctcaaaagccatactcatgaatctatcaagcgcagcgaacgaatcgggcgttcgaggtaatactcccccaatcttcaaccaactcctgcacaacccgctccacaggcgcggcatcaagcaccgaccaatcgccacgaatcagtgcatcgaactggtttaacacgaacggtgcgatacggcgcgcatcggtagtgtggtcggcttcgcacatcacgccgccggacgcgatggacaggtacgccggctccgccttgccgcataccacgcaagtgcccaatcgtggcgtccaaccggccaaggccaaggcgcgcatcacgtaggagtctcctatggcttgcggggcgtgggattgtttggcgagcgcgttcaacgcgccgatgagcagccgatattggttcggcagctgctcatgttcggtgctggcgagtttatcgatagtctcaacgatgacgttggcggcctcatacgccgcataatccgccgcgatcggagcaccataagcggcgaccgcttcagcttgggataccacgtcaagcgagcggccttcagcgataagcacatcgacgcgcatgaacggctcgagcctggcaccgaagcgtgatttggtgcgacgtacgcctttggcgaccgcccgaatcttgccatgcccacgcgtcaggatggtgatgatacgatcagcctcgcccagtttggaggtgcgcaacaccacaccttcgtctcggtacagcgacatctcatctcctttccccgcgacgcccggcagactccactcaatgaagtagtcagtaaataaacagaccccagaaagcgaacaccaacagtatgtacagcatggtgaaggtcaccagccagaacaggattcggcccagacgggtggaggcgagtaccgggtcggcaccggtgacgatgtctcgaacggattcgcgacgagggggtatctgaatcaggccgcggacggaagcggcttctatcaggtgcataaagacgcgggaccaagcccatagcaccagcacggacaccacttggatgaccggccagctccaatacatgacacccggcgtctcggtaggtgcgccaccccatgcaagtttgaccacgcccatgatcacctgcccgagtccggcgaagaagatgagcaatgtggcaagagtggtgagggtcaaagtcagcagcgcattgccgaaaccatgtgcgaaaccgagtaccacaggccgttccggtatcagcatgcccgcatgtttggcctcgcgcttctctcgccgccatcgggcatccgccgcgattttgcgacccagcgccaccagtgccagcacgatggatgcgagcagcagcagtaccaccgtgacgtgcagaatcacaccatatatggtgccgacgcgtcttgccttcaaagcgcccggcagaccgattgattggtacagattggtgccggccaccttttcactggtctgcgtgagtccggcggaagtgccgacggcccagtcgatgagatcgtccacataggcgtccgcaaacggggtgcccgcttcggactcatctcccaaacgcagcacatggttggcgaccgggtagctgcgcacggtcacattccagttatcggctttgtgggcgttgtagagaatcgcacgcacaccgtcgacctgcgccgtcatcacgtctttcgaaccgtaagccacataggtgggtacggcgtaggcggcgggtttgagtgtggcgaggtcgaaattgttcagtccgaacaggccggtgtccgcgctgaacacacgttggacgatggattgatagccttcgttcgcgccaacaagggtgaagtcctgggtgacgaaaaatcccagtgattggcgtgggctgaacaccatcgggctcagaagaatctggaaggcgacgtccggatcgtcctcgagcagatacgaggagatccatgtcgattcggaggtggcatagatgccgaccttggcctcgtctacatcgctttggtctcgcaggtattcgatgacctgatcataagccttggctgaggccggataatcgcggttgatgtcggtggtgttccagacgggtttgtcgagcactgcggtcacaaagccggccgaagccataccggaggccacgtcgccaaaggagttgtcacaggtgccgtatccggcaccgtgcatgaacaccacgccggggcgcttgcctgatgcgttctgaggttcccgaatcaataccttgatagcttggacgccgtccgcattggccttgccccgagcaccggactccttggtcagattgccgtcgctggtcatgttcagcgtgatgtatcgctcggtgacctcatacgtgccttttgccggcagcgtttctccggacgggttatcgaaggtgacttcggtatcgtcggtgagcgtggccatcgactggccggtgggttcgatgttccaaggcaccgtggtcagattggaaatggagaccagcacgccaatcaggataatgaagatgggcaggctgaccatcagccggtggatgctggtccacggcttggatcgaacagtcaggcgatgctcttcttcttgcggcacgtgcgctattgtaatctgaccgcgatatttatgccgagggcctattcggccgaatcagtgaccggggtgctggattgggaccacgaccgggccggtggaattgacggggacttgaccgtcggcctccatttgggcggcgatatcgttcgctatggtgagcagcgtgtcgacgatctggtcttcgggcacggtcttgatgaccttgcccttgatgaagatctggcccttgccattgccggaggccacgccgaggtcggcttcgcgtgcctcgcccggaccgttgacgatgcaacccatgacggccactcggatcggcgcggtcacgtccttcaggccttcggtgacggcggaggcgagctggatcacatccacttgggcgcggccgcagctcgggcaggagatgatgtcgaacttgcgggggcgcaatcccatgtattccaagagtttgcaacccaccttgacctcttcggccggcggcgcggagagagacacgcgaatcgtgtcgccaatgccctcggccaagagcgcaccgaacgccaggcaggatttgatggtgccttgccaagcagggccggcctcggtgacgccgaggtgcagcggccaatcgcccttggaagcgagcagtcggtacgtttcgaccatggtgatgacgtcatggtgtttgacggagatcttgaaatcgtggaagccgacgtcctcgaacatgtgcgcttccttcaaggcagaggccaccaatgcttccggagtcgggccaccgtatttggcgtagagttccttgtccagcgagccggcgttcacaccgatacgcagcgagatgcccgcgtcggtggcggccttgcagatgtccgggccgacttcgtcgaacttacggatgttgccggggttcacgcgcacggccgcgcagccggcgtcgatggcctggaacacgtatttggactggaagtggatatcggcgatgaccggaatcggcgatttgcggcagatttccggcagtgcgtcggcatcgtcctgactcggcacggccacgcgcacgatgtcgcagccggcggcggtcagttcggcgatctgctgcaacgtggcaggtacgttggccgtgagcgtgttggtcatcgactgcacggagatgggcgcgcccccgcccaccggcaccgggcccaccatgatgcggcgggacttgcggcgcgggtgcaagggcgattcgctggtcaggtcgaccggatcaccggttttgcggaacggcttttcgatgggattttccgtattcaaggtattcatcattgcttgtttatcaggtcgtcggcgcgtcggcgggcttcaagctcaagctggttcatttcctccacgtccgtgaacagcgggttaccacgaagctcggcgtccatctggtccagcacggctttgaccgtgtccacgatgccgaggtatggcagacgatgctcgaggaaggcatgcacggcctgttcattggctgcattgagcaccgccgtatgcttctcggaggcggccaggcagtggcgggccagttgcacggcagggaacgcctcatcgtccaacggttcaaaggtccaagttgcggcttgcgtccagtcgcacgcggcggccacattggtcatgcggtccggcgcggacaggcccagcgcgatgggcagacgcatgtctgggggcgaagcttggcaaatcgtggcgccatccacaaattcgaccatggaatggacgatggactgcgggtgcacggtcacgtcgatgcgttcaggcggcacgttgaacaagcgggacgcctcgatgacttcgaggcccttgttcatcagtgtggaggagttgatggtgacaaccggccccatgttccacgtcggatgatgcagcgcctgctcgggagtgatgttctccatgtcggcacgtttccagccgcggaacggtccgccggaggcggtgaccacaagcttggcgacttcggcgtgggttccggagcgcagggattgccagatggcggaatgctcggaatcgaccgggttgatttggttctcgcgcacttgcgcgctgaacagcagatgcccgcccgcgactacggactccttgttggccaatgccagctgggaaccggccttgagcgccgcgatcgacggttcgagtccgatggagccggtgatgccgttcaatacgacattcgcaccggagccggccatggcgatgaccgaatccggaccgccggtcacgcggacaccttgtgcgccggcctgtgcgagagctgcttgcagcgctggaaccttggtctcatcaaacaccgcgacttcggacacatggaactgtgcggcctgttgcgccagcagctcgatatgtgctccgcccgccgccagaccggtgacggtaaatcgttcaggatgacgcgagatgacgtcaagtccttgggtgccgatggatccggtggatccgagaatgatgacagtggagttggaggctatgctcactgttccttcttcgtatcgtcattgttcagtgtggggaacgacaggtcggggatatccgaatcgaagttaccgccaagcgggaacagcagcgggaacgaatcgctggaatcgtgcttatcctgtgacggctgagctgcttccgtgtcatgggaggcggcaacgtattcagatgattccgcagccggacgggagatcgtgctgtctgcaggctgactatcggatacgcgaaccggaatggagttcgtgttacgatccggcttgctggtgggagcaaaggagaccggcatagcagcggacgcagcctcgtcagcagtgctattcacaggctgtactgccggggcggagggtgccggggatgaaaccgaacccggtacctcattcaatttcagcgcattcggtgcatcaaggctgggcatcttaggagcgaaggacggtgcatccactgccggaagttcctgagaaaccgcagccatgtgggcgagagcggccaaagaggaatcgttctgcaccatatccacgggctgttccgcgaacaccgacggggtcgatgacggagctgcgggttcgtgagctgcctgtgccggagcaaacgaggggacgctgccagcggtcacaccggaaaccggcgcggacggggcactgacgggaggctcagccgcagcaactgcggtaggagccacggaaggcgtctcggagacgggcttcgccgcagactcgttggacgcatgcaccgggtatgctgcgggagcaaaggaaaccggctgttccgcattggtgctattggtgcttgtggaagcatcgaacgatgcaggagccgacgcataggtgatcggtgccgccgcggccggcgctgcgggagcaaccggagccggagcagtgaacaagctctgctcggcctgatgcagggcatcgaatgattcgtcatgagcaacggcagccggagcaaaacgttcgtcagttgccgggcgctgcgttccggaagcgaacaacggtgagacgccgttcgcttgaacggtcacgttcgtggcggtctgggcaggagccgcaggctcgccggacacgaaatcggccacacgggcataggattccaagcgactcagcaactgtacgcaggcgttcaggaagtaatcgacctgtcgctcgtcatagcctttcttgcccttgcgctgggtgaagatcacattgttgaccgtattcgcattgagatcggccaaagaccgtacatcgtcttcggtaacgccgtcaacgcccaatgcggccgccgccttgtccacaatctggtcgaccagacgatccacctgcttcttatcgtacgaaggctgcttgggcgctccggacttgaagcgttcgcgctcgttacgctccgcatggttctggacttcgtgatacagcttctcggtcttcgccttccacgtcacacgcccgtgctgtgcgatctcccatgtggtctgcttatcgaccacggcacgttccagacgtccaagcgcggcgtcaacctgtgcgatcacatagccgttcttgcgcaaatcaaaggacacgttctgaatgtcatgctgggtgagattcatgccctcgctgtcatacaaagcatgggcgcgctccaggaaagcgtccacctgagcggggtcatacccccacttgcgcttgcccgcacgtgcgatgcccgacttgccgtccccttcacgaagttcctgcgccatcggctattcgacctcctgctggatataaacactctgccacaactttacgtgactattgagacgcatctgaccaagaagaccgaaattcacgattttgtagcagtactgccggtttccttctgcacgcatctcattgagatttcagaacccttgccgaagactgtcagggaatatcgtcacagcctatatccgtggaatgaggggattccatgaagcgatgaaaaatgaaagtgggcaatgagggactcgaacccccgacatccaccgtgtaaaggtggcgctctaaccaactgagctaattgcccgcaaatgacaacaatagcgtatggccagcactgcgcgacacgtggtgtcgcatacgcgtgccgtagcgctcaatcgcaatgacattcagtcacgcccagcagcactacgcagcacacgacgccggtcaacacgcttaaagtcaagcgtattgattgaggcttatcagcggcccttgccgaatgcgcgcaggcggatgccgttccagtccgagctgacggtcagcggggtggcggcgttcataccggcggtctgtgcagcggactgcacggtggacgagctggcggcacccgggcggccgggcttgggagtcagtatccacagcgggccgtcattgcccagtaccgcgtaggcgtcaacgatcgtatcggacaattcgtcctcatcatcgccgtcgcgccaccatacgatgacgccgtccacagcggagtcgtagtcctcgtccacgagatcctcgcccgtgagctcttcaatctgggcacgaatggaatcgtccacgtcgtcgtcccagagccactcctggacgatatcgccgggctcgaaaccaaattcttcagcgttctgtgatgccgtttgattcacaggggacacattagcaagtcttcgcgaacaaatgcgttaacgcggccgaaaatcgccgcattgtgggcagacccatgcgagtcgtctcaccagaaacaacgactggccgcgcgtgtcatgcctcgcaatgaggcaaatcgtcggcctgccccttgccgatggccaccaacgcctgatacgcctcgttcagcgtggcgaccttgacgtcgcgcagaccatccggcacgcggcctgccacatccaaacaattcgacgcgggggccaggaaccatgtggcgccatcgcgcttggcgccaagcatcttcagctctatgccgccgattctgccgactttgccgtccttgtctatggtgccggtgccggcgatggtcttgccgccgctctcgttggcgggggtgagtttgtcgatgagaccgagcgtgtacatcatgcctgcggacggcccgccgatgctgtccacgtgcatcgtcaccttggcgtgttgcaatgcactggcgtcaatgtccagttcgtccgcatgggctttggcatacgccagaccgacggcactggccgaatcctgggaaccggccatgtcttgttcgactttcttctgatactggtccgcactctggcccaccggtaccgtggcctcacgcggcatgacctccacctgcggattgccccaaccccagacggcctgcgcgttgatgatcgggtacccgggcacgccggacgcgttcaccgtggtcagcagcagcttgccggaatccttatacgtcgtcacgccggtaccagtgatgtcgataaccgcaccatcctcaactttgcccagcacatcctgggtgggtccgggcatctcgatgacgtacgggctgggcagcagcagaatcaccacaccaagcaacacggcgaatgcaccgacgaaatggcgtttcgaacgagcggccgcataggcccgagcacggctgattccacgagataggcgcgaatcatgcttcacttcgaacgatggcatgtgctcatctcccgcttccgaatccgcagtcgggctctcctgctcctggacgaggtctggttcctgattcctgtggcgtgcaaacataccctacagtgtaagcggagggccgaaatcggccgaaaacgaacataaaccgaaaataatgctcggccacaagcgaacaggcccgggcagaccctacacttggggtaacacaccgcggcaaagaaggatacgcatggacgacaacgcgattcacgagtggctgatcaaatgcttcggccccattcagggtgagatggcctggcagcagatcagccagttgcctgaggagatccgtgaacagctgatgagtcaggaccccagccgactgcccaatccatctgaagtccagcagatgatggccgcgttcagcgccggcggactcaacacgatgggtgatatgcagcgcactgtcgaggaagggccgatcaacgtcaagctcgccaagtcgattgccttgcagcaggccaacgcctccggttctgcatccagcgtgtccgccgtggatggcgaggcggctcgccgcgcgatgagtgaggcgaacctgtggctggataccgcctgcgagttcaatcccgcacccggcgatccggatgtgctgacccgcgccggctgggtggagggcaccatcgaccagtgggcgaagttcgcagctcctgtggccgagtcgatgaacgacgctttggcttcggtgatttcggagcgtcttggcggcgcgttcggcgatggcgagattgccggcatgttcgccggaccggtgccgattccgattcccgacggtatgaaagacccagcccaactgatgaagctgctgggcaacacgtcctttgccatgcagttggggcatgcggccggcaatctgagccatgaagtgcatggcagcttcgatcagggcatcgcgttgctgaagaacccggctggtggactgattgcccagaacgccaccgaatacgcgaagatgctgaacggtgaggcttctgcggccgaggccgacacggccggcacttcaaccgactcggtcaatccgttctccacatccaccgacgcttctgccaatcccattggcttcacttcggccggcaacagcgatactccggcaactgacggtaccgcccaagtctccggctctgatgcttccgccgatgccgccgacgccgccgcgttcgaggctgcgctctccggattcgagaccaccgagaaaatccccgaatctgaagtgctttccttcctggccctgcaggaaatggctcacgcccgcctgtatgcctcggtaccgtggctgatgccgcgtttcgaggcgctcatcggcaagtacgcacgcggcatctccattgatctggatgcgatggaggaacagctgcgtgacgccacgtcaatggatccggagtcgatttccggcgcggtgaatctcaccaaggtcggcatccccgacactcccgaacagcgcgaggcgctggcttcgctggaatcgctgctggctatggtcgagggctgggtggattgcgtggtgtggcgcgccggtatggcccatctgcctcatatcgaacagttgcgtgagatgatgcgccgcgagcgcgcgatgggtggccccgccgagcgtacgttcgaaagtctgctcggtttgcagctgcgtcccaagcgcatgcgcgaggccaccgggctatgggagatgatcaccgccgccgaaggccctgaaggccgtgacgccaagtggtcgcatcccgatctgctgccttcgctgcctggcgacaagcccgcagatggcgcgtctccgtcatccgacgccccttcaggttcttcttccgatgccaacggttccgcttctcaccctgccgcagatggcaagaccggcgatatcgattgggatgccgaactgtccaagctgctcggcgaagatggcgaagacggtgaaaacggcaactcggaggatacgcaggcatagtcaaccggccttcagccaattcccgctcctgaacgacgttcaggagcattcagtatgcattacagacgcccgtcacaaaaatcgtgatgggcgtctgcgctgcactccataaccatccttggtccgtgcatacgacaaatgcagcgaatcctcagctcgggtgatgcccacatacataagccggcgttcctcttccagcgcatcccccgtttccggcgaaccatacggcaagagcccttccgaacagccgatcagaaacacgtgcttgaattccagacccttggatgcgtggatcgtggaaatcgtaaccccgagatcgtcgtttgcggcaagtccggtggcgtccaaacccatcgcctccaatagtgcgcgtttggacgcggcatcgtcggcgagcgcggatgattgccatcccgaatccttgcggacgcgatatttcagtctcgcagcgcgcaaggcggcaccgaataccggctgttgggcgttgatgcgggtgaggatcgcgcaatcggacggcttggccccgttggcaaccaaccgggctatgcgtgccgccacgccctgtgcctcttccatatcgctctcataagcggttcgggtaacgcgcgggccggattcacgggcggaaaccagtttcaggtaatcctcacggttcggcgcggccgcaagcacccggttggcgaggttcacgacttccggcgtcgaacgatagtcggtgttgagattgacatcggcggcgagcggcccgaattcatcggcgaaacgcagcagatcccagctggaggcaccggcaaacgagtagatggtctgggccggatcgcccacgacgcatacgttgcggttcattgcgctcttgccgtcaggtcctcccccgcccagccacagggtcagcagcctgtgttgcaggggcgagacgtcctgatactcgtcgacggtgagccagccgatggtggaacgaatttgggcggcggcttcgggaaaaccatccatgatatggcatacgagcagcagaatatcgtcaaaatcgatttcgccacgcgaggtcttttcctgctcgtaggcgctgtagacgtcggcgaaccgagcggtgtcgagtccggcgggcggctgcctatgggcgatggcacatgcccgggcataatcttccaccgccaccaacgagattttggcccaattgatttcggcgagcacatcgcgaacggtcagcggatcggcatcggtacgtgcggtggcgcggatgatcgcgcgggagacgacgtcacgctgatcttcgatcacatgcggaaatggagcctcgcatatgtctgcccagacgctgttgagctgatgcaatgccgctgagtggaaggtcgcggccgtgactccggcagttcccgcacccaaaccggaacgtccagtacctccccctacgccgagctggcccaatcgtgcgcgcatttccgccgccgcttttaccgaaaaggtgacggcaagcacccgctccggcttccatgccccggtggcgcaggcataggcgattcgccgcgtgaccgtgcgtgttttaccggcacctgcgccggcgataatgcgcaccggcccttgcaacgtagtcgcggcggtacgctgccgctcatcgagcccctcaagaatcccctgcgcctgttccatgcgtccattgtggcacgattcgcgctcacggcacgactcatgcctatggctgaatcggactcacgacaaaacatcgccagaatcatgcgttttgcgtgtcattctgcggtgcgaatcgccacggatgtattagtgtggaagggtgatgaaacgtagcgattatatgttggcggcactcgcctcagccgtcctgccgaatctgggggtggccggcgtacgcgagaacgtgcaggccagcgcaaccgacgaggccaaaggcatcgatcagaccgtgatccaagatgcctcaggcaagttgtacgacgtatacgccactaataccaaggaagggcgtacgcgtctgattcgccgtgtgaaagcggcgcagacactggcagccgcgcgcgagcctggtggcctcggcttcgatatggaccgtgtggtcgcgttcgccccgggagacgtttcccgacccggccagacggccaccgcacaggccgtggggcagcagacccaggcggagtccacaccgctgaccccgcgcaagcccggtcccacaggcgagacgaccgtgatgattgccgtccaccgtgatggccaggcgcggcctctcgacctgttgacattggatgactgcgcggccgtcggcaccgccatcggagccattcatcgcctgccttcgacttttctggccaatgccaaatatccggtagttaccaccggtcagattcgttcgcagctgaccgcctggattcgccgcttacgctccgccggccatgttccccaagaaatcaccgacagctgggcgcgcatcatggacaccgagggattgtggtcgttctccacctgcacggttcacggcggattttccgacggcgacttcctgttctccggttccaccatcaccacggtgaccaactggcaggatatgcaggtcaacgatccggcacgagaccttgcctggattttcggcaagctcgacgaatcccatcgcaacgccgtgctttccgcatacggccgcatgatgggctctcgacttgacgatctcatcatgctcagggccaacctgtggctgcagatggaacaggtgggcgaattcattcaggcgttgaaccgtgcggacaacgatcacatcatgcagttcaaggcacaggtcgaacgactcgcacaccagttgggcgtgatcaagcacactccggcaccggccccagccgcagggtcggccgccgcctcgtcaacgaagcccggtttgccttccacaatcaccgtcggcacattgttgcaggacgaccgtcatcaggcacccgcacaaccgcagcagtccgacaccggtaccgcggcggccgaggtctcggacgacacgcccgatcccgatcgcaccggttccgctgacatcgtggccgctggcgacgtggatcttaccccggaagtcgaacccgatgctgaccggaccgccaatcacccgcaaacgaatgtctccggcatcgcaaccggtacgggatcgaccaaaccgcagccctcacatggcgcttcccattcttcggtgacgatcacgctgaaggagctcctcagtatgaacgggcatagcggcacgacgtcaaccgacgcttcccctgcgtctcaatccgccgccccgaccgacgatgcggtgaatgacgatactccggacagtctcgttcagtacggagcctcgagtgcccaaaccacggtgattccgctgttggagcgggaagaacgcgctctgcgcgatgcccgtgccgggttggacgggtatgacagcgagggcaatccgctggccgaatcgtccacatcatccaaataatgtcgtgtgcggtgttccgcgccacgccgagcgcgtaacaccgcacatgacgacgcagacacgcggcacaatagagtacagaacctcggccggcgacggccacttaccatgatgttcgtcacaaagacggcagaacaaggagccttatatggatatcgaactgggcattcagaacgtggcacgaccggtgaacttcagcaccgacgaatcagccgacaatgtgagccaggccatcgcgcaggccgtggccgacaacgcgacgatcgatctgaccgatgacaagggccgtcgcatcatcgtgcccgccaaggcactcggttacgcgatcatcggctccgaaaccaagcacgccgtcggcttcggcacgctgtgaccatgaatcgcgcataagcggccttgggcattatctcaaggccgcttttgtattgctgaatcaccgatatagcggaagcacgccgcgatgaacgatctcttcgacagtggcctcgtcggtgaggttctcccccagtttgttcggtttgcctttgccatgccagtcagacccaccggtgaccagcagctggtgccggcggcagatggtgagcagccgttctcgttgctccggtgaattgccacggtgccatacctccagcccgtccagtccttcgctgatcaatgcctcgatctggtcatcggacaacagtctgcggttacggctcacatcaccggcatgggcgatcagaatcacaccgcccgctcccttgacggcggccaccacttcatgagaggtcggcgaaggcgtgggaatatagtatttggatgaggcgctgaccgcatccgcaaacgcttccgaacgagtccgatatacgccggcactcaccaaagcatcagcgatgtgaggccggccaatggtggttttgctaccctccttgacttgggcgagcacggattgccaggtaatcggataatcacgagacaacaattcgaccatgcgctgcgtgcgttgcaaccgtgcggctcgagtattggcgaacaagtccgcgatgtgctgattcgtgggatcatactggtagccgagcatgtgcacggagacgttctcatccgtggcggtgatctcggtgccgcggagcaacggcaaaccgaccctatgagccgcggcttcggcctccggccagccggcggtggtgtcatgatcggaaatggccacgcccttgagtcccaatgccttggattgttcggccaacgtggccggcgtttccgtgccatccgagaaggcggtatggcagtggatgtcccacccgacggcgggcggttccaaaggcatcacatatccagtcataccttccatcgtaacctcatttcagcattcccacgcaaggcgcagacaggtcgtcaccttctgccaacggccgaaaccagacattcggcacccagctgacaaccgcagaggctaatctggagcgcagcgctatcgaaagggacatgatgactcgtaacaccgcaaccgacacatcatccagcaccacgaacaccacgccgcttggcttggcggaggcacgaccgttgattggatggcgccacagtgccacttggacatatctcatcatgctgattgcctcggcagtggcgttgggggcctcgctcattctgtccgctgagactttgcaattggctcggcatccggagtccgcactcggctgcgatctgaactcggtggtgtcctgttcggcggtggcccagtcctggcaagcggaaatcgcgaagttcggcgggctgagctatccgaacgcgttcttcggcatcgccgccgaatcggtgttcattaccatcgcggtgatcggtttggcgcgtgtgaaggtgccgcgttggttcgcgacctgcacgtggctgggcggactggccgctttggcttactcgtactggctgagcacgcagtcgctgttcgtgattcacgcgctgtgcccgtggtgcctgaccctgatgttctccaccaccatccagttcatggcgttgagccatgcgaccgtggccgtgcagggattgccgtcgcgtaaggctgtggcggctgatgatagcgacggtgaggctgaggtcgcggcggtgccggccggactcaataagtattaccgcctcaacatcgacctcatggtcgacatactgtggatcgtggcgatcgtggtactcatcatcgtcaccgaaggcgcggccctgttcgctgcctgattcctttacaacaaatcgatatcggcgaccagcgtggctgctccggtcagctttacgtcgctgtcggtgacgtccacgcgcagggtgccgccacgtacggtgatgtcccagtggctgatgccggtcttggcccgcagcacaatgcctgtggcgcacaggccggtgccgcaggacagggtttcgccgcagccacgttcgttgacgcgcatcgtggcttcacccacgccggtgctctgatcgatgtcgtcgacccgcacgaattccacgttctggtcggattcgatgaccggagccaccactggtttggtgaccaaatccagtgattcaaccactggcagggacgcgaaggcatcctcgatcaccgcgaccacatgcgggttgcccatatccacaaacgtaccgcgcgccgagccctcagtgccggggatggtgacctcgtaggcgtcggtttcgccgatcttccactcccccatttcgacctggaacacgttggctccgtacggcctcatattgccgcgtggcgtcagaatcttgacgccggcacgggtgccgaggcggaacggctcggtggagtcggccaccccctcacgctgagcgaacaaggtgatggcgcgtgtaccgttgccgcacatctccgccaacgatccatccgcattgcgatagtccatgaaccatttcgcgcccccggccagtacgtccgaaagctgatcatcgcttaaatcagacacgaaatcaggccgtgtcaggcgaatcaggccgtcaccgccaatgccgaagtgacggtcgcacaggaatcggacctcatcggcggtaggctcgaatttgccggacttgtcgaggtataccacgaaatcattgccggttgcgtgtgtcttggttactcgttgcggaagactcatggctttcagagtactctagggagcgaaacaacaccgcaaaacaatcggctttgtgatcggtcgcggcaacatacggttgcagtcatggctatagggaggattcaggcatgagctcttcggctccaatcggcgtattcgattcgggtcttggcggtatttccgtggctcgccaaatcgccaaggatatgccggccgagcatgtgctgtattttggtgattcggccaacgcaccgtacggcatcaagacgcctgaacaagtgagggccctgagtttcgatattgtcgaacggttcgtgcgtcaaggcgtcaaggccgtggtcatcgcatgcaacaccgccacttccgccgcggtgaacgatttgcgcgaacactacgatattccgatcatcggcatggagccggccctgaaagtggcgtgcgaccgtggtgacgtgccttccgacccgcatcatattccccagagggtgattgtggcggccactcccctgaccttgcgtgagcggaagttcgccaaactgatggatcgattcgattccaacaacacgattttcaaggagccttgccccgacttggtggagatcgtggaatccgggcggctcggcgaccatgacctggtgatgcgcacgctgcacggctacttcgaccagtacgacatggagcatatcgactcggtggtgctgggctgcacgcatttcgtgttctaccgcgactacttccgcgagctgctgcccgaacgggctgctgtcatcgacggcaatgagggtaccgtgcgccatctgggcgtggtgttggagtccctgggcaaactggcacccgaagacgcgaccggcggcgtggagctcgccaattccgatccgtccgaacggattgccgagttgtcacgcaaattgctgaacgtatgagccgttcttggctcccctctctgagggaagccaaggaagaaccagacaaattcacagcacactgcccatatcgttgtccgtgcagcacgcgtaagctcataccagattcaagtgaacagggggttggtatgacaaagacggcgatgattgatgtcggcggcgggttccgcgcgattttcggctgtggtgttatggaccgcatgctggaggacggcatcgacgtggatatgtgctacggcgtttccgccggcgcggccaatatgacctcattcatcgcacgccagcacggccgcaaccacaccttctacaccaagtacgccttccgcaaggagtacgcgagtgcggaaagcttcttcaagaaccacaactttgccaacctcgactacatctacggcacgctgagcaatcacgatggcgagaatccgttggatttcgcggcgttcgaggccaatgagaccgggttcaccgtggtggcctgcaatgccgaggacggctcgaccaagtacttcgacaaatcgcgcgtgcgttttgatgatttcgacatcatcaaggcttcgtccgccgtgccggtggcctgcgagccgtatgtggtggatggtgtgccgtatttcgatggcggcatcgccgatccggtgccggtgcagaaggcgctggaggacggctacgatcgcgtgattctgattctgtctcgcttgcgtgacgaagtgcgcaagcagcagaaggatttggctccggcccgcatcctcgaacgctcccaccccgccgcggccgagaagctgcgcatgcgctacaagacctacaacgacgaactcgaactcgccaagcattacgaggcagaaggccgcgtgctgattctcgccccggaagacctctatggcctcaacaccctaaaaaagaacttcgagggtctggaaatgatgtatcgcaagggatacgcggcggccgaggccattccggcattccttcaggcatagcgatagtgaagtccctcgcttggagggacttcactatcgatggatggggattcgcaaacggggtgattacttcgtctcggaagcggtgagcatggccttggtgacctgctcgtagagatcctgataaccgccgggcgtggaggcgggcagcaccacggtcttggtgttgttcgattcggacagcgagcgcatcacgtcgaggtactggttgaacagcaccacgttgttcacgtcgttgatgttcatgcccacagcctgcagactcttgatctggtcgacgataccgttggcgatctcgcggcggtaattggcctggccctcaccctgcaagcgagtcttctccgcatcggcggcggcttgggtctcgatctggatacgctgggcctcggcacgctgacgggtggcttccttttcacgctgggcggcattgatggagtccatcgcgttcttgacctgtgggctcgggtcgatggcggtgatcagcgtcttgaccacggtgaagccgaaacggctcatttcggcgcccacggtcttctgcacgtcgaacgccacatcgtccttgcgagcaaaggcatcatccaaagacagtgcggggatagcggaacgcagcgcgtcctccatgtaggagcgcagctgaccggccgggtcacgcagctcgtagtaggcggtggccacatcgttcgggttcacgcggaactgggtggaggccaccacggtgacgaacacattgtcaagagtcttggtttccagctgcacgttaagctggttgacacgcatgttggttttcatggcgatgcggtccacgaacgggatgcggatatggatgccggcgaactggaccttaaggaacttgccgaatcgctcaatgatgtaggcctgctgctgcggcacgacgaagagtgcggcactcagcagcacgatgagtagcacgatgataatcagcggaccagcaaagaatacggccatgatgttttcccttcacccacgtcggaaccgccctcggcctcgactcgtgatttccatcgtatcagcgttcaaaacaaagcggtagacatcgtacgcatatgtgtacaactgttcactatgtgtgcatgctggcttcttataaaaaagtgcggcatccaatcagtatgctgcggccatgcctgagccgacagccacggcgccgataccgtcctccagcgcggcaagccgcttttccagtgcatcgacagtgggattggccacacgggagtactcgaagccgtcgatgtcaccgcccgcgagcgcatcgccgcgcgccgcgtcacccaggtcgaatgcggccgaggcatagattggcggcacagcggcacggccgttatccagcggctcgtagccggcgtggatggcttgcgttcggaaatcaacgtccattaatccttcttcctcatgccgctctattgtggcgggctcgactctattcccgaacttagcaagtcatggtacgcgacaccggcacatcggtatcgcaattgtcaatgcgcgcttataagcaatggctatagaatatccgccgaatgccggaacacaccaagctgcccagccctctttcagcacctcggccgcaatattacgctgcctcaaataattcaaagccgcgtcaatccgtaccggttcaccatcgaaaatggccacgatgccccctatcggggtatccgcgacgatgtcgatatctccaaagattatgttgacatcgatgccgaaccctttagtaatttgcgacaccaacgcttcagaaacttccttggacacatattgcatccggaccaatcgttgaccttcagacaatctcatcaaaagggagtcatggttctcttttcatatctggcgataacgcatatcaaatcagcaatcagcgcaaagacgctcggtcactccatccggataacaactttgccgtttcgcctaaggtgtcgatgacatggtcaaccggtgcgtcagaaagagcttcagcatagttctcgatgcgatagtcgaaataacgatcggcgcccagcgcgctgctctccgaaagcaccgggacgaacgccgtcagcattcgtaacgccttgggagcgctcaaacgcgcggggctcatcacagtggcacgcggaaccggcggtgccgaacttgcccgcaccccccaaggaaatcactctgctcgatatctatcaggcagtggaatccacgaacctcgatgatgtgatcggcatccacgagagaggaaatcacacatgccccgtggctcggaatatccacgacgttctcaaagatgcgtatgctccagtggccaaagccatgtcggattccatgagggaagttacgcttgccaatatgcttgccgactaccgaaatcgcattggggtcaaagcccggcaactggaacagtagtgggcaccgaagcgtaagccccctactctctgatccgcataaacagataagacgtgcgccatcaagaccgatcgatgacgcacgccttatgcagctcagaccacggattcctagtcagccagcagccccagctcctgcagcttgttcctgatatccactgcagagggttccacttggaacgagccgtcatcgtaccgcaccaccggaatgtgcatctggccgctgatcgccacggcacggtcggcggcaccttcctcttcctcgatgttgtgccaagtgtatgccgcgcccagtttgtcgagagtgttctttgcctggcggcagtcgccgcaccatgtggcaccgtagacgtcgatggtcatatcaggtcctttctttgttccgccgcgcttgacttttacgcggtgcactatcaaaccgtattcatcgtaacggggatgctgtgatatcgcggttggcataatgcgggcggtccgcttaaccaccccagtcggctacgccgacagccctctgccagcggaggcggaaccagagcataaaaaaagcggcgccggtgtggcacaaccgacgccgctccccaggagtagaaaaataggcagaaaagtattagatcaggcaaacaccccgaagtcagctgttggaacacgtcgaagtcggcatgccgatcgatgtaacgggcgtaagcgatatcgaacgcctggccgagatcttcgatcagatcgttggcgtcctcgatgccaacggcgagacgcaccaattcatcggtgatgccgatcttcagacgctcctcgcgaggcagttcgaaatgcgtcatacgacacggcagctcggcaagagactccaccgcacccaacgacacagcaagacggaacaggtgcaggttgttgagcacgtcagccggatcaacgccaggcacgacctcgaagctcaacacgccaccgacccccttgagacctttggcagccagacgctggtcgcctgcgccgggcagacccgggtaatgcaccgccttaaccagcggatgcaccagcaggtagcgggcgatggcattggcattctcctgctgacgatccatgcgaagggccagcgtctgaatgccgcggcgcaccgcgtcgcactcagcaggagccaacacaccacccaaacggttctgcgcgaagtacacgcggctcgccagatcctcaccggaaacgaccaccagaccggcgttcacatcagaatgaccggccagatacttggtggcggagtgaatcaccacatcggcacccaaagcaagcggcttctgcagatacggggtcacgaacgtgttatccacaatcgaaagcgccccgaaacggtgggccaccgtggagatggcgcgcacgtcgttcaccttgagtagaggattggtcagggtttcaaagtagacggcttgggcaggcacgatgccgttcgcgcggtcgcccttgacggcggcctccaatgctgcgatgtcctgagtgtcgacggcctcaacgatgattccccagcaagtgaagaactcattgagctgggaatacgatccgccataaatattgtcaccgaccacgatgcggtcgccgggcttgaaaatgctcagcaccgcgtggatcgccgcgagaccggaggcgaacgcaaaaccacgcgttccttgctcgagctgggcgatctgctgttccaggaagtcacgtgtgggattgccgctgcgcgcatagtcgtaacggggcatcgcgtcgaccctctcgaaagcatatgtcgttgaattgtagatcggcgggttcacggctccggtgttgttgtctccaaccggcagtccgtggacgagctgagtattgaacctggtcattgcgcacccccttaaagtgttgcgtcatctgcgcgaagccgttccccgcgcggcacgattacgaccttaacgcaaaacgccggcccgaaggccggcgttgctatatgtgttggttatggacgggtataatcagacctctccgtcctgcaagaatggacggcctgacgaccggcccaacacacctcgccgctgccgcggctcggcgtcgcctacggacagtccaccggactgtccgtcagacggctccgccttctaccacgatgtcatcggggttgacttcgttgccgtagaccggctccagagtctcctggtaatccttgtggaagaagttgtctttgccgagcttgacgatctcgtcgttcacgaagttcagcagttcggtgttgcccttctgcactgcgggcgcgatggtgtcgtcgtcaccaaggtgggtgatgccgaccttgaagcccttgttggacttggcccaggcgagcacctcggtgttgtcggtggagaaggcgtcaccacggccgtccagcagcgcgttgtaggcatcggcgtactggtcgtacttctgcagcttgacgttcggcgcgttcttctcgaaccaggtttcggcggtggtgcccttagcgatgatcagggtcttgccgtcgagctggctgacatcggtgatctgggcgctctccggggagaccacaccaagcgccaccttcatgtacggcttggcgaagtcgactttctccttgcgctcatcggtgacggtgaagttagcgagcaccagatcgaccttgttggaggtgagcacgtccacacgggcagccgggtcaaccgacgtgtattccggatccacacccagatccttggccagctgttcggcgaagtagacgtcatagccctggtacttgccgtccttgtccacgtagccgaatggcgccttgtcggagaagacggcaatcttgatcttgccgctcttcttgatctcgtcgaggctgcgggccttggcattggcgctggagctggtgccagtgtcagaggacttcgcttcgctcggggtgcctgccgacggaccgcatgcggccatggacgccgccattaccaatgccgcgcctgcggcaatcagtgctttgaatgatttcccaaccttgatactcattgggttctccttctcttgttgttattgatatttcttctcaaatacgtcgatatgacacaatcgaatcactcgaattcgaaggtgtgcaggaactgctgcgcacgttcggtttgcgggtgttcgaagaacgcctgcgcatcatacgattcctcgacgatgtgcccgccgtccagcaagatgatgtggtcggcgatggctcgcgcgaactgcatttcgtgggtgacgataagcatcgtctgcccggacttggccagttcgagcaccacgtcgagcacttcacgcaccatttcggggtcgagagccgccgtaatctcatcgagcagcagtacttccgggtgcagaatcagcgcacggcaaatggccacacgctggcgctgaccgccggacaattcgtgcggccaagagtccttgcgatcggcaagtcccacgcggccaagcaaccggatcgcttcagcctccacctcggacttatcgcgtttctgcacgagcaccggcgccatggtgatgttgccgagcaccgttttattcgggaacaaatcgtagctttggaacaccatgccgatacgcgtgcgcagttcactggaccggtcggatcgtccggctcgttccgtgccaggcttgccggcatcgatcacctgattgttgatggaaatcgtgccgccctgaatcggttccagaccggcgatggtgcgcagcagcgtcgacttgcccgagccggaaggacccagcaccacgagcaccgaaccatgctccaccttgaaggagatgtcatccagcaccggcttgtcggcattcgcatactgtttgaccagatgattcacctcgaaacccttgcaggtcgtttcgggttcagtcattcgaccacctcttttccagtcggcgggccacaatggacagcggccagcacacgatgaagtacataaagaaaatcacgccataaatccacaaggttccggtcgggaactggaatcggttcgcgtcgataatctgctggccgaccttgatgacctcgaccacaccgagcagcacggccaatgatgtcgttttgacgatacgtgtcgccaagtttacggatgccggcagcatacggcgaacagcctgcggcagaatcacccgggagaaggtctgccacgggctcaaccccagtacgtagctcgattcgtactgcactttgggaatcgactgcaatgcgccacgcaccagatcgcccagctcggcgcctccccacaggatgaacaccagcacgcaggcaccggtggcatcgagattccaatcgaaccatcgagcaaaaccgtagtaggcaaggaacagcaacgccagctgaggcataatgcggatgaagtcgaggtagatgcgcatcgcggcccggatcacgggattcttcagtgtcatcaaccagcccatcaacaggccgaccgggatggacgcgcctacggatacgccggctatccacacggtgacccacaggccttgcaacagacgtgggaatacgcctggctggagcagtatttcagcgccgctcataatcgaacctccgctccaaccatgtgccgaagatggaaatcggcagcagaatcaccagataggccacgaccagcatgaacaacgactcataggtgctgtaatacatgccgatcagatccttggccatgtacatcacgtcggcgagcgcaatggcggagacgacgctcgattccttaaacaggaagatcacattggccactacgccgggaatggcggtggacactgcttgcggcagaatgactcgggtgatggtttgcgtggaagtcagtcccagcacgtacgcggtttcgcgctgcacgttgggcaccgcttccaatccgccgcgcattgcctcggccatgtaggaaccgcccaagaatccaaggccgactatcgcgcaggtttcggcggaccatactacgccgagtttgggcaggccgaagtacagaaagtacagctgtaccagcaatggcgtattgcggctaagttcgatgtagattctcacgatttgccgggcgaccgggatacgcgcgatttccacgccagcgcagaccagacccaccgcgatggcaagcaatatgccaaacacggatatgaataaggtcatcaatgtgccgttgacgaagaaaggcgcgtaacgctgcacgaacgaccaatcgaatgtcattggacgcgctccctcctttgcttctcgtttcttctcctgcgcataaacggtcttagccacccatgtacgatttcggggccgaacatacctgtcccccctgccgtgtcatcgtagagtatcagaacacgtggcacggccgctgcgctatacgcattacttatgggacgttactcgatgggcgaacatcagggcattattgtcgcccaaacggtggatacactgaggctatgaagatcaccaaagctctgacccgtttgaccggtcccgaaaccgctccggtgttcgtgctgttgcacggctggggttccaatgaatacgatttgcccgatctgctgaactattgcggtgccggttcggctgattatgccagtttgcaggcacccatcgcctatggcatgggatatacatggttcggtgcgtgggcgcatgaaggtgtgccggagggcgaatcattagacaagcaggcgactgaagccgcccaagccattgatgcatgggttgcggagcatattcccgccactcggccggtggttgccatgggattctcgcagggcggcctcttggccgcgcatcttttgcgatgcaatccgcaacggtatgcggcagcggtctcctgctccggctggttggctccggggccggtctctggagacgccgagctggctgcgttgaagccgccggtgttctacgggcatggtgctgcagacgacatcttcccgaaagccgatgtgacggcgatgggtgagttctggcacgagcacggcacgttgaccgaacaagtgtatccgggcatggcccattccattaatatgccggaaatgcgcgatattcaacggttcttggagaccaacggattcattcggccgcagatttggtagtcaccacctcacatggcgtagtctacgtgggcgaattcagggaccttataccatttgacggggtagccggcaccgtgggcgcagaagaccgagtcggggtgttgtccagatctgcttcgggatcgtaagcggcggctgcgatgatctgttcggcgtcatggcatggcttgtagccgccgaaagtggcggagaaacggccatggccgtgcgtgtactggttcacgtccatcgcatagtcgcgcatctcggacaccggcgcctcgccttcgatcacggcgtattcgccatcggtgaccggggattcgaaggtgccggccatgcgctggatgtcgctcatggcacggccgatcatgtctgctggcacttcgagccggaaccggtaccacggttccagcagtcggcagttgccctcccctgcggtgtccggacggctctcgaccggcgtctcgggccggccactgactccagctctggcttccataagcccctgacgaatcgcacgataggtggcttggcggaagtcgccgccttcggtatgcttcagatgcgcgcggccagccaccaaagtcatcttgatatcggtgagcggcgcgccaacgagcacaccgagatgctcacgctcggtcagatgggtcagaatcagccgttgccaattgcggtccaaatcgttttcggacagggccgaggccacagtgactccgctgcccggctcccctggttccagcaggatatgtgcttcggcataatgacggagcggctcgaaatgacctgcgccttcgattggcgcagtgatggtctcacggtacaggatggagccggggccaaacgacacatccagaccgaaccggtcgtgcagggtctgctggatgatctccagctggactgcgcccatcaattgcacatgaatctcggccagccgttccacccacaccacatgcaacaacgggtcttcgtcttccagctcacgcaatgcggtgatgaccttatgcaaggtcagatcatcgaactggggacgggccggcgagctattgtccgccgcggtctggcgagcggtgtcgttctcctcattgcggccggttcccgacttggcggcatcatgctcggcatcgtcctgattcacgctgttatggccggcgccaccgcgtttggccgctcccgaggtgccggccgtatcggattccgctccggcgggcaacaccgtgtaggtcaacacgggttgcagcgacggtgattcggcgtccggttccgctcccagcccttcgccggggaaggtccgcgtcagtccggtcaccgcacacaccgatccggcaggcacctcggtgaccgtctcgaatttggcgccattgtagacgcgcacctgatcgactttctcggaccataccgtgccatcatccccctgtaccggcgacggtgctgatgacgccgcagcgcacgaggatgaagagacgatctccttggctttgagcgcaccaccggtgacgcgcagccacgtcatacggttgtgctggccgtcgtgggcgattttgaacacgcgtgcggcgaaggcggccggccattcacgttcgcgggtgaacgtctccagcccgtccaggaattcctcgaccccttcgagtttcaatgccgagccgaaatatacggggaacagttcgcgtacggcgatcatcgctcgcaatctgcccacggacagcgcgccatgttccagatagtcgttcatcgcctcctcgtccagggtggcaatgtcttcggcgaacgcgtccaacggtaccgcgctgccctcagtggactgctccattgccggcagcggatatatcgcatcgctcaggcgtttgcgcaactgtgccagaatggcctcgcggtcgaatccggcggcgtcgcacttgttgacgaagatgaacgtcggcacaccgtatctggccagcagacgccatagtgtctcggtatggccttgcacgccatccgtgccggagaccacaagaatcgcgtaatcaagcacacgcagcacacgttcggtttcggctgcgaagtccacgtgccccggcgtatccagcaaggtcaggcgcaggtcgccgtgttccaccaatgcctggtgcgcgaaaatcgtgatgcctcgcgccttctccaaggaattggtgtccagaaacgcatcgccgtgatccactcgccccaatttgcggatctcaccggtacggtagagcagagcctcggacagcgtggtcttgcccgcgtccacatgcgccacgatgcctgccactatctgtttcatcagctgtgctcccttcccgatgcgccgcgcaattgccggccgcctaaccaatatatccgagaaaatccgggagggaaaaattgtaccgacagaccgggctgccggtacaataagtcaccgaacaccgactgatatgaggagcctccgtgaccacttccggcattaccgttttcggccaaccatcccagcccaatcatggtgccggcgggcgaatcgccatggacgatgccgtcttccccaccgattatgtggcgctggatttggagaccaccggcttttacccgaacagttgcgccatcacggaaatcggtgccgtgcgcgtgcgggaggggcatatcgtcgatcaattccagcagctggtgaatcccttgcggccgattccgcgtcagatcaccacgctgaccggcatcaccgatgcgatggtggccgatctcgatccgattgacgaggtgcttccccgattcatcgcatggctcgctaccccggctgccggtcccgccgttgagccgattgtcggccataacgtcagcttcgatctgcgattcctggattacaacacccggcatatcgccggctgcggctttgcctgcgcggattatgacacgatgcagatcagccgcgccctgttccccgcgcagcggcatcaccgtctggccgacctgatcgtacgcttcggcatcgcggacaatgaggagcaccgcgcattaagcgatgccatccaaacccagcagtgcttcgaatggatgcggcattacgtcaccgagcatcacgaaaccgaagcaatccgctggaagcaggcgccggccaaaaacagcgccgaaatcctccaccagcagttggtggtaaagaggtagtttacagcccgtattccttggcgatgacggaccagaggtcggcagcggcctgatcgacggtttcgttgacgatggtgacgtcgaattcgctttcggcggcgagctccaccttggcggtctccaagcgacgggcctgctgttcggcggtttcggtgccgcggccgatcaggcggcgctcgagctcttcgaagcttggcggcgcgatgaacacgtacaccacttcgaggtcgagctcggcggcgcgctgcttgacgcggcgggcaccctgcaggtcgatttccagaatcgtgggcacaccggcggccagatgttcctccacaggcttgagcaatgtaccgtagtgggccatgccgtgcaccacggcggtttccaggaactcaccggccgcttcgcgggccaggaactcgtcttcagtaaggaaccaatagttgacgccatcaacctcgcccgggcgcggagcgcgtgtggtggcggagacggacacccacacttcggggtggtcggcgcgcagcttggcttccacggtgcccttacctactgcggtggggccagtcaggacgattagacggccagcatgggtgttttcagtcatgggttcctccggagatgatgtggtgtgcagcgattatgaatccaatgtggtaacggctcaccggcgagatgaccggtaactgctacagccccgacgaacagggaagaatatgaatcgtgatgcgacgtacgcgatgagatagacacgtacgcatgccgcgacatctgattccgttctgattactggttttccgagccttcgacagtggcttccatcagcgcctgacgtacgtcaagcgcaatcgactcggtggcttggctcagtgcggcgatatccggcccatgcgaggcgatgaagcgggacacggtgaccagcacgttgccgcgcgtaccgcggaacacggttttcagatccttggcctcggcaccctgccaaccgtaaccgggggaaagaatcggaccggtgaacttggaggggtccacgccggaatcctgcatccattggccgatggtggcaccgatgatcagaccaaccgagcccatgccttcgatatccacgttatgcttctgcgcggtggaggcgatgccgtaggccacggtacgtcccttgtaatcgccgctctggcgcaacgcggtctgcagactcatgccttccgggttggaggtcagggaggcgatgaacacgccgcgtccgttttccagcgcttcggtaatcaggccgttcaacgaacgcgcgccatagtacggcagcagcgtgatggcgtcggccagcaacggtgcaccgggcttgaaataggcgtctgcgatggcggaaatcgtggtggacaggccgccgcgcaggcaatcgacgatggtgatgacgcccatttgtcgtgccgcgtagagcacgcgctcgagcgcttcgaaacctttggctccgtagcgctcgaacatcggcgtctggaatttgactgctgcggcgcgcccgttggcggcctgcagcatacgcatggagaagagttcggcgccttcggcgtcgacgttgtatccccagtcggtgaggagcttgcgatgcgggtcaatgcccacacacagcggcccgtatttggccattgaattgcttaatcgcagaccgaaatccgaacgttgtgcctgcaattcctcactgctgagtgtagtcatcagaactcccgtcgctccaattcgaacagctgcttcgaatgctcctgaatgctcatgatctgataatcattatgcttcacggcctcgatagcgagcagtgcggcctggaactcggtgatggtggtgaactgcggcagatcggcggcaatggcggcggcacggatggagtagccgtcggaacgggagccgcgcgagttcggcgtgttgaggatcatgtcgatcttgccttcctcgatgagctgaaccacgttcttgcccacggatccggcagcgtgatgcacctcgaccggggcttccggatcggtgtccacgcgggtgctgatcttgtccacgatgttcgactcgatgccgtaacggcgaagcacggaggcggtgccctcggtggcccagagcttgaatccaagctcctcgagacgaacggcgatcaacggcagctgacgcttgtcggtgtcgttcacggagatgaacacgttgccgtgggtcggcaggccaccgtcgtaggcggcgagctggctcttggcgaaggcgtgcgggaagtcacggtcgaagcccatgacctcaccggtggaacgcatctcaggtccgagcaggatgtcgacggtcttgcccaccggggtgcggaagcgcttgaacggcagcacggattccttgaccgcgacctgctggccggggtggatgtcgccgccgtcgcccttaggcagcagcagaccgttggcacgctgatcggcgatggtttcgccggccatgatgcgggcagcggccttggccagtgccacgccggtggccttggaggcgaacggcacggtacgggaggcgcgcgggttggcttcgatcacgtacagcgtgttggccatgaaggcgtactgcacgttgatcaggccctgcacatggcagcccttggcgatggcgtaggtgccttcacgcaggcgacgaatctggtcgtcggacagggtggacggaggcagggtgcaggcggcgtcaccggagtggacaccggcctcctcgacgtgctccataatgccgccgatgtatagttcctcgccgtcgaacagtgcgtcgacatcgatttcgatggcgtcttgcaggaacttgtcgatgagcagcggggaaggcaggcggccggagaccacggtatcggccttggcctcggcaagtgcgcggtccacgtacttgttgagctgcttgtcatcgtagacgatttccatgccacggccgccgagcacgtagctcgggcgcacgagcaccgggtaaccgatgcggtgggcggcttccttggcctcttcgaggctcagggcggtgccgtaacgcggggcgttcatctccgccttcttgagcacttcgccgaacagctcacggttctcggccaagtcgatggattccggggtggtgccgagaatcggcacgccggcggccttcagacgcgcggccaaggacagcggggtctggccgccgagctggacgatgacgcccttgaccgggcccatcttcttctcggcctcgtagatctcgagcacgtcctcgaaggtgagcggctcgaagtagaggcgatcggacatgtcgtaatcggtggacacggtctccgggttgcagttgaccatgatggtgtcatagtccttgccaagctcctgcacggcgtgcacgcacgtgtagtcgaactcgatgccctgaccgatgcggttcgggccggagccgaggatgatcacagcctcgcgttcgcgcgggcgcagctcggtttcgtcggcgtagcagctgtagtagtacggcgtggcggcgtcgaactcggcggcgcaggtgtcgacggtcttgtagaccgggcgcagaccgtaggtccagcgcagttcgcggatggtgttctcgccttcatcgcccaaaccacgcaggtgggccacctgcacgtcggacagaccggcgagcttggccttcttgagcagcctcggggtgagggtttcggcctcgcgcaccgtcatggcggtctcattgatgaggaagatctgcttcaggaaccacgggtcgatcttggtggccgcgaacacctgctccaacgtggcaccgccccagatggcgcgcatgagctgcaggtaacggtgttcggtcggggtgtggatggcctcaagcagttcggccacttcttcggcggacggcttctcgccatcccaattgaagcccatgtggcgcttgtcgatggagcgcatggccttgccgagggactcctggaagttgccggccagggccatggcctcgcccacggacttcatggaggtggtcagggtggggtcggcgcccgggaacttctcgaaagcgaagcgcggcaccttggtgaccacgtagtcgatggtcggctcgaaggaggccggcgtggactgggtgatgtcgttgcgaatctcgtcgagcgtgtagccgagggccagcttggtggcgatcttggcgatcgggaagccggtggccttggaggccagtgcggaggaacgggagacgcgcgggttcatctcgatgacgatgatgcggccggtgtccggatgaacagcgaactggatgttgcagccgccggtgtccacgcccacgccacggatgatggcgatgccgatgtcacgcagcttctggtattcgcggtcggtcagggtgaagcagggggccacggtgatggagtcaccggtgtgcacgccgaccgggtcgacgttctcgatcgggcagacgaccacgacgttgtcgttgcggtcgcgcatgagctcgagctcgaattccttccaaccctcgatgccctcttcgatcaggacttcgtcggtgggcgagtaatggatgccggcgccggcgatgcggtgcagctcctcctcgttgtgggcgatgccggagcccaggccgcccatggtgaagctcgggcgcacgaccagcgggtagccgaacttctcggcgatcttgtcgacttcctcgatgctgtgggcgatgtcggagcgggcggattcggcgccggcctcgtcaacgaccttcttgaacagttcacggtcctcgccacggtcgatggcttccagggaagcaccgatcagttcgacgttgtacttctccaggacgccggcctcgcccagcgccatggcggcgttgagcgcggtctggccgcccaaggtgggcaggagcgcgtcggggcgttccttggcgatgatctgctcgaggatcggggtggcgatcggctcgatgtaggtggcgtcagccatctccgggtcggtcatgatggtggccgggttggagttgacgaggatgacgcggatgccttcctcacgaaggacgcggcatgcctgggtgcccgagtaatcgaactccgcagcctgaccgatcacgatcgggccggagccgatgaccatcacggatttgatgtcggtgcgcttcggcatatcacttaccttccttggagttgttcttcataagttcgcagaaacggtcgaacaggtaggccgcatcgtgcgggcctgctgcggcctccgggtggtactgcacggagaatgcggggatgtccacgcactgcaggccttcgaccacgtcgtcgttcagatcgatgtgggagacgaacaccttgccgtacttgccgttttcaaacggcgcgtcgacctgcttgccgatcggggcgtcgaccgcgaagccgtggttgtgggcggtgacctcgaccttgccggtggtcagatccttgaccggctggttgatgccgcggtggccgaacttgagcttgtaggtgccgaagccgagtgcgcggccgagcagctggttgccaaagcagatgccgaagaacgggtagccggcgtcaagtacctggcgcagcagctcgatttcgggaccggcctgttccgggtcgcccggaccgttggagaagaagacgccgtccgggttcaggttctcgatttcggcgaaggtgatggtggagggcaccacgtgcacgcggcagccgcgttcggccatgcggtgcggggtcatgcccttgataccgaggtccacagcggccacggtgtacagcggctccttgccttcgtactcgccgcacggttcgatggtgtaggtctccttggtggacacctcgtcgtacaggctcagaccctgcatctgcggggtgttcttgacgtcttcgagcagctgctcgatggtcttgagcgcgccggtggcctgatcggtcagggcgtcgccggagaagatgccggcgcgcatcacgcctgcggaacgcaggtggcgcaccagcttgcgggtgtcgatgtggctcaggccgacgatgccgttcttggcgaggtcgtcgtccaggctgccttcggcacgccagttgctcacgttcggagagggatcacgcacaatgtatccggcaacccagatgcgggaggactcagggtcttcgctgttgacgccggtatcgccgatgtgcgggaacgtctgcacaacgatctggcgatcgtagctcggatcggtgagcgtctcctggtatccggtcataccggtggcgaagacgatctcaccggtcgtctcgccgagggcgccgtatggctcccccacatatacctgtccgtcttccaaaacgaggactgcatcgtccttgtcatacatcggaattgcgatggtcccggactcgttctggctcaccaaaacccccttatgtttttcgggtattcgtaccaaggttaacggccagcgcagactcacacgccgttggacgcaaagtctcacccccgctggcggggctgtcggcaaggtgccgacttgagaatgtacggcggcacaagtgtccgcccatgaaaaagcctcccgaatggggaggctgaacaacaaatgactaatcgaccgtcggctgaatctcagcggacggggcagcaggctcgtcggatgcaccggacgaatcgggcgaatcggaaacatcgccctcatcggtcggctcggatgcggcggcagcggaatcggacgattcctcatcggcctcttctgccacggactccggtgccggtgctgcattcttggcggtgcacaccgcagacagcaggccatggatgaaagcgggcgaatcgtcatcgcacagggtcttggccaatgccagagcctcgtcgatggcgaccttgtccggcacatcatcggtgaacagaatctcccaagcggcgatacgcagaatgttgcgatcgaccacgcccatacggcggaccttccaacccgtggagtgttcgtccagggtcatgtcgatctgacgacggtgctcggccacgcccttgacgatttcaatggcatagtcgggaagcggggtctgggcaccgggatgtgcgatgcgctcgtcaagcagggagagaatatcctggcttttttcgtcggcttcgtacagggtgttcagagcccttttgcgcgcggtggaacgtgccatactgctgctgtcctagtcctttatacggtcggtcgtctgttgaggatgcggagatcagttgttctcgcggccggtgtaggaaccgtcctcggtgttgatcttgacgcggtcgccctcattgatgaacagcgggacctgaatctcggctccggtctcaacggtggccggcttggtgccggcgttggagcggttgccctgcaggcccggctcggtgtgggtgatggtcaggaccacggagcccggcagatcgacgctcagcggggtgccgtcgtggaaggagaccaggcagtcggtgccttcgagcaggaacttggccttgtcgcccagaagggtcttcggaaccatgatctgatcgtaggtggtcatgtccatgaacacgaagttgtcaccgtcctcgtaggagtactggagagtgcggttgtccacggtctcgaattccatcttcatgcccgcgttgaaggtcttgtcgacgatcttgccggagagcacgttcttgatggtggtgcgcacgaaggcggggcccttgcccggcttgacgtgctggaacttcatgacggtccacagctgcccgtcgaggttcaggacggatccgttcttgatgtcgttagtagtctgtgccacgttattcacctatttcaaattcaaactagcttaggcaaagcccaaaaattgcctcggctattatgccacaccgggtatacaggaagtgaacgctggggtttcccatgtgcccccggctagactggatgaatatgcgatccttcttcgaagccatatccgtgtcctgcgtcatccccgcgcaatcgccggcggacgacgaacgcacggtgttcgagaacctgtcctttgctgtggagcgcggcgagatcgtcgatctggtgggaccgtccggctccggcaagtcgagtctgttgaccgcgtgcgcccggctcaacccgcatgcgcacggcgcgttcgcccttgaaggcaagggcagcggcgagttcacgccgcagcagtggcggcgggatgtcgcctacctgccgcagaagccgattctgacgggcaagaacgtggccgaggcgatccgcctgccctggacgctcgcgattcgcggcaagggcggcaagggcgagcatctgctgcccgacgagcgcatccgcacgacgttggacgcgatgggctgcgaggacatcgatctggagcgcgccccgcacgacctgtccggcggccaggcggcccgcgtggccctggcccgcacactgctcaccgatccgaaggtgctgctggccgacgaggtagatgccggtctcgacgacgacaacgcggccaaggtggctacaatcatggcggacgcggccgcacacggcatggcgatcatccgcatccgccaccgtccgccggacggacgggccacccgcacgctgacactggacaaggggcggctgaccgaacacgagatgacggatccggcggcgcaggacgcgaacgcggtgtctgccggcgccgatgaaaatgaggagacgcaggcatgagcggcgatctgggcaattcctacaacatcgatatctggggtctgctcatcgcgctgggcatggtggccgtggcggccatcatcagcgaactgatgcacatgggcatcggcaagaccctgatgtggtcatcgtgccgcgcattggtgcagctgtgcgccatgggcttcatcatcggctacgtgatccggtcgaacagcgtatggatggtgttcgccctgatggcggtcatgctggtggcggccgtgcagatcgtgatgtcccgcgcacgcggcatccccaagggccttgccgggccgatcttcctgagcctggtcatcaccatgctgctgatgctggcgctggtcaccgagctcatcgtgcgcccgcacccgtggtacgcgccccagctggtggtgcccctgaccggcatgctgctgggcaacaccgtaaccgccttggcggtgggattgagccgtttctacgagagcatggaggagcggcgtgacgaggtggatatgatgctggcgctgggagcgaccccatgggagtcggcccgcccgtccatcgtctcgtcgattcgcctgggcctgctgcccaccaccgcctcgctggcgtccagcggcatcgtgacgatcccgggcatgatggccggtcaggtgatcgccggcggcgacccgctcaacgccgccaagtaccagttcgtggtcctcgacgccatcgccgcgctgaccctgctggccgacggcctgatcatggtcatgatctaccgcacctgcttcaccgccgacgaccaataccgcccgcccgaagcgcgctaatcagctaagctccctctgataagctccctctgacgagggagctgtcgaacgcaacgagactgagcgagagaccaccctacgcgatggtgaccagcgtgccgtccggcacctggtcatagaaccattgcgcgtcggccacagtcaggcgcacgcagccgtgcgaggcgggctggccgagtttggcaccctcctccggcagatagtcgccgaaggcctcgccggtcggcaccgagtggaacaggtacgaaccgtagaactgcacccaatagtcggcgcccatgccttcttcggcattgtagaagtgttcgccgcgtgtatcgatggtgtacgagccgtgcggggtggcgtcgtcgacgccggtactggcgatcatcgtataaatggtctggccaccggacttgacgtacacccgttgtttggcgagactgacctccacgctcaggtcggagtactgggataggtcgggctgtttgccggtcggccccttccagtccacgctttgcgcggctttgtcatcgccgttctgcgtgttctgcgtcttccgcgacccgccctgtttgccgctatcgggaacctgcttgcgggtaacggccgtgggctcgttcgccgctgcggttgcggcggcggatgcggtgtcggctcgcggccagctgcgctgcgccgccgcggtctcgactccggcgccgatcaggcagaacaggatacagcaggcgaccactccgcgccgaatcgcgtagacccgatcgtgactccaattcacgttcaacgtcggcagcctcaccatatgcctcttctcaccacaaagaccattcgggtcgattgtaaacaggcattgcgacgccctacgcctcggtttcagccgtgatctcgactgcaggaacggcatcgtccggggaatcttcgcccgacgccggcaccgtccagcgccgccgcagcagcatccacaggccgatgaagcacaggagcccaccggtacggtggtagacactcatctcctgagtgagtcgctgcacgcggtcggcaatctggcgcgtacgggtatgcgatttgacgatggagaaacgtgagacgcacagcatcgcgtagtacacggcgctcacgatgaacagcacggacatcgtccacaatcccatcgccagtttgacgatggccataatgccgccgagcgttgtggagaaggcgacggccagtgcgactttgtcgttgttttccatggcgcccaggatgttcagcgtggtggatttgccggcgccggatgcgccgaggagactgcctggccattcctgcaaccggtcctgttccccggcgagccggatatcgactccatcgccgatccggccgaacgtaaacgccgcatccttctgaagcagttctacgtttccggcatcatcggcacattccgtgcagcgctaagcggctcgatcatgaccacccccaccgagatcgggcactttgtctccgaagaactgctcccccgcatcgcgccgcatatgcaaatgccatcgcaatcggaaacagcgcagcagccagcggcatcaccgcaagcccagtagcgaggtcaacccacagctggcggcgcgggaaacaggtcgcgccgcccagtacgcgaatccggcgagcttctaccgagtcgcgaggaagaagaaacgcgggaaggggaagatgatgctgccgtccgactgtgtggggtattcctcgcggacctgggcgaacacttcgccctcgaacttcttgcggctggcgtcgtcaagcgcctgcagatacggacgcatgccggtgccgcgataccagtccataatcgcctcatgcgagggcagcgtgtgcatgtacgtgaccttccacatgcggaaggcgctggcatgcgcatgcagcagctcccagtattcgggcggcgtgaggttgtagaactcgcgttgctgcggcagcttgtccgcgaacgcgggcgagtgcacgataccaccgatgatgcggtgaatcggctcctcatagttcatcggcgtctgcacagccagcactcccccgaccctgagccgggcgagcagtccgggaatcagatgcggatggtccggcacccattggatgcaggcattggagaagaccacgtcgaagtcggccggcagctcgtccagccgcgcggacacgtcgcacagctggaaatcgatgtcgggataggttttgcgcgctgtctcgatcatgaccggcgagctgtcgacgccgagaatcttggcatggggatagcgctcgcgcagcacggccgtgctgttgcccggcccgcagccaatatccagcacgcgcgtgacgctgccgtcgtccggcggcagctgcatcgccagatcacgcgccggctgcgtgcgctcccgtttgaatcgcagatactgttccgaatcccaggtaaccatgctccccacgctaatcagccattcacatatcggccgatattatctcacaattcagccgagcagggcgtcgcggcgggcgatgagcccgtcaatcgcggcctcgccttcgatgacggtgaaggtcagggacttgcgttcgctggcctgcggggcgatggcgtgcaggtcgccgcgctgctcgtgccagcctcggccgtggacgctggagttcgagggttcgaggccgaccacgtagtcgcccgcacccgtcgacttccattccatgaagtatgggaagaggctggcgtcgaagtcgatgacgactccgagtccgagcttgcggttgaccacggcggcgaagctgcggccgttctcgtcggcggcgagctcgtgcaggtacacgctttcgggactgatcgtcgcggaaggattcgttggtcacctcatcctcgaccgtgatcgacagccggccgtacacgctggtgattgtgcgacgcagtacgaggttctcgccgcggtattcgaactggcagacgtcgagggcgcggtcggccatggacacgaaacgcaacggaccgttcttcacctcgatggccttgaggccgtgggctcggccttcctagtattcgatcgggcgcacgtaggcggcctgctgaaggctgcccatatgggccagcatgtcggctcgcgtgctgtgttctgtggacgtcatcgtcgtcaccgatccttgatatttatgcctcacgcctgcgcagcggcggcatccgcggcgtcgttcttcagcgcgcgcagcagggccttgttgcgggattcgatgatgcgcttgccgtcctcgccctgccaggagaagaagccctggccggttttggcgccgagattgccttccctgaccttctcggcgagcagcgggctcgggccggtgccgttgtccatatcgtcgaacaggtaagtgctgatgttatagaacacatcgaggccgccgaggtcgatgctggcgagggggccgaccagattccagcgacggccgagactgtacttcatcacgtcgtccacggtggccgcgtccgcgatgccctgctggacgatgtagaacgcctcacgcagcacggccagttgcaggcgattgcccacaaagcccagcgattccttcttgatcttcgccggcttcttgccgatcttggccatgaggtcgaaggtgatgtccactaccttcgggtcggtcttctcacccggcaccacttcgaccagcggcatcaactgcgcggggttccagaagtgcgccaccacgaagcgctcggggtgccccatcaccgactgcagcgcggtggggctcaggccggaggtgttcgtggacagaatcgcgtccttgggggcggcgtgctccacttcggtccagacggacttcttgatgtcaaggttctcggccacggattcgatgacgaagtccacgtccgccacgccgcttgcatagtcggcgtaaccggtgatgcgggccagcaccgcgtccacggtgtcgccgtccttgagcagtccggcttcggcgaagtcctcggcatccgaacgaatcgccttcatcgccttctccagcgaggcctcgccgcggccgaccagatgcaccggatatccggccaacgcgaactgcaacgtgatcgcgtggcccatggttcccgtgccgacgttcgcaatcgtcttgatatcgtccactgtctcaatcacggagaccccttctttccggcggttcgtctggcgttggtgtacgcatgaacagcaccgtgccgttatgcgtttgttcgcattctatgccgatttcgctacgtgaacatttgctgaacatttcgcggattcgactagtacaaatccccatatcagcacaaaaacgtggtgccgcaacaccgaagtgttacagcaccacgctgaaatgttcatgtcgttacgctgccgtcgcgcacccacagcggaatcgataggaaacctcaccggagtaggtgaacacgggggcgaccagcatggacggaccgaacatatactgacggtccagcgtgcggcatgccgggtcatcggggaattccacgaacatggaacgcatgaccggagtaccgttcgcatgaggctgcaggccaagctggtagacatacggcatgagttcaagcttgagcttggtgaactcgcgcaccacatccacggcggtctggccgggcaccaatgcgacgccgttcttctcgtcttcctcgtcgaacagccacggcacacggtacacggtggaaccgtgcagtcgcgagtgggagccgagcatgccgaacgccacccaacgcttgtagacggccgggtccgggaacgcgccctcgaaaccgccgatgtcgtgactccagaagccgaagccggaggaggtcagcgacaggccggcacgcagggactgggccatgccattgaaggtggattcgcagtcaccgccccagtgcacgggctgctgctggccgccgaccgtcgcggagcgcgcatacaggcaggcgttgcccttgccgtaggtttcttcgatggcttcgaacacggcctggttgtacagctgggtgtaccagttgtgcatggagagcttcggagagccgtcataccagacgacgtcgcgcgggatgcgctcgccgaaatcggtcttgatggcgtccacgccctgattcagcagggccttgaccttgtccttgaaccattcacgggcggccgggttggtgaagtccaccaagcccatgccggcctgccagaagtcggtctgccagacttcgccattgggcttgcgcaccagatagcccttgtcttcgtgcaggcgcttcagcgtggattcgatgtcgccgaagaaacgcttgtcccactcgaaatcgcaccaatggaactcgcgcatccagtagcagtcgtagtggaaggcggccagcggaatatcacgctcggccataccgtcgatgaaggagttgatggtggcctcggtgttctcggaaccgatctcaaaggagacatggccgcggttgttgaccagtacgccatacccattggaggtcatgtagaacgggatgtccttgtagccctgctcggaagcagtgccgccatcctcattccagatgtcgacgctctgaccattcttcacgtaagcgccgaagcgttcgcccaagccgtatacgtcttcgccaaccgacagatgcagctggatggcaatgaacacgtcggattcatcacgggcggaaccgtccatggtcacaccgaattcgctgaccggctgggcggtgacgttcgattcggcaccgagcttgaatcggcccagcgacttgcctgcggactcagtgagcaccttgccgtcctcgccgatgaaggtcaggttccagggggcgcccttgacgaccttcacggtaagtccgccagtggtcagcgtgacatccgcgccattgacgccaacttcgccgtcgccattgccgttcgcctgaacggtcacgtaatcacggttgccgggttcgtcggcattgagcgggaatccggggtattcggtggcgccttgccagtgttcggcacacacacgaatcacgccttccgcaggtgtggtgatgtccacattgaatgtgggcaggttcagggtatcgtatcggccgcgcaccacggaggtcggggcgaggacgttgaggctttcggtggtggcatccgccgccagttcgtaggcttcacgagcgtagagggcgtcgacgccgtcacgaatcatccagtagccgttggtgaacttcattgttgctgctccttggtggagaggtggtttcgaccgccagggaacaaggcagccgaaaccaaaatcaatatgtgctgcttgttgattgaattgcctgttgtgcgaatgaccttacttcaccgcgccggtggtgatgccgtaccagtcgccggagcccatcatgccttgctcatcgtacttgccggtgtcggccaaggaaccggtgataatcttgtcccagccatattcggacacgtaatcgttgaggttggtgagcaggccttggctggcgagcaggccggacgtggcgttgcccttgttgtattccgtaacgtccggagcgtcgtcggagttgaggacctgggaggcgttctggcgaatctgttcgaaggccttcttctcgaattcgaccttgacgccggtctcacacattttcatgctttatgcaaaaaatgtgaggcatacgcacatttcccatcaaacgcacaggtgcaagaatggcagcaattcgccatttttgaaatcaccatgtgcgtttgacggcgcgtaagcctcacattgttctcagcaggaccgaatttctgcgagcccccctatagcgctcccctacgcaatatgtccgcaaacgaccacaccacatgggcgatacgcgccaattcggcgtaacggccgatggacagccactgcacacggtaccgttcgaaccacaactccaaatcggcggcaagacgggcgcggcgcgaggcatccagcgcacggccggtcacatccttggtgtcacaggcgtcctcgccgccagccaataccagcagttcctcacccagtctattgaacaaccgctgcccatccagcatcacccacagcagctccgggttcaatcctcctcgtgccgagccatcgagcaccgcgacaaccgcactgccgcaatcaatcaacgcccggtcgcaatcccggcgtcgttcgagacgggcatggttccgcaggagcaatcggcggcgcgcgtcggcgcatcccagcgcacggtcaaacatgagctctcccccgcacgaccgttccacatacgatgccacatccgtattcagcatgccggtgccggaaccgtattccagttccagcacttgcacggcgaggtcccaggggaacgacactccatcggagtcgatgcgagcgagtgaatccataagccaaccggattcgtcgccatacgccagattagaaatccgatggttcatttcgcatgcgtcaattgcaaccgggttccacgcgttttgcgcaccgtagcacagtcccggcacgctcaaccgcggatcattgacatgcccatagtcaccccaatcggtgaccaccatgccttccgcaccatatttgagcccagccaccgccatgcggtacgtgttcagccaggcaccgtcatagtcggggaagaaccggctccacgcacgcacggcagggcacacgaattggcggcggccttgtgatgcgatggtctggatcttgctttcgtcgatatccggctcatacatccagttgagcatcgtgatgtcgccgggcagcaagtccatggtgtgcggattctcgagcgcgatatccgcccacagcatcggttgtagaccacgatgggcaagcgtgctgcataggtctttgacgaaatcggcatacagctcatcgcgactggcgcccggcgagtcctgtacggaccggccacggcccaagtcgaaagtctcatcgccaccaatattgaaggaccgcgagcggaacagcggcgcgtattcctcgattaggcgcgaggcgaaatcgtgcgacttggggttggctgcgttcagtgtgtggtgttccattcgttcgatgaaactgaacggacggtcggcgtcttcggggaactctcccagtccacgatgttcacgggtgcgcaggttcatatacatgtgcccgaaagtggccaaggacggcaccagttcgatgccgtggtgtgcgcagtattcgtccaggaacatgatgtcgtcggccgtgagcgggtcagtgccgcgccacgcttcgctgagctcgccgaaagcgaaggcatgttccacgtacagctggaattggttgtacttatacaacgccagctggtcgatgaaccaggtgaggaacgccatcgtcggcacacgcccgcgcgtcacgtcaagactgtaggcgcgcaccgcgaacgcaggcttgtcttggatatgcaggcagggcaaggtccgcgaggtttgcctgatcatctgccgcagtgtctgcatgccgtaccgcaatccgctttcgctgccaccacgcacggcgatggtatctgaggcgaacacatccagcgtgtattcgtcatgcgccaatcgcgcatccacacacagcaatatgacggtgccgttcatcgctgccggcgcacccgcgcccgcacccgcacccacgcccgcatctcgcgctttttcggcggcattggcaccggcgtcggcttcatctgtggctgtgagtactcggcgcgtacggacggcgacgccgcagtaacgctcgagttcgctggacagctgctcgattggcagcgtttcccaggtctcatcggcatcttcggtgacggcatattcgggaattcgtttctcgatcgtcaccaaggacccgatcatagccgtgccatgcgtgtattccaatgtcaccggagcgggaatcagggtgagacacggcgttgcggcatcagccttatattcgaatgtgggcacagctgttcctttcatactgtttttattatcgttcatccgctgacggcaggcgacacgcggtcacgccgccatcagcggacgaatcgtttggtgaggtacggcggcatacgctatttcacggcaccggtcgtcacacccttcatgatgttgcgctggatgagcatgaagaacaccaccaccggcaacgagaaggtcaccgaagcggccatctgcccgccgaaatcggtgcccatggtgggtgccgagaaggacgacagccataccggcagcgtgtacttcgactggtccttcatgaacgtataggcgatcatgtagtcgttccaggcgttgatgaacgcgaacaccgaggtcgagacgatgccgggcgcggccagcgggaaggtgatcttccacaggatctgccagtcgttcgcgccttccacggccgcggattcgaagatgtccttcgggatgttcaggaagaacccgcgcatgttccagatcgcgaacggcagcaccatggcgatgtacgccaggatcaggccgctgtatttgttgagcaggccgagctggttgtagatgatgatctgcgggatgatgccgccagaggtcatctggatggccagcacgaacaccatgatcggcttgcgcccgcggaagcggtacagggtcagggccgtgcacgcgaagaacgcgacaataatcgacaggacgatcgagaggtgcatgggccagaacacgggggtcgtggtcatgatctcatcgcgcggctttacggcggtgataatcatccagtagaccgggaagaaccatacgacgcagaacagcagggcgaggatagtggtgccggcgcggcgcgcgatcttgccggggttggttcggcggcggggcggtgcagactgcgctgcgccatgcgatacggcccgtggattctcaacacatttcataaggacgaccctctatttcagggattcgccaatatcagcgtgccagtcgccatttccggcgtcggctatggcagcgccaccccttccccaccgtcgacatcgacaaccgactcgcttcacgcaagctcaccgagcatatgttggggcgcgggtatcgacgaatcgcctatatcatcggaccgtcgtacttgccgacgttgacgccgacgccagcgtgcccgcagctgaccaccgtgcgccagccaatggacgcattcggcgtcagcttggctaccctagtgcttgaccagatcgaggaccggccgttccagcgcacggggctcctgcccaccgaggtcgtagccagataggcgcgcagagaacggttctcaataatgtctgtgcacacttctctacgcccgaagcacacatggaatatgccctaatcactgccatgtcgccatttgcgatgatgtgagattgttatgttcttgttcatttgagcgcacagatactactgagaaccgttctctgcgcaaatagacaatgtggataactccataagctggaaccacattgccctgcctggcttgcattcaagtccaaatcagctttacggtcgcaccatgagctcttttatgcatgaggatattgtcggccgacgccgagcagaacgtgaacgctgcaatgatgctgcgcgccgttcgaaaggtccattgctggtgggatacatcaatgcggccaactactacggcgcgcccatcccccgacattgcacgctatctgttgatgccgtgcacgcctgtgtttccagtgccaacaaacgcagacgaatcaaaggcgtggtcttccatgtgtttaagggaaaactggatatccgcaaaaaggattatgaacagttctggattgcctcgccggtcatgatgtgggctcagatggcccaatactctacattggaggaacttgcggccattggagcctctttgatgagccgcgataaacggcgcagaatggccactcgcaaggatttcgatacttacttggaaatcagtccgcggttcataggtcgtaacaaatgccacgaggcactgccctacatgacagagaacacggattctccgccggaaaacacgctgtttgggatgctgaaggattcaggcttgggatgccccaccgccaactatcgcgtgaatatcggcaactcatacgtcatattggatatggcatatccggactgccgcgtcgcgttcgaatatcagggagcctatcacgccgatccggcacaaatgcgaatcgacgcggcaaagcgaaacgcattgcaactgctcggctggatcgtcattctcgtcactgcggatgacctgagaacagccgacacgcggcatcgttttatcgagatggcccatgtcgtggtgtcccggcaacgcaatctcgccgattggaaccgctcatgggccattacctcttagcatcgcaccgacaatgcgctatgccgttatttactgcgaggcacccgccagatatcgggctcaacgtagatctcccattcataccaaggcagcgcggcacggcgtcctcgtccatgtgaatggcctgcaggttaatgagcctatccacgccggcagtgcgctccattgcctcgaccaccaggtcgcaggtgctgtggtcaagcgattcgcccaccagcagcgaaccggacttaaacgccagcgccgcctacaaaagtgtgaggctgcgcaggctcacactgccaacagccgttcagccaaccctcggaaggtctggccaatgccatccgtacgcaaagcgccgtcggcgtccagcaccgccggccggccggcctcgccggtctcgcgcacttcgggttccagcggcagctgggccatcagcggcacgtcatagcccagcgcctgagtgagctgttcagacacgcgctgaccgccgccggcaccgaaaatctccagcttctcgcccttgtgctcgtagtagctcatgttctccaccacgccacgcaccttcatcggcacctgcagggccacgagtccggagcgcacggcgatgtcagaagcggagggctgcggggtggtgaccaccacgagttcggcgttgggcagcgcctgggccacggaaatcgccatgtcgccggtgccgggagccaagtcgagcaagaggacgtccggctcgccccaccatacgtcagacaggaactgttccaaggagcgctgcagtcgcggcccacgccacagaatcgcccggtcagcaccggcgaacatgccgatggagatcagtttcacgccccacgcggtgaccggcatgagcatgccattcagattggtgggctgtgtatgcacgccgaacaggcgcggcagtgagaagccataaatgtccgcgtcgatggcggccgtgtcgaagccgagggccgcaaacgtggcggccaggttcgcggtaaccgaggacttgccgacgccgcccttaccggaggcgatggcgaagatgcgggtcttgacacccggtttgctgaaggggttctgcttgcgttcggccttgaggtcggcgaccagatcggccagcttgtcacggctcatcgaaccgacttcgatatgaggcagcagctgtgcgcccggataggagctgaccgcgccattgatctggctggtgatggtctcgctcagtgggcatccgggaaccgtcagctcaacgtgcacggtgacgtcgtaagtgccggcgtccgacgatgcgggcgcggcttcgatggcggcaatcatgccgaggtcggtgaccgaacgaccgagctcggggtcgatgaccttgctcaggcgttcgtagatgtcggcttcgatctgacgtgcgtcgctcataaatccgtatcctcctttagggcctgttctaccctagcgtgtgatgcggcggcatgccagagggagtggagtaagtcacactggggcgggattcgctttttctctcccccagtcagcctaaaggctgacagccccctcatcagagggggttaatgaagcgtctgagggggctattttagatggtgccggtggctaggagctgggcgaattgggtttcgctcagcatggggatgccgagttcctcggccttggcggccttggagccggcgtttgcgccaatcaccacgtaatcggtcttcttgctcaccgaaccggccgccttgccgccgcgctcgataatcgcctctttggcggaatcacgcgaatagccctccaatgaaccggtgaccaccacggttttgccggccagcgtctgcggcaacgaactggtctcggcctcgtcgacgcccacgccggcggcctgccaagcacgcaaagtcgcgccgcgccagtcgccgggttcgcgggtggcggcgaaccagttcaccaccgattcggcgatttccgggcccaccccgtcgatggccgtcagatcttcaatcgtggcgttttcgatggctgccagcgagcccatcgccgaggcaatcaggcgtgcggtaggcggaccgagccggcgaatcgacaacgcgaccagcacacgccacaggtcggcgtgacgggccttgtccatttcgtcgaacatcttgcgcgtgttttcgccgggccgaatgatcaccggtacatccgtgacgccagtgcgcgtggtcttgtgatccacgcgcacgataaccgcgtcggccggcacgtcatactcaggataggaggctgcggcaaagcccggcatagtaccaagtggcgcctcagccccggtaggtgcgccggtcgtctcgctggcggtacctccctgtgtttcggcagattcgattgcggcctccccttgcgcgcgttcggccagctgcttggccgtgagctttttggccggcgtgggcgcggtccagaaagcaggcacctgatgccacaggccagagccgccgacacgcttacgcacctttttcttcttaccgttcgcaccgaccgtctcatgcacctcgacgattgcggcctcacgccacacgcgcacgtcgcgcagatcggcggcggtcaggttgaacaacccggattcgttggacaacaccggcttctgcgcggccggcaattccagcccttccaccggctcgtacgggtcaggctcttcgccgggggcgaccagaacctcggtgatgttcggcgcgtaggtcgccaccgaatcaggccggttctcctccgggttggtcagagcgatggccgattgttcgcccaagtgctcgatgtcgaacgccttgcgtgaggccagcgaaatcacgcgctcggtcaactgggccgggcagctctccacattcgggcagcgaatgtccttgtccccctccttggcgggtgacagtttcgcgccgcatgaagggcagaactcgggcatgacgaattcgcgcagctggtcctcacgccctttgcgccgttcaagcaccgggccgaccagttcgggaatcacatcgccggccttgcgcaccaccacggtgtcgccgatcagaatgcccttgcgtttgacttcaaatccattgtgcagcgtggtacgagccacggtggagccggccacgtagacaggtttgagcacggcgaccggcgtcacgcggccagtacgccccacctgcacggtgatgttgagcagttcggtgttgacctcttcgggcgggtatttgtaggcgatggcccagcgcggcgcgcgcgaagtggcgccgagggtacgctgcaggcccaggtcatcgaccttgacgacgatgccgtcaagtgcatgctcgatgtcgccacgatgctcgccgtagtactcgatcatgtccaggatctcctggaatgaggtcaccgcacgattgtgcggggagaccggcacgccccacttggtgtatagatcgtaggcctgcgactggtcggcgaccacatcatgggtgccgcgcggatggtccggcccccaagtgagctgccccagaccatgcgcatagaagctcaggcgacgggtggcggtgatgcgagggtctttttgacgcagcgagccggcggcggcgttgcgtgggttggcgaagggcgctcgtccggcgtcctcctgctcgttgttcagggtgtggaaatcatcccaacgcatgaacacttcgcctcggatttccacgaagtccggaacgtcttccttggggccgccgaggtttgcgggaatggagccgatggttcgcacattcagggtgatgtcttcgcctgtaacgccgtcgccgcgcgtcagtccctgttcaagcacgccgttgcgatagatgaggttcagggcgaggccgtcgattttgacctcgcaactcatgggcaggggcttggattcaggccaatcgaggtcgcgaatcaccgagtcgtaccaatccttgagttcttcgatggagaagacgtcgtcaaggctcatcatgcggctggggtggcgcacggaggcgaagtcgttggagaaggaaccgccgacgcgatgggtgggcgactgcggattgtccagtgaggggaacgccgcttcgagtcgttcgaggcaacgcatgcgcgcatcgtaagcggcgtcggagctgacgggtgagtcgtcgatgtagtaggcgatctgatcggattccacccatgcggccacgcgagcccacaggcgggcggcggcctcagcggtcatcgtgttcacgtcgaaacggtcgaggcgtatcgcgtcgtcgtcagtgggctgcagtgcggctatccattgttcggagccaggggcaaaacgtgcaataccggtatcaggccggacctcggccacatccccatcgtcgaaatcccatgccagttgttcgttcgtgctcatggttgtctatcctagcgggctcggctcccctcggccggctataccgtcaactcccctcaggcggctacgcggatagcgagcgcaggaactgggcttggatgatgtcgatgttatcgccttcgccgtcattcatgcgggccacagccaccgagagcgtgcgggccggcacgaacatgccctcatccacgcacacgcgagcggcgtcacgcacgatgtcagccacttcgatatgcggccagaccggcagatcatgcgtggcaagcacatgggcggcggcctccaccgattcaggcaccggtatgcactgcgagtccgcacgggaaaccagttcctgcagttcgctttccagcgaaccaatggccccgggagcgatgtgatcgctcataatgtaggctgcggcggctgtgtcgaaccggtcaagcatccattcggcgtacgcgaaccggtaataggcgaacgcggcatcgtcgcggtccaaggccacgcgcagagcattcaggcaggcggcgcgtgccgaatcccaatcctcattgcgggccagttgaatggcgagcttcagatgtgagagcgggtaggcgggcgcgtacgccaccatacggttgagatgcgggatggccgcctcggcacccttgatctgactcaacacgtcagccagctccatgtgcgcgtagaacagattgtccgggataagcaccgtacgctcgtccaatgtggcgaacagccgattgtagaccacgcgctcggcataggagttgaagtatcgaggtacgccatggcctgccgcatacacctggtccaaatgggccacggccgcttcggccgcttcgatggcctgatcggcttggcccgagaacagcatatctcgggcgcgcagacgctccttgtcaagatcgtcggcaagcgtgaacgtgaagtccggcgtgtccttgccatcgatcaacgcactggtgacctgagaggccaaaccggtcagttcgggatcgcatatcgattcgatgacctgcatggctcgctgggccttttccacggagccgagcgacgtgttcctggcgatatcgtggaattcgttgacgccatgctgcagcaggtccactcgctggatagccagtccggcactattctgtgcgcccagcacgtgagcggtcgccggactgaattgacggtcggccagttcgggctcctcctgggatccggtgggagagaaccggctgtccgccaagtcgaagtcggcgctgatgggtttcagaccaccttcgccgtccacgtccatcacggcaccgaacatgcggtaggtttcctcgggattgtcaagcccagcggtgtccagtcgcttgaggaaggcatcacgggtgaaggtgacggtgaccatattgcgcacggtgggattgcggcgcagcacactcatcggatcatcgtccatgccggcggccccatcagcaccgtcagtgccgacgccctcgccgccgataccgcccaggtcgtcgcctgcgccggtatcgtccggcatgccgaacgccatttcgtcgatatcgatgcccttcatcaggtcttcgaactgcgaatcgatggacgcagcgccatcggcgtcagcagattcggccgcggcctgatccgtagcatccgcagacggtccggtaccgttgcctgctcccccggccgtgccgcgttcgtcaccggacgccgtctgcccgaacgtctcctcatgggtgatggggcgggtcgggtcgccatggaaatcaccatctttggggtcggctttggaacccacacgccccaaatcgccactgcgtagatgttcgaaggcgcttagggcctcgctcatcatcgcctcgatggcggaatcctgttcggcaatcgcctcttcaagaccaatggaatcgatgtgcaacgacacctggcgcacggattcgctggtgccgaaacttagcgcggccatcatcaggccgacacgcaggttgtaggcggcgctcatcgacgcgcgttcggcgctactcagcgcacgccacgtacgtcgagtggtgtcataccggctatcgggcatcatcgaggtgccggcggtggtgaagccaatggccacttcacccgaatccaagcgcgaccggaactccacgtcaaaccgatacggcaaccgtaaccggcgcaacagtgaagagagggtctgacgatacacccattcgtcgctcctcgccggcgaatacgaaggacgagcggcttgagtgttggtgtcgctcttatcggtccgttctacagcgccctcagcactctcagtactttcagcgcccgcagcattcgtcacacccgaatccggcacgttctgctgggtcagcacatctcgaggatcggggaattcactgcgaatctgtccagccgtgcgtgcggcgatatcgatcaggctcagcacggcccgacgctcctgctcgccatcatacgggtcaagcgccataatcgcagggttttcgatgagtttcatgtcgatttgcgcggcctcggcacgggtcaccgtatcttccgtagggttgcgtcccaaggaagcgttgcgctccaaccaagcgctcaccgcagcgaatcggttgaggttgccttcgatcttcaaggatttcagcgcctgcccgaatgccaaggacttatcccacgtaaagaaatagccgctcgaatacgtcgaggtgtacaggtgcaacggttcggcgccatgcaccgcttccagtcccggcgtggtgtcgagagcgccggcttcgcgcatcagatcggcgaaatgatcctccagaccggaggcccgcatgccgtgggcacgtgccgccaaagtgtcacgcaccgaacggcgaatcgcaccgattggcgcctcacggttgagacggcggaagatattgccggaaccgaatccgatgagcagaccattgatctgcggcaacatatacgtggcgaagaacgcgatggtaatggcatcgcggtattccaaatcatgacgcatcgcaggcggcagattggcacgcatctgctcaagcgtgtaccggttgccggccttgagccatgaggcgagccacgtcatgcgtccggtgtcgtcacgccccaccacgccaccggtaatggccttcacaccgtcagcaccatgaccaaggccacgtcccaaaccacgcccatgatgcagcgcacttcccaggccacggtctgtacgggagaaaccggaacgtgaacgaggctcgtcgctttcgcccagccgctcaccgtccggcaatgtcacttctttttccttgccgaacataaatcgcgcctgcatatcctgcacgtccatgttggggtcggtgcccacgaatacgcggccatgcgtatcggcgaacgccacctgcgcaaaatgatcgcggtcggggaaaatgccaagcgaaaagccacggcctctggtggagggcagctgcgcccatccaagcaccagcccttccggcacgttctccaattcggggaaggtgcgccgcttgattacaggactcagcgccactgcatggcgagtcagttcgtcgataatgccgcctttacgctcactggtctcccgcaaggcatcgccgaacggattcgtatcgtgcttcttcggcttggacagtcccagatcggccgcgagcgcgttcatcgaatccttcagcccgcccagcagtggcgtgcggttgtgcttcccatggtccgatgtacgttttggcatgattcacattgtctcttgtttgcccgacatcaagcccgaataaagcctatagaataaatgcgtgcattccatagaccacactcgcgcagaccgtccgatgccgtcgaatcatgaacggcacctgcccagccgcccggatacccggcaccggctgcgtttggtgcgcctgctgatcgccttgctggccgccgtcgccgccatcgccgccatggagtgcatcgtgttcaacctgccgttctggcgtacgctcggagcgagcacggatacgaacgccgtgcataacacgctgggttcgggtctcacgcgccggaatgatggcatgttgaccgtcaccgatccgaccaaggcctatcttgaactgaccgcggacggcacgtcggattacctacgcatcgataccgagagcagcaaggtcatcgataaggcccgcgagcaggccgaggccgaatccaaagcgaacgacgataaggaagtcttcaaaccgctggcgaccattcatgtgcgcgcggatgtcgatggcatcaccggcaaggcccagtcgatgaatcccgacgctattcgcagccattatgtcaaggcgccgggtgccggcatcgtgcgtatttggattcaggaagagcgcggcgcgatcgtaccggtcaccgacgcccgcgccaacgtgcgcgtaccgttcgtcatcaattggatgcgcgtgctcgccatggccttggtgttgctgatgattgccgtctggaggccgggatcgcgcctgtggcgtatcacgcttgacccgtccagcactcggcaacgacttgctttcgtggggcttctggcgattcctaccctgcttatcggcgtatccatcatccacgaactgtggtacacgtcttcgctcgtcttccacgtttccggcgattacacctatgatttcgaccagtatgggcatgtggccgatgcgctggtcgccggccggccctggctcgacttgccggttcccgaacagctggccgccaccgagcacccctatgacgtagccacacgtgcccagctactcgccaatggagccagtccgctctactgggattacgcgtattatgacggtcactggtattcctattttggcgtgttgcccgcagtgctgctgttcgtcccctatcgtctgctggccggtcataatctgccgacatccgccgccgagtatattctcgtgctgctgttcatcatcttcttctccttgctggtgctgcgcgtcatccatcgtgtgatgccgaagacttcggtggcggccgcgtcgttagtagtggtctcatcgttggtgagcgcgcaaatggggtatttgctgtatcgcacgaacttctatcagataccgttcgccgcatcgctgacgttgacgtcgctgggactatggctatggctcggcgcggacacgtcccgccgtccgctgagaccatcggaccgatggcaggcgggcgatgccaagcctctctccctgccacgactggccttgggcgccttgtgcattgcggcgaatttcggatgccgaccgacgttcaccttggccgcattgcttgcgttccccctgttctggccgcagattcgcgcgctgggcaccggtctgcgcacacgccgcatcaagccgttgcaggcgttgcgcgcgccgctggcggtaatcattcccgccattctcgtcgtgacgcctctgatggcgtggaacatggttcggttcgattccccgttcaatttcggcaatgcgtatcagttctccatatccgatatgacccggtataccaccccgtccgcggatatgcccgccaacatctggtattacctgttcctgccgctgcgcttcatggatcgtttcccgtggctggcgggctctcccgccccgatgccgcaatggggttattacgaggtgatggtcggcgcgattttcacggccacgccactgaccttgatggctttggcgctgcccctgctgcgcagattggaaacacacggcatgcggccatggctgatgtcttgcttggccgtggcggcggtgctggtcgtattcgacagccgcgtcggcggtttgggatggcggtattccgccgatttcggctggctgatctcgctggcgtccataccggggctactgtggctggtcaatgggcgcgaaccgagccgctcattggcgggggccaacgacgccgcttcaggcgatggcatcgcccgcgtcactccgtggcgttggctgatgcgctgggtcgtgatgctggccgtattgtgggcgctgggcatagccatactaagttgcttcgtgcagtcgcgcagcgattcgatgatcgccaacaatccgacgctctggcatcaggttcagtcttggttcaccctgctataggaccggaccgctcggcgacccgccaagcttcagtattctcccagcattccggccggtgttttccaagacctgcggcataatgtatgtgacgtaattcactaatcgtttacccatactgtcgtgagggtttccccgtgtccactgccgtccgtagtcgcgtcttccagctacaccgtttccgctgaggggtacccggattacacggccaacgccatcaccagcgatgaggcggccgccgcataccgtgaggccgccgccggcgacgccgacggttccggcaatgtcggcggtaccagcacggcgagtcagacgaccacggtatcgagcaatgacatcgcctccaccgagcacgagtttctggtgttgggactgatccccaaggtcaagaacaccattaccctgaccatcaccgacaccgacggcaacctcaaggcacagtacaagatggtgctcagttcgggatgcatctgccgcgtctaccagtacggcttccgcggcttctacttcgcgtgagcctcggcatcggactcacggccgatgccaatcctccaacggccgattcctatctgctaccgcttcgcagcctcatacttgcggcgaatcagatcctcataaaacgccacagcctcagccggcgctccgtcaaacgcgaccgcgtgctcgtccagcaccagtacgcggtcgatggcgtattcgggccggcggatcatatccgtgtcatgcgtggcgaaaatcacctgcttgttgtagctgaacaacgccttggccacatgcgcggcgccaatctcatccaatcccttgctcggctcatccgccacaatcgcactcggctcaaagctcagcgcggccgcaatagccagcaggtgccgtttctcggagtccagttcgctggccttggccttggagacctgcgccaaatcaaaatgcgcgaacagattgccgatgcgcgcatgacgttctgactcgggcaccttgtgctttttcagcgcttcggaaacagcctcggaaatattcgccgcttggtaaaagctgttcggaatctcctcgcggcgaacttcgccgaccagattatcgatgcgcttcgcgtccttcttcacagccgggtcaagacgttcctcaccgcccgcaatggtcaccgtgccggcgttggccttcaacgaaccgtccagcagacccagcaatgtggatttgcctgcgccgttcagtccgatcacagccacccgcagctcgctgatggtgatgtccgtgggagcaagtcccacgtgcccatcatcatacgtatgcccggcctgatccaaagtgaacgtcagcgacgccaggcgtggcagttctttcggtctaaacaagaatcccatgccgctattgtacgtggagtacaggcgtggtgccggcaaacaccggcctatcgcagcaaagcggcgacggtattgagcacggcgcggatgccacgctcgaattcgtccggttcgggtagcagggaaacggccaggtatccattggaagtcatgtcgaagaagtagccgggctgtccggtcagtttgtgctcgtcaatcaaccgcagcaccagctcgttctcatcgatgactgaaggcactcgtagcagcacgttccagccgccttcggcccgtagcacgctgaccagcccgttgggatcggcgtcaagcaactcgtgcaacttggccaggttattgcgcacgcgctcccccacccgtctggtctgtgcgggcgcggcgttcaataatgcgggaatccgttcggcgatgatgtcactcatcggcagataatcatcggcgatgacgtccagtcgacgctgtgcctcggcaacgtcctcggcaggtccggacacctgaatccacccgactttggcgtgcggcgcggccagcattttggagaatccgtctagggcgaaggtgagcacgccgcgctcccccgcgagccgtgcgttgccggggaaaggttcgagagagtaatcgaagaacacttcatcggcgataagggcgatgccatgctcacggcacaatgtcacgatacgtgcacgctcggttggttttacgtacgaaccggtcggattgttcgggttgatgagcaccaatgctctgatgcgttcgccaccgggctcgctgagcagccgctcgagttcggcgatgtcgatgaaccaggagccgtcgaattgcaactggtattcgaccgtgtcaacgcattcaagccgtgcaatcgactcaatcagcggatagccgggtttgggtgccagcaccgcgtcgccggcatcgcaaagtaacttaatcagccacgaatacgcctcggacgtggagctcagcaagtacagggcgtccgggtcaacgccctcgatggcggtattcgcattgttgaaagcggcatggcgctcgttcccgccctcgctggcggcgggcgaagtcgactgagggctgcttgcgtctaccgcctttgccgtattgaggaatgcggccaatgcttctcgcgccgcacgcggtccacgcgggtcggccgtatacacgctcggcaccaattcaggtgccagcccgtggcgggtcggattggaatcgttgagtttgctgagtgcgatgccgtttgccttggctgccgcctcggccgccgcaatgggattcggcgcagaaatatccacacgagaagagaaatgcacgctcataccctcccacgatagagcgtggtgccccctgccccgctctcaaacgcgcaacattcccggaaatgcgtcgctctggacccgaatcacaccctcaaacgcgacacattcccgggaacgcgtcgccacagacctccatacacacgcccactttgcgcaacattcccgggaacgcgtcgcatacctttcctatgcaatgcaaaaggccgcccgactagtcggacggcctgaagcatattcgcgggtcagcgctgcacacccacgctcactggctcactgctgcttggtgctggcatagtaggcggcaccgacgatgccggcctggttacgcagcttggcgggcacgatcggggtcttgatatccacgtacggcaggaacttttcgctctgacggctcacgccgccgccgacggtgaacaggtccgggttgaagtacttctccataaggccgtagtacttggtcagacgcttggcccacttcttgtagcccagttcctcattctcgcgaatcgcggaggaggcatacttctcggcgtccagatgcttggcgctcaggatgatgtgtccgagttcggtgttcgggatgagcacgccgttgtaaatcaaggcggtgccgatgccggtgcccagtgtggtggcgatgaccagaccatcctggcccttggcggcaccgaactggacttcggccaggccggcggcgtcggcgtcgtttaccacgacgaccgggcggccgcaggcttcggagaacacttcagtaacgtccacgccaatccaagactggtcaaggttggccatgaagtcgagcttctggccgggcttgatcggcgcggggaaagcgatgccaacgggtgcggattcaggcacttcgaagtggtcgagctgctgcttgacgattttggccacggcctgaggagtggagacctcgggagtgagaatcttcaatcgtggctcggcgaaatcgcccttggtcagatcgacaggtgcggccttgatgccggaaccgccaatgtcaacaccgaaagcctgtgcagtttcaatcatcgttgaccttcctttccatacgttttcatcagttcgtaaggttgcgcccagtttaacgcgaattacgctcaacacgaaaccattacacaccaattgtgcaaacgtgtgcatcgtcgccggtcactacgtaccctattcgtatcgtttttcaagcctgacaatgggcaatgcatgcgatttcgcatactaggaaaaatcggcgtctatggtggcctgactctgtgtcgcgcgcgataatgggaggtatggcagaacatacccaacttattgatgcaattaacatccgcaccgccgtacgcgcctacgatgatgagccgatcgacgacgatacggcccgccagctcgagatggcgcttcagccgatcaacttactcggcgatctcaacattcagctggtgcgcgaccagcccaaggtgttcgccgaagccaatgcttcaggtcatctgaccaatgcggcgaattatctggccatcgtcggccccgcgaacgatgaggaagccaaagagcgtgccggcttctatgccgaacgcatggtgctcacggccacgttgcgcggcctcggcaccttatgggtcgccggctcatgggacaaggcggaggcggccaagcattgccgcgtcacctctggccaggagctgtatctcggtgtggtgatcgggcatccgaagaatcatctggattatcaggcgaaatcctatgaggagctatgcgaagcgcaacgcacgcaccgcgccaccaagacctatgagcagttcaccgccacaatgagcgatgaggggcgcgaggccgctccggattggttcaagtccggcgtcgaggctgcgatgaaggcgccgagcgcgatgaaccgtcagccaatcaccttctcgtataatccggccgacgataccgccgccgcgcatatcgatcagagtgcggaagatgagcatcacgcgttcaatgacatgggcatcgccaagctgcacttccagatcggtgccggccaaggccagtgggcttggggcgacggtggcctgttcatccataagtaacctgtagtgaccccctcatagaggggagccactactacggctacttcagcgacggcatgagcttccaggtggggtcgtgcatcagcttgcgcgagtcccaccagcccttggcaatctgtaccaaaccggtcttgaggtgctcgcgatccaccatcaccaggcgaatgacttccttggccgcggtgagcacggtacccagtccaaacaccagcggacggaagtcaccataggtcatgaagtaccgggccatgtatccgcggttgcgcatgatgtgataccggttcatgtcggatgtggagttgagctggcgcacgccggcgatatcccaattgccgatttcgcgcgtacggcgcaggatcacgtcgggcaccacaatcgggttggtgaccttgctggcgcggtagccatacatcgtgtcatcccagtagatgaagaagcgcgggtccggcagaccgatttccgtaaccacacggcggttgaacaggccgccttcgaagcacagcgtgtccatcactcggtatccggccgggccgaatgcggcgggcgcaatcgggttcgggatgcccagcggcacaatgaagtcgtactgccagtagaacgggccgccatcgtagtcgaatcgggagccctgaatcacctcgtgcttgtcggtccacttggacagcttggcaatggcgtccggcagcacggccacatcgtcatccatcacccagaaccatgcggcacccagctcgtaggctttggccacgccggcggagaaaccgcccgcaccacccaggttctcggtctgcggcgcatagaccacacgttcttcgttaccggactggtcggccacggtggtgccccattggccggtcaccttgccggcaaacgcagcgaccatgtccgccgtctgatcggactgctcattgtccacgatgacaatgcgccacggtgcctgttcaagcgccagaatcgaatcgaacagtgtctcaagcaactgctgacgtttgtaggtggtgacgatcagggcaagcttgtcgatggtgttgttgggtttcttcacttcagccatggctcccattgttgcacttgaccggcacaagacgaatttctgcacagtgaaacgcgggttgcatacgtccggcgcatggcgtatgaataagcctgtcagtttcagggaaggtgcaattccttactggcggtaacctgcaccccgggtttcataacggggatggcaggaagcccgcgacccgcgcaagcggctgatccggtgagattccggagccaacggtatagtccggatggaagaaacgagggctcattatgagtgtatcttcgcgtattcgcatgcaagttgttcgttctgtggcacccgaggccgagggttcggccagcacgtccaccgccagcaccagcgccaaacttggctcacacaccactggtgtggccgattctggccgctggtccacgcgccgtatcgccatgtatgcactgttcgtggcgctggcgatggtcaccagcttcattgaattcccgattacgccggtcacttggctgaagtacgacccgtccggcatcgtctgcctgattgccggctttgcgtatggcccggccgccgccgcaatcgtgtctgtgctcggctttgtgccgcacatgttcgccaatccgtggggttcgctgatggctgtgctggtggcgctgttcctgtctgtgccggccgcgttcatctaccgtaagatccgtacgcgcaagggtgccgccatcggcattctggtgggtgcggtgctggccatcgtggtggcgctggtgagcaacctgattgtcacgccgatttacgcgcacatgacctaccaagctgtggccgcgatgattctgccgattctgctgccgttcaacgtggctaagatggcgattcacgccgtgatcaccttcctgatctacaagccgatctccaacctgctgtccaagcagcagtgactggcctgagacgggccgatgcccgccacgactaacgaccactcaaagaccactcaaagaaccagaacgcagaatcccggcacgggccgggattctgcgttttcgcctatcagttacggattgctgtttcatgaccgttgcaccccattccttcgacgccgacgagttccacgattctgccgaacctcacgcttccgccgagcctgcctcccccgccgccgtgctcaaggacattcgtttcagctatgaccgcggcacctcatgggctttggatggcgtttcactcacggtccatgccggcgagcgcctatgcttggtcggtccgaacgggtcgggcaaatccacgttagcccgtctgattgcgggattgaccgcgccggacggtggtgaagtgacgttactggggcaacgcgtgtacgcagccggcccgaatgccgatgcctatcgtgctgcccgccacggcatcggtatggtgttccagaatcccgaggatcagctggtcaccaccgtgttggaggatgacgtggcctttggcccggagaatctcgggctggagcgcgagctcatcggcgagcgtatcgttgattcattgcaggccgtggggttggcgaacttacgccagtccgacccgacccgtatgagcggcgggcagcagcaacgcgcctccatcgccggcatgctggccatgaacccggcaatgctggtattggatgagccgaccgccatgctggacgaatccgcacgcgccgaagttatgcgcattttggatgatttgcaggcgcgcggcaccactattgtgcatgtcacgcatcatccagatgaaaccgttcatgccgatcgcatcgtgcacatggaggccgggcgaatcattggtatcactgcagccgtcgataatcgatccccgctagcggaggctgtctcgcaaagcgagactgagggtagtatcggcacagaagccgcccccagtcgccctacgaacgacagcccccgccagcgggagcgcgaagacggctccgaactgccgctgctctccgatggcatcggtgatatgacgaaccccattattcgcgtctcgcatctgacctatcgctatccttcggccaaacgggcggttatcgatgacctgtcgttcaccatcgcgcgcggtgaaaccgtggcactgatgggcgtgaatggttcgggcaagtcgacgctggtgcgcatgttgtgcgcactgactgcgccgaccgccggcagcatcgaagtggccggtgttccggtggcctcgaccggcaagcgcggtcgcaacgtgcgcccgaagtcggcgaatcgcaagcaattagcgcaattgcgccggcatgtgggttacgtgatgcagcatccagagcatcagctgttcgctgacacggtagccgaggacgtggcgtacggcccacgcaaccaagggcttggcgagaccgaggtagccgaccgcgtgcgcgaatcactggaactgctgcatatcgggcatcttgccgaccgctcccccttcgacctgtccggcgggcaacaacgattggcagccattgccggcgtgctggcttgcaatcctgacgtgctcatcatggacgagccgaccgcgagtctggacgcccaagccaagaagcgtatccatgagctgttgcgcacgctcaaatcgcgtggcgtgaccgtgctcatcatcacccatgaccgggaggaggccgagcaaatcgccgaccgcgtggtccgtatgccgattgccgcccccgcatccggcggccccgtcacggccaccgtcaccgagccggccgtatcctccaacggccctgcgcactcagtgatacaccgacttgacccgcgcgtgaagatggtgggcttcctggccgccatgttcacgatgttcgcggtgaacacgccaacccagctcgcgctgggcatcgccatcactctggccgttatcgcggcggcacgcctgaacccgttacgggtgcttgaatccattcatccgattctgatcctgctggtgctgatgggcgtggtcaatctgtttgtggtacgcaccggcacgccggtggtggcgcttggcccgctaagcatcaccgatcagggcgtgaccatagccgtgctgtacgcctgccgtttcgcattggtaatcattctgggcgcggtgttcctcactaccaccacgcctaccgccatgaccgacgccttcgccaccttgatcagtccgctcaaccggctcggtatccatgcccaagaaatcgcgctggtcatgagtctggcattacgattcattccaacgctgaccgacgaaacccgcgccatcgtcgacgcccaatccgcgcgtggcggttccatcgaaaccggttcactggcccagcgcatcaaggcgatgagcgcgattatcgtgccgattttcgccggcacgttgcgtcacgcggacaacctgagcctcgcacttgacgcccgctgctacgaggagggcatccgccgcacccactggcgtgccctgaccatcgccgcgcgagatctcatattcgccgctgccgtcatcatctacatcgcggccatcatcgcgctgtagggcggcaaacagcgcagacagcaccggttgctatgctggtgtggttatacgaaagatgtaaggaaattcccatggcattgaccaagaagcaaatcaagcagctgcgcgcgatggcgaactcgctgaagcccctgttctatgtgggcaagaacgatttgaccgagtcggccgtcaatcaggccgatgagaccattgagaagcacgagctcatcaagtgcgccgtgcaggacggttctggcctgaccgccaaggaagccgccgccgagcttgccgagcagctgaacgccgaagtggtgcagtccatcggcaatcgtttcgtgctgttccgtcgctcccggcgcgacgatgtggagcatatccgcttggtgcgcgagtaatgttcgccccgctcgatcccgtagcttgatatgagtaatggcggttggaatcagtccgattccaaccgccattactcatattcgcccagcgagcaccgtcactgatccaagatggacccgacgattcccgcaacaatggtcaggaccaaggaccccagtaccgaccaccagaaaccgtgtacgaagacgcccacgccgaacagactgaccgccagccagctggcgagtcgcatgaacagccaattgataatcaaggtgaccagcccgagagacagaatcgcaaacggcagtgcgatcagatgcacaatcggcttgattgacgcattaatcagcgccatgaacaaagcgaacgcggcgatgccgagaatcggaggctcccccaccggggtcatgccgggagtcaccgcgaccatgacggcggcggcgatagtcataatcaaccagctggtcaggaaacttctcatggcccaatcgtagcgcggcaggttttactattgggcaaaacatgagatgatgttgtgcagaaacggtaagaaggtattgccgttcccgattgagaggggactgacccgcatgactgataatcaacaacaaccgtacggttcggacagtgttccgcagccggcacagcccgcacagccggcacaaccgtcttacggccaagatgccgcacagcagccgcagggctatggcgccccacagcccgccgcatacgctcaacccgccgccggaagctacggccagcagcaaccgcaatacggccagcccgccggcgcatacgctcagcctcagtacggccagccgcagtacggccagcccgcacagcccgcagcgggctacggccagcagcccggctatggacaggcttaccagcagccgaacgcctacgcgcagccgcaatacaccgccgctccgtatgccgccgccccggtggggcaatcgtccaagtccaagctggctgccggcctgttgggcatcttcctcggcggacttggtgtgcacaacttctatctcggcaacaccggcaaggccgtggcccagctgctgctgacgcttgtcggctggattctgctcggacttggcccaatcgcagccgccatctggggctttgttgaaggcatcatcattctgtgcagcaagcccggctcaccgtggcataaagacgccaacggctacgaactatcagactgaaactaacctcgggccacgttcattgggcccctgatcaaccacgcctctgcaggtatcatctcgatgccgcagtcgcagcgggatgcgacacgccggccgtgtacatgagttcatgtacacggccgttttctttgttgctttcaccctcaaaacaaacatttatcatgttcacttttgcaagatatgaacatcagacatcacagactaccataacttcccaattgcattaccaatagattaataaccggcaaaacggcttatatccgccatttttcatgctaggctttgaaaccagcacatcaacaaagtgcacaatccttttctacagagaaggtaacatgttgttcaattcatatgtgaatcgaacaatgccagtacttccctaggtgcttgcttggggaacgccatgctgaaaggaacacattatggcggagggaaaagtcatcatcgtcaacccggatatgttcggcaaggacccggattcgaaaacaaccaaggccaatgaagtggccaagagcttcggcctgagcgacgcggcgttggccgaggtcgaggacttcaaggcacaactcaccaaacacaacgcctgggatctgccgttcatgggatacgtcaacgaggatggctacggttacgcctacgtgcccggtgccgccgtggtgtacgacccgtactgggacgcccaccaagcattcctggcgctgcctaaggacgtgcagaccacattcgccattcgtatgctgttcacgcaccgtccggtcgaccgctatggcgccagcatgttcctgcattaccagcgtggcttcaacgtgaagttcgagggtatcggcgcgaaccagtactgattggtactgactatcaaccatctttttcggattgcccgataaggggcgtataacaacggtgttatacgccccttatctgtattcagtgtcaggcgatggccgcccgccgcccgacacaggcgaatcagtatcgcacgagattcaacagttcctgctgtttggcatagcgggaaacgttggtcagggcgatgcggatgatgtgttcggaagtcttttccaaatgattgccgccggccacatgcggggtgatcaggcaatgcggctcatcccacaacggactttccgccggcaacggctcaggctcggtgacgtccaatccggcaccgtggagccgtccattgtgcaaggcgtcagccaaggcctcgggatcgatggcgtcgccacgcccggcattaatcacgatggctgtggatttcagacgacccagacgatccgcattcagcagatgatgggtctgcggcgagcgcggcaccgccatcgccaccacgtctgccaatggcaacagcgtctccagccgctcgaagccatacatcttttcaatgcccttggccggcacgtccgcatgacggcgcacgccgaaagtacgcatacctacggattgggcaagctgagcgaaatgcgacccgatgtcaccgacgccgataatcagcgcgatgccaccttccgggctcaataccggtccttcatcctgccactgatgatcacgctgattggaggcataccggctgaggttcttcatcaatgcccacatggtggcgaacatgtgttccgacacgctttggccatacgcgccgctcgcattggtgaccatggtgccgcgaggcagcacacccgggcagatgtacgcatccacaccggcgctgaaggtctgcaaccattcaagacgggtgtattgggaagcctgcgagaccggaaagttgccgatgactgcggtagctcgggagcgaagctcctcgggaacagcggccgaccagaccatgtcgccgcggtgcgcttcgtcgcccacgaattcctgcggcacatcgcgagccgccttggcgaaagcccgccgttctccttcgttgagtggcaggcagttgacaatcagcttatgcgtgttctcaatacccatggttcaccaaactaggcggcagggcagatattatcgcggtttcctcatgctgaaccaatgccgaactgctaccggaccaatgccgaatccgccccatcaaaccccaccaaaccaagggacaacccattgcgcatcgaccgtagcgtccgccccgaaccgtacactcacaggtggttttgtgattccatagcgtgcagccaaggcagtacgattgccggtttatccgcacgcacaggtacctacgccggttggtaaaccttacattccataccttgcaaccgaacgtttaggagcatgtatgcctgagcagcatattgataacgagaagattcccacacgtcttatcggcgcgattgtggctgtcggctcacttgccttcattggcattctgaccgaaaccgtgatgaccgtgcttttccccgcactgatgcgcgaattccatgtcgacacggccactgtgcaatggattaccacgatttatctgttggcggtggccgctaccatgcccatcagctcgtttttgaagcgccgattcgcgctgaaaaccatttttcttgcggctgtgattctggccatcgttggctcgctgatcatgatcgtcgcccaagccttcccgctgctgattgtcgcccgcattattcagggcattggctcaggcgtggccacgccgttgatgatcaacatcatcctggagcagtctcctcgttcgaaaatcggccgattgatgggcgtaggatcgctggtcattaccgtggctccggccatcggcccgaccgtcggcggcgcggtgaccacagtgctgccgtggcgcgcgattttcgtcatcgccattccgctggtgctaatcgcagcatgcatcggcatgaagtgcattgagcagaagacaccgaccgaggctgcctatcttgacccgattcagcttgggtccattgttgtcgcgttggtcggtctggtgctggcgctcaaccaaggtggcgtggccatcagtgcggcggtgtccggcaagtcagccacacgctccggcattatcgccattgtcagtctgattgcgggcctcgccttgttgatcgtgttcgccatgagttccaagcgtgccttctccccgctgctgcgccttggcattctcaaggatcccgccgtactgttacacgcctgcgcatatctgctgctgccattggtcgccatcggctacggctatgtcatcaccaatgtggcacagctctcgctcggtaccacggcatttgtggccggctctctggtactgcccggagcactggtcggcgctgtctgtgccccgcttggcggctggttctacgataagttcggcgcggtcaagccgattctgattccgatcggcatcgctattttgggcccagtgcttatgctggtgttctcgatgcagcttacgcccttgctgctcgccggattctatttcattttcggtctgttctattccatcggcaatgcgaatgtgatgaccagtggcctgtcggaggtctctcccgagttcaagccggacggcaacgccattttcaacacgtgtcttcagtttggcggcgctgccggtaccgcactgttctccacgattctttccgtggctcaggccggcgcaggagaagaaggcaccgctgagtttgctcacgccactgccgtcggcggcacatggacgtttgccacgatgacggttatctgcctgattggctggtgctgtctggccaccgcgttccgcattcgcgcggcacgtaagcgtgcataaatccgatcatcaatagagtcccagctttccaaacacgtgtggggcgtgccccgggagaaccccggggcacgccccacacgctaatgaaaggaagaaaaggagaaagaaagctttggcgggcagtgccggctgctgtgaccttgccatcacagcagccgggctgatcccgcctattcagttatggtgtgtgtcgtattcggtgcggagaccgagcgggcaagcccgctattttttatctccgccgaccgccatcaccgcgcgctgaagcacaacgaagacgaggatcatgagaccgataacgatggtggtccattcggccggcacaccgaagtcagaggtgagcggatcgaggatggagcggaccagagagccgagcacggagccgagcacgtagccgaagccaccggtgatgatcgtaccgccgatgaccacggaggcaacggcgtcgagctcccagccaacacccacagtgttcttggcagagccgatgtttgcggtgtacacgatcgaggccagggcggcgagagtcgcagaggtcaagtagatgatgtactgcgtgcgcttgaccggcagacccatgagttccgcggaggaacgggagccgccgatggcgtagatggtgcgtccggtgcgggtatggtgcaggaagacgtagccgaagaccacaaccaccagtgcgatgatcacgccgacgttgaaggacagatcgttggagatcttcggattgtcgatgatcttgatcacgttggagatgaacgagaagtcattgccctgcgggaaggtcagcgagtcggtggagatgatggaggcaagaccacgggccaggaacatcgtcgacagggtcgcgatgaacggctgcatgttgaattcctcgatcaaggtgccggccagcaggccgaacacagcgccgatgagcagcatgatgatcatgaccaggaaggcgggcacgccggcgttcgccagcttcaggccgacgactgcggtgatggccacgatagcaccgacagacaaatcgataccaccggtcagaatcggcagggtcatggccacagccagaataatcaggtaggcgtggtcaatgaacagggaggagatgaagcccagtcgaatgtaggtgccgaacaacgcctgacccatgatgatcatcaggatgaagatcaccacggccgcgagggtcgggatcatctgacgatcgagcttgaagcccttcttgggagccttcactttgtttgccgtagctgttgtcatgctgccaccgccttagcttgagccttgagcgcgcgcttgcgtttcatattcgcgctcaggttgtgaatcttcggagcctgcatcacgcagatcacaatcacaacgacggcgaagaaggccggagttgcctcggcgttgacgcccagggtgatgatggtcttgcggatcatggcgataattacagcaccgacagcagagccggcgagggagaacttaccacccagcagtgaagtaccgccgatgacgactgccagaatggcgtacatttcgaggtcctgaccggtcttaaccacgtcgacacgcatcacggatgcggtggcgaacagaccagcgatggccgcgaggaagccggaaatcgcgtagacgaggaagaggatcttcttcggcttgataccggtcatacgggaggcttcctggttgatgcccacggcctcaatcatcatgcccatagcggtcttgcggcacagcaggccaacgagaatcacaatgataacggcgatgacgaagttggcgggaatgcccagaatgaagccgttggcgaaccacttcagcggttcgttgccagcaactgcggaggcgtcggtgttctcaccggaggtgatgaccttggccataccacggccggcgagcatcataatcagggtggtgatgaacggctgtaggcccaggaaggaaaccagagcgccgttgacgcagccaatggccagaccaacagccaaggcgatgaggatggagagccacacgttcatgccattggacagggtctgcatggcggcggcacctgccactgccataacggaaccgaccgaaaggtcgataccggcggtggagataaccaaggtcataccggttgcaatcatcaggtatcgggcagattcctggagcatggtgatcagcgggccggccagaccaccggtgttgctgttccagctcaaagccaggaagtcatgctggaagatggtgcagatgatgaccagaagaatgaatgcgacgatcgaccaggtcaggttgctgctcagcagcttcttgacaaagttgttgccctcggcttttgccttttcagccatctcatgcctcctttccggtgtttacgttggtgttagcgatggtttcgacgatggtcgcctgagagacggtgtcgtcgttttcgatttctgcgatcttgtggcggtccttgagaacctcgatgtcgtcggacagacgcacgacctcttcaagctcggaggagatgaagacaacgcccatgccctgagaagccaggtcaagcacgacctgctgaatttcagccttggcaccgatatcgataccacgggtcggctcgtccagaatcagcagctcggggtgcgtggccagccaacggccaatgagcaccttctgctggttgccgccggagagattcttgaccgggcgatccgggtcggcgggacgaacgttgagttccttcatgtacttgtcaacgatggcgtccgcttccttcttgggaatcggcttgaacataccgcgcgttgcctgcagggcgataaggatgttctggcggacggtcaggtcgccgatgatgccctcatcacgacggttttcggtggagtacgcgattttgttcttcaaagccgtgtacggatcggagatgttgaccttcttgccgttgagcgtgtaggtacccgaatccggcttgtcggcaccatacaggagtcgaccaagctcggtacgaccggagcccagcaggccagcgaagccaacgacctcacccttgtagatgtcaacatcaaccgggttgatggtgcccttcttgccgaggcccttgacatcgacgatcggcttctcgccaggggtgatttcacggcgagccttcttggcaccaatctgggacagctcggcggcggacttaccaatcatcatgccgatgagttcgtcgcgcggggtgtccttggtcatgacctccttgatgaactggccgttacgcagaatggtcagacgatcggtaatctcataaatctgatcgaggaagtgggagacgaagaggatggccacgcccgagtcacgcaccttgcgcatgatcgcgaacaggtccctgacctcgttggcatccagcgaagaggtcggctcatcgagaatcagcaccttggcgttgataaccatagcgcgggcgatggcgaccagctgctgcatagcgatggagatggagctcagcggagtgtgcgggtcaatggattcgaggcccatctgtgccaaatacttcttggcggcctcgtgggtcttcttccagtcgatgccgaaggggccgcgcttttcgtggcccagcatcacgttctcaccgacggaaaggttggtgcacaggttcacttcctgatacacggtggcgataccggcgttttgtgcgtcgagggtgccgttgaactgctgaggcttgccgtccaccataatggagccggcgttgatcttgtacacaccggtcagagccttaatcatggtggacttgcctgcaccgttctcacccatcagggcgtgaacttcacccgggtagagagtcaaatcaacaccatccaaggccttgacgcccgggaattcaatcgtaatgcctttcattacgacgatggggtttttatctgtcatgtctttgccttaaacgagaatgagatgttatcgttttgtgatatttgagccacacatgagtgatggcgtggaaggaacatccttctcacaccatcacatcaattatttggtccagttatcaatgagtcgcagcagacttatcagtaggcgcgggtgttgttgtccagggcttccttggcggaggcggcctcgaaggtcttggactcgatctcgatgtccttctcaacggtcttgccatccagatagtccttgacggcctgagcggtttccttaccgaagatcgggttgtactcgatcacgtaggagaggtcgccatcaacaagagcctgcagagcgttcttggtaccgtcgatggtgatgatcttgaccttgcccttgaggccggcggcgtcaacagcctgagcggcaccgaggcccatctcgtcgttctgagcgaagatgaactgcgggttgtcggacttgtacttgtcgagcagaccagcggtcacggtcttggcctcatcagtggaccagttagcggactgggactcaagaaccttgacgttggaggcaaccttgttgtcccaaccagtgccacgatccttcaccacggacaggccggcagggccttcgaggatgaagccgttggcgccatccgggaagttcttgttcacgaactcggcagcctgctcgccgcaccagacgttggacggtccgatgtgagcaacgatggccttcttggcctcggcgtccttgacgtccacgttacggtcaacggtgaagaccggaatctcagcctcagcggccttcttcagggagtcatcccaaccggaatcctcggtggaggacaggatgatggcgtcgacttcgtcgttaacgaacttgttgaacgcctgaatctgcttctgctgatcgttgttctgggtcggagagtaggtcaggtcaaagccggcatcctcgaatgccttctgaatgtccttctcgttggcggtacggaagccgccctcaggaccgacagccacgaagccaaccgtcttcttgccggagtccgagctgccacctgcgttgctggaaccgcatgcggcaacgctgacaagcgcagcagcagaagcaacgagggcaatggccttcttccaattcttcataaatactcctcctcgagcagtgtttattttttggatgatctttcatcctgtttggtgactgttcgtcatcgacagcctctagtatgacgctcacaggccaaatgttcaatcgcatgcgataacagtttgataacaggtttataacaaattaataacagtggttcaaaaatggcgtcgcaacactgttttgccttgataacagaccaataatagtgattggttgcgcagcggcaatgccgctcgccagccgagcgacaaagccgttgcctcatacaacaagaaaggttattatgaacaccgtttttcttataccatctactgcgcaccgagggcagtgacctggctatcggcgatggtccaggaaccgtcgagtgagccagaaacggagcgaacaatacccaaatcgtccacaatggccaggcgacgggacaggctaatctgccccgatgccatcgacgttatggttccattaggcagacgctgcgcattggccgggcctggtgccatttgacgccatgcctcttgttgttcgctgtttccctcaggaggtgtggtggcgtacaccagattcagatcgttgtagaacgtgagcatggtgacgtgtctgagcacactcacttgggtggccgctttgctcagaccgctcagtgttttatcaccgttgcgcgccacaccggtcatcatcacgccgttcgtgtcctcgccctcgactgccaacgccaatcggcacccttccggagaaaccgccaatgccacaatgctgtcggcagcgccaagccaatcaagcttcagatcggtttccttacccccatctgacacatgcaattcgcgcccgttctcggatacagcccatacttcgccatccagaccttcggtaatcgatcgcatcgactcgccggagaacatcaccccacaggacgcaccatcagatttcaggcattcgacgacaccgtccgcacgcaacaccgcaccgccggatgaggaaaaaacgaagccccgagcatcgtcatatccgggggcctcccctacacgcaacggactggagctggccagggaaacgatatgcccaccggtcaacgtgtatacgcccgctgtcggctgctcggtagtaagtttcacatttgcgtcggcatcagaatagtccactccgtcgccggtaatcttcagcgcgtattcggcattgccgtcgcccatagtcagacggatgcgatgtaccagcaggcctcgttcttcctcattcaacgcattgataccgctgttaaggtgtatctccaccacattgttcttcaccggcacgctgtcgaccgcgagtttgatggtaggcaagccggtgcctcgcagcactccttccaaccaggagggtgcatccgagagtacttcaccgactgcctgggtgcgccagttgcgccagctcagccatcgaacatccggtatgagctgtttgccggatgtgctcacctgatacacggatacttggcggaagacttgttcaaaatcggcggtggatatcaccacgccgttctccaacgaggagatgcgccactggccgcttcttttaatcaagatataaggaactttgctgatcgtgctgctatctgtcggcgtatacacgccatgcgagtccagagagccgaccacttggagctgtacttctacaatcagcgagctctccgccccttgcggggtactcatcgtattggcacggcggcggaaatccggcgtaccgctgtagaccagtgccgaggaatcgccattccatccggccgacgccgaaccggtcagaaactcacgggccacacggtagccatcggactgtacgccggcaggcatggcatcatagaaccctttgacgatggtttccggctgcgcatcgtccgcaggtccctgaggattggtgtaaacacgctgagtctgctgttccaccggtgccagagtctgcaccgagccgctaatcggcaaaccgaacggacttgagcatgccgtcatcgtgacgcaacagactatggccgcgcctgcggcggcaatcgttctggtcactcgtctcatagcggcctccccatcatcgtgtcgcggcgaacctcatgataatcatgtgtgacttggctggtggccacaccaaacccaccggtaatacgcaggtcatcgggcgtttcagaagcaaaattcaccggcagttcagcgtccgccacctcaccttggtcggggtcacgcggcagcaataccaagaaccaggtgccctcccccactgccgaacgtacacggatagtaccgtggtgcagcaaggcatcagtcatggcgatggccaagcccaatccggtgccgccggtaacgcgcgaacgtgaagggtcgcttctccagaatcgatcgaatacatgagcgactttgtcttcgtcgataccaacgccatagtcgcgaacgctgatggccacggctttgcggttggccgcgacacgcacttcgatcggccggtcctcagcgaaatcgacggcattggccaacagatttctgacgatgcgaatcactcgacgcgaatcgatacgagtcaaaacctgcacattgggcagatacgtgtgaatcggcacccgtttggcttgggcgatgccggcaacttggtccactgccgtttcaattggttcgcataaatcggtttccacaaggtcaagtgccgcataaccggcatcgtagcgggagatttccaacagatcggcgagcatgtcttggaatcgactgatctggccggccaacagttcgaccgtacgcttggtggaggggtcgaagccgtcttttttcatttcgagcaggtcggaagccatacgcatggtggtcaccggggtgcgcaattcatgactgacgtcggacacaaatcgtttctggaaaacgcttgcttcctccagctcatcaatcttctggttgagcgcatcagccatcgtattgaaggattgctgcagcacaccaagctcatccttacgattcacggtaacgcgcatatcgagattgccggaggccagtgtttccgaggccgctgccactcgttcaatcgggcgcacgatgccacgaatcaccagccagattactacgcccaccacgatggacagcaacgcacagatgaccaccagactgagctgaatctgcgtcaaggactgctgctggaacgtgtacgaataaatggcgaagaattcgaggttgccggccacgccaaagtccaatacggtgccgagcaccgctgcgggcgtcccgctgcccgacatgccggaatcaccgggaatttcgaccggctgatagaacacgctgtcatccaagtcggaggccacggacgaacggatgtcatcagaaatcagactttgatagctgggttcggtggatacggggatgatggcacgcgagttggtatcacgactccacaaatacacacctatcaggttggagggcccctcggattgcaacgaggacgccaagtcattgaccagctgctggatctgcactgtggcggagacatcggccgcgtccagactggtttgggcctgctgcaccatgtttgaatagtcggcacgcgactgcgaagtgatttgggtaagcagcgaggcgcgcactgataccatcgatacgccagagaagacgatggccacggccagtgtaagaatcacggtgagggccacggtgcgggcctgcagcgagcgacgaacttcagcgcgtccgtggcgcagcaagcgtttgaggctgaatcgagggcgcaggttcattgttcaggagtgacgaacttgtagccgatgccacgtacggtctgcacgatttgcgggttctcggggtcgtcctccactttggccctaaggcgttgaacatgcacattgaccaggcgcgtatcgccggaattctcgtatccccagacattcttgagcaggctggaacgactgatggcctcgccggcggcggccgcaagcatgaacagcagctcgaattccatcggagtaagattcaggtccttgccatccttggtggcggtgtgttccaaacggtcgatgacgatggatccgcgttccagatggttgacgtttgcattgccaccgcttgcgccaccggtggcaccgtcttcggcggccggcttggcgatgcggaagcgtgcatggatacgcgccagcaattcggccactttgaagggcttgggcacgtagtcgtcggccccggcttccaagccggccacgacgtcaagtgtgtctgatttggcggtgagcatgataatcggcacattagaggtagctctgatgcggcgggccacccccgtgccgtccagcccggggagcataacgtcaagcagaatcaaatcgggcttgacgatggggaacatttccacagccctcagcccgtccaggcaggtcacggtctggaatccctcgttttccaaaacaagactaagcatttcgccgatggcctgatcgtcgtccacgatgaagatggtcgccatggtgtttgtcttccctttcccactgttattgttgcgttacactttactcccctatgttcatttctgttcgggttccccgccatgcaacatcgggcgaatcttggcaagacgctggctgacttcgtgttcgtagccgcgatcgttgggatggtagtactcggtgccacgcagctcttcgggcatatattcctgtggcgccacggcaccgggccaatcgtgcgcatacttgtagccctcgtggttgccccactctttcataagcttggtgggggcgttcctcaaatacagcggaacagcgccgatcttgccggcatccacgtccgcgagcgcctggttaatggcgttatagctggcgtttgatttgggcgcggtggccacggcaatcgtggcctcggccaaaataatacgtgcctcgggcatgccgaccagcgccacggcctgcgccgcggccacggtgacctgcaaaatctgcggggcggccatgccgacttcctcgctggcggcgatcatgatgcgacgggcgatgaagcgcggatcttcacccgctttcagcatgcgtgccagataatggatggcggcatccggatcggagccccgcatggatttgatgaatgcggaaatcacgtcgtaatggtcatcgccgtctttgtcgtagcgcacggtggcggtgtccattaccgtagccacgatttcgggggtgatgatgggtcggcgtgcgccctttttgcgggcttcgtcgccagtgaccgcgccagccgcggcctccagaatcgtgagactcttgcgtgcgtcaccaccggccatgcgcacgatgtcggcgatggcttcgtccgtggctttgacctcgcccctgagaccgcggtcatcagtcagcgcgcgctgcaccagttcgatgagctgatcaggctccaatgactcaagcttgacgaccaccgaacgggagagcaacggtttgatgatggaaaagctcgggttctcggtggtggcgccgataaaggtcacgtcgcggttttcgacggcgggaagcagcgcatcctgctgggatttggagaagcgatgtacctcgtcgatgaacagtacggtttcctggccgcgtgacacgagccgttcgtgagcgcgggtgagtacgtcgcgcacgtctttgacgccggatgtcacggcggagagttcctcaaacacgcggccggattggccggccacgatggtggcgagcgtggttttgccgacgcctggagggccgaacaggattacggagctcggcgcggtgagactgcctttgctggccggattggcgaggcggcgcagcggcgagccctggcccaacacctgcgtttggccaatcacctcgtccaaagtgcgtggacgcatgcgcaccgccaacggccgcgtcatcgactccggcgcatcagccgccccaaacaaatcgttctcactcataacgtcctatagtaccccagtgttcgaacagacgttcgagctgcaccctggcttccctcagagaggggagccaagaaaggaatcagttactcaccttgtagtcgcggaagactacttcgccggtgtcttgggtggcgtcgaggtccacgatgccttcgatggcccaatcgtgatcgccatcggaatcatcgataatctgacgcaccttccacgtatgctcgtcgttctcgtgcttgtcatccaacatgaacagttcgggcgagcgtgcttcggcgccgatgcccacgtactcgtgctcgtcgtagtagtcgtcgagcacatcttcccattcgtgcacgccgtagccccagtccttgtcgagcgcgccgagcttgtccggctggtcaaggtccataagccgcacacggcggaacaaggcattgcgcaccagcacggtaagaccacgacggtcctcgaccaccgcgctttttgcgccgggcgcggccagggatgccgcagcctcggattggtcagccgagtcaccggcgttctcccattcgtccaccagcgaggagtcgatggagcgcacgagcacgcgcagccacgagatgatgtcttcgagttgctcgtcacgcttttcgggcggcacggtgcgcgccagcgtgcggtaggcgtccgagaggtagcgcaacagggtgccttcggagcgggcgatgttgtatcgggtgatgtatccggtgaagtcggaggcggtttccaccatgtcgcgcaccacggatttcggcgacagccagtagtcgttggcccacggcacatcgtggcggtactgatcgaacgcggcttcgagcatgtcttccagtggcttcggatacgtaatctcctgcagcttatccatacgctcgtcatagtcgagtccgtcggccttcatatcggccatcgccttgtctcgggcctgacgctcctgggcacgcagcacctgcttggggtcttcgagcgtggcctcggccatggagatcacgtccagcgcataggtgtcggactcggggtcgagcagttcgagcgcggccagcaggaacggggagagcggctggtcgagggcgaagtcgtccggcatatcaagggtcatgtagtagtccttgccgccgtccttgcggtcctcggtttcgatgacttcggtatcgaacagggtttggaagatctcgtcggcccgctggtgcagatgctccttctggtcgggggtctgcgcggaatcgtcgatgagatcgtcgatacgggcacgggcgtcaccgccctgcgccacttcattgagcaccatcgaatgcgtgattttcaggtgcgggaccagggtttccggttcggcgtcgatgagcttatcaaacgtgctctggttccaggtcacaaaaccttccggcgccttcttgcgcttgaccttcttgagtttcttcggatctcccccggccttggcgatggctttctggttttcgatttcatattcgggagcctcggcgatcaccagtccctcggtatcgaatcccatacggccagctcgtccggcaatctggtggaattcgcgggcgcgcaggcggcgcatcttggtgccgtcgaacttggtcagggccgtgagcaccacggagtgaatcggcacattgatgccgacgcccaatgtatcggtgccgcaaatcaccggcagcagaccctgctgggcgagctgttcgaccaggcggcggtagcgaggcagcatgccggcatgatggatgccgacaccggtgcgcagcagtcgctgcagaatcttgccgaaggctgtggtgaacttgacgcctttgatggcttctgcgatggcttggcgctgttccttgctggatacaccggtggaggcgagcgcttgcgcggtctccaatgcggcgtcctgcgaaaagtggaccacgtaaatcggggtttcgccgttgcggaaggcgagttccacggttttttccatcgggtcgagcgtgtattcgtagctcaacggcaccggtcgcggcgcgtcggcgattacatccacgtccggggtgtcgttcagatcggagagcttgtcggcgatggcgtccacattgccgagtgtggcgctcatcagcaggaactgggtctgcggcagcgtgagcagtggcacctgccacgcccagccgcgctccggatcaccgtaataatggaattcgtccatcgccacgaggcccacatcggcatgggtgccttcgcgcaaagcctgattggcgaggatttcggcggtgcagcagatgatcggcgcgtccgcgttgatgtggctgtcgccggtgatcatgccgacgttgtcgcggccgaacacttcgaccaagtcgaagaatttctccgacaccagcgccttgatcggagcggtgtaataggagcggcggccagtgcacagggcggcgaagtgcatgccaagcgccaccagcgatttgcccgaaccggtcggggtattcaaaatcacatggtcgccggccaagaggtccataatggcctcttcctgatgcggccatggttcgatgcctttgatgtcttccacccagccgaagaatcgttcgtagatgtcatcggccgtaagattccgttcacgctcgtcaccgtcccattcgggggccagccgccccagggatccgtattccttctcgtcagtcataatgctcagtctacctagtggcctattccgacggcacgagccgccctccgtcgctatgcgacgcctcccgccagcgggcggagccatgcgaagagctgtgccatgcgcttggctccgccaatgggaggatcgctcacgccaaccggcggcgcacctcgtcggggtccacctcgggttcgaggggaggccaggtcatgttcatgttcttcaaggtggtgcgcagcagttcggagaccacggctcgcgaataccagcggttatcggccggaacgaggtaccacggtgcggcggccgtgctggttttctcgaacacttcctgccaagcgaacatgtactcatcccatcggtcgcgggcctcgaggtcggagatatcgaatttccagaacttggtgggatcatccagcctcccaagaaagtgttttttctgttcttcctggcttaccacgaggaagatcttgaggatggcgcatccgctggcggccagttcacgttcgaaatcgttgatctggtcgtagcgggcacgccatacgtcttcgggataggtgccatagacgtgcggcatgaccacatcttcataatgggagcggtcgaatacggcaatccaccccggcttgggcaattcacgcttcacacgccagaggaagtcgtggtcgagatcctcggccgtaggcttgccgaagccatggtaatggatgcccatcgggtcgccttggctgaacacgtgacgcacaatgccgcccttgccggaggcatccatgccttgcagcacgatgagcagccgccgtgtcgagcctttgacgccattcgcgtacatgagccgctggtatcgggcgatttcggaggagctgatcgaaatgaacttctcggcgtcctctttattgccgtcgaatccgggagtggaatcgccttcgacatcagtgacctgcatgccgtggtggaacataagacgttgagcgggcggcaacgaccatacggcgctgagcagttcactggatttcgccgcacgcgccagtcgttcaggcacgctggcactggagtcgatggtgtctatgcgatccaccgcgagctgtaataccttgtcgatccgtcgatcggttttggattcctttcccttgccgttcttgttgttctttcctgaggattttccggccgtaccccacttgccggcctcttcaggctcgttggttctgtcgtcgtccttggccatgctcccgattgtacgtcttgtaactcaggagacctagcaacgtagcgacattcacatttcgcctgttactgcaaatctataggcatgcagtcgttcggaccgtaattgttggctttgcaccaattccaagcctcatctgtcgagtcgaagccctcaccggcaagaatcacatagtatttgtcggaattgctgctgtaggcgggccagtcacccgaccagataagcagtacgtttgaattcttgttgtgcatcgtgatgaattgcgcaagaatatcgcggtagttccaggtcttgccttcagcctccatacccttacgcttgctggacagctgtgcggtatacgtggaatagacccgaaaaatcgaacacggcatcggccacgacattatcgtcgctgtcctgcaacgtgagtcgggtggccgaatcattgaatttcgtggatgcgttcttatcatcacaattcgaagtggccagaatcgtgactatcagattatcgctctcgctcttgatcgaggagactgtcatatcgggagcggcatcgcaggttttggcaggcttggccttgtctttcgacttcgatgcgctgccttggttaccggattgtttggttgcggtgccggaacttgtggtgttgggagacgatgcgccgccatcaaaccaatgcacggtaccggttgccaccaaagcaacaagcacacccactaccacaaccagtgcgatgacgacccccagcaatatcttctttccggcagacccaccggaacgcggctgcgcagcgccaccgttgcctggcgccgtcgacaatgtcgaagtaggtgcattcgccgtgttgaaacttgggggcaacggcatcgaacccgctggcacctgctggggagcagccggtaccagcgtcgggccatccatcgactgaggacttgggcttggcgcagactgtgccatcggcgcaccgcattccgtgcagaatcggcttccctccggcatctccgttccgcaaacctggcacttcatactctctccgttctctctcgtccctatcggccaatcccccgcccgttttgcagtacataaagaagcggcaaacggcccgaaacatacctgagccatcaggaagacggcacgatctactacgagaaagatatcatcaccgaccagcaaatcgtcggcatcatgctgaagcatccgaccagcgcacgcggcttcaagcgctacttgcgcgccgcatcatgacgcttgaccacgatggtgacgccacccgcagcgaacagcgtcgccagaaccacaaccaacgcaaccgaggcaccggtattggccgtatgttcggtctgctgtggcttggtgctgccattggcattgacgctaccgctatggttgccgttatccttgtcgtccgtcccggtggacactccggtaacggcaacgggcagagcgaccgtggtcttattggtcgcaccggttacggtcaggctgatatcaccggtcttggttccggcgggaatcgtgaccttgagctcggcggtatcgccattcgcaacctgcgcttcgccgaccacctgctcgccgatggtggcggtcagcttcgtctcgtcaggcacgcccagcgaggtgagcgtgagcttcgagaagtgcagggtgaacgagccaccggccttgaccgcaccggtcgggataccggtgacggccactgcacggcggtcgtagcgcggggcaaccggattgttgtccttgagatagtcgatccaggcgtcgcggtccaccagaccggtgtccttggtgttcgtgccttgggcgaaggcgcggaagttatcgccgccctccaacaggaagctgaacgaaccgatacggtagttgcgtttcaggtccagaggctcaccgttgacggtcaccgaggtgatgtgatggccttgcgcggcatccggatcatacgtgtagctcacgttgtgggacagtccgagttgcagatacgcgcgcgatggcgtgctgccgtccgcgttcgtctgccactgctgttccagcgcttccttgaactgcgcgccggtaagcgtggtggtccacaggttgttcaggaacggcagtacagcgttggcctgggcgtaggtgatattgccgtcggcatcgagcgtgcaggcgtcattggtgccggacttgcagaattcggcacgcagaccgccggggttgaccacaccgatttcggccgcgccgcggtcctcgcctttgagcgaatcgagcagcgcatcggccaccagattgcccatggtcgattcggaggcgcggtcgtcacgcttgccatccttgaatgcggtggtgctatccgcagacaccttgccgaccttctcgccgcccttttcatcggccatcttaagagcctggtacacgatgtccctcaccttggcgacagtcggattcgcggcggcgagcaggccatcgttgtattcggcgtaatcgttgtagtgcggatcatttttgtcggcgggctgcgaagccacctgcacggccgtgttaccggacttgtcgtaagacaccgcaccggtggccgtgttgtaggtgagcaccacttggccgatgttggcggcatagctaccggtctggatgatcggccggttgttgtgcgcgggatcggtgtacgagtacttcatgtgggtgtgtgcagtgaagatcacgttcactgccgcatcggtatcgtccacgatcttcttgaacacggggctggcggccttctgctcgtcaagtgtgggcttggcggtggcgtcatcttcattggaggctgcaccctcatggtattcggccacaatcacgtcagcctcgccattggattcgtcgccgtcggtgagctgcttggccacacggttcacggcctccaccggatcgccgaattcgatgtccttgacaccaccgggagccaccaatgtgccggttttctgagtgaccgcaccgatgatgccgaccttcacgccgttcacttcctgaatgctgtactcgggcagagccggggttgtggtgcccttcttgtacacgttggcaccgaggtaatcccattgggcgttgcgcgcgccctccttgccaatcacacgatcggtaaggtcggcatagccttgatcgaactcgtggttgcccaccgccgaagccttgacgcccaaagcgttaagcacatcgatggtcggctggtcctgctgtaccgaagagttgaacagcgaagcaccgatattgtcgccggcggacagcagcagtgatgagtcagggtattcgcccttgagctgctcgatggtggcggcgaacggcacggtgaggttcttgtcgatacggccgtggaagtcgttgaagttcagcagattgatggtggtgctggcgggaaccggctgattggttgccatatagcccatacgcaatgaatggccattggtcacgccgtcgtctgcccagcacaccggcttgtacaccttgccatccaccaccttggtggcttcggcatcgggggtgatggcaaagccttcggtgttctgcgtacggatttcatccggagtgtcggtcagcttggtcagctgcagcacgccgttcttgaactcgtaggtaccgattttggcaccggtgttcgcatcattgtcgctttgggcgagcagctggttgtgctcggcgtcccaagtcagatcgcgcggaccatcatagccggcgttcactgcggactgcggcaggtcgatgtcggccaccggatgcaccaggtcctcatcattcacggtttgcagtgcgaaggcgtagatatggccggttttctccagtgcggcgaagaacagaccgccgaaatcattgccgaaaccgtccgggtcgtaggtcattacgttcttcgggtcaaggttggactggaatccgttggcggtcaggaccgagtcgggaataaaggctatgccttccaccccaagattggcgtccgctccgtggcccagcgtcacgccgaactgcgtgagtgctgcgatgagattccactcgtgcgtagcgttcagatcgtgcgctccgtcgccgttggcgtcggtggttttctcggtcacgtcatactgcaggatggaaggccgcggcacattcttgttttcgttgtcgcgctcggcgccgatgaatatgcccttggatgaatctccgttgatcagcgtgatgccttcggagtccacaccgcccttgccgtccttgaagtgcagctgcttgccgcccttggtctgaccgttgttggtgaaggtccagccatcagtgggatcctgctgccatgtgccgttctggtagacgaacttgttgatggagccagggcccttatcagcggtgttgccgagcgtggggttcagatcgttgtcggccgcccacagcacgccttgcttgccgtctttaccggcttcatacaccagaccagacagattgccgtcagtgtggtcgccgccttgtcctttggcgccaaattcgccttcggcatccactgtggtcacatcggccaatcccgaccatgcgtccacggtcatggtctcgccggcgggcggagtcggagtcgggtcatcgaacacgttctgtgcaccgggcgtgggcgtatcggaaagcgcgaaagtgccatcgtccttacgggaccacgactgactgtcgctcatcttcttcacgccggttgtatcggtattccatgacgtggaatccaccacatcgctatcggtaaagtcgccgctggtagtggtcagataggcttcgtcggcatcggaacccaggccgggctcggccttgtcggggtcgatgtatgccaccagatatccgccggctttgatgacggtgtccgtattcgttacttcgctggtgccgatggtgtagtgcttcttggctttcttgccgctgtcgtagatgccccagcccttcacgtcaacgtctgtggagccggtgttcttgagctcgacccaatcgcaacgcttgctatccgggtctccggcagctttcgtattgccggcatagacctcgttgatgattacggatggtttggcagccgtgttctgttcggcagtggcctgctgctcgtccgcagccgcagcgggcacgccgatcagggcgatgctgctcagtgtcaccgcagcggtgagcagcgcgatggcgcgccgcgacatcgcggtgaaattgttggtgtggaacattactcccgttccttcctcgggttgtgccgccgcagcatgatgctcttcggcggatgacaccccgagggtatgagagagaaatgaagccgacaccgtatgaaggcaaactcggcagatctccaaactgaactttggctgaattactgctgaagctagttcttggatttgcgtcgaaccgtccgtattccgccgacaatcgcgattacagcggtaccgatagctacgctgatcaacgccggtcgttgcgcggcatggagggtggcgagatccggtccggccgcaatggcactgttttcacccgccgagctatccgacgccgggtgattgcccgcgtcggtgtactgggcattgaccacactcgggccggtaagcgccacttggtcggcggtctcgaccttggccacatcgccgtgcttatccaaggtgacgcgggcgcacagggctttggcccagttgatacgctgccagccgtcgctcgattgccatagggggtatccggaatccaaggcagtggctttcaaaatcgcgttgcgctgatcggcgtgcagttcgggataggccagtcgcagcacgtccgccgccccgcgcggtgccacgaaatcagcgccggactgggcggtgtcttgcgggaaggtgtaggtcaggcgtgcggtgtagacgcgcacggccgaggcctggtccgcgaccggctcggtggccaccgggtccagaaaatcgttggtgtagccgcccgaaccggaggccttggtgttggcgatgcaggcggcgagggtagtgccgtggccgtccgcggcgcagcgggacaccagatagtcccgcagctgccgggacgcgggcacgatggacgaagcgaattcgttatgccagtactgcccgttctgggcggatgcgccaatgcgcccgcccatgatgtcaagcggataatgcacgccgagcacgatgcggttgttgccggcctccgaagtgcgggccatgatttgcggcgcgagttcgggaatcatgccggccagcgcgataccccacgaataggcgccggtagtgtggccggaggggtaggaactgtttttctgcaagttcgagtagccgggcacgtgttcgagccatgagggtgattgcttgatgtcaagcgtggcgggcagtccggcgagatcgttagtgccgccgtagctgctttccgcacggttcagataggggcgcggatgcatggccgcacgttttgaggcgtaggtggaggccacgttaaaggagaagatatcggcgacggcgttgagtttcccggatttgagcccttcgctcatatatttgccaagcaccggaccgagcgcgtccggcatggcttcctcggcttgcagatcggagtcgacgagcgcacgcttgcgttgggcgttcaggccatccttatcgagattttcggcggctttgtggttaattgccacggccaaatcttcgtcgagtttcattgtatcggcgtcgagcaccttgccaccgtgttcggcatcggtgggggcctgccaatagttcttttcgtagtcggagagcaatgccacccaatccgggttgggcagctggtcggcctgtgcgattgcaggcgtcacggctagcgtggccgccaacgccagcggcgcaatggtcgcaatagcaaaaacggaggataggtgccggaacatcttcatatgttccaacctatcctccgtgaaggctacgtagccggagcccagtcaaacactcagtaaattcttcgtgccggcttagcggcgattgagctgactgtcaggcctctggcttgtcctcaggcttttgagactcctggaattcgccggtttccgggtcaacctgtgactcgggctgggtggcgtcatatccctgttcgtagcgggtgcgccgccagttgcgaatcgaggcgttggtgccacggtgatgcacatggtatttgcgcggcgtaccgcccagcggcagctcttcgacctccttggccacagcgatctggttgacattggacgggtcgccggcggcgatcggcgccagcggctcgggttcggcgggtgcggccgtacgctgctgcatgcgcgagggcagccattcggcgagcctcgacaacagccagcaggcgatgaagtaaatcaccgcggccatgaccagcgtctgcaggatgttgaagtacatcgagccgagtcggcgcgattcctgcagcaggtcggtatacatgatgatcgagcctagggcggtgtccttcaacaccacgaccagctgggtgacggcggccggcagcatggcgtagacggcctgcggcacctcgatctccatcagcgactgcgtttcggtcaggcccaaagcgagcgaggcctcacgctggccgcccggcagattgccgacgccggagcgcaccagttcggcgaccaccgaaccgttgtacagcaccaaggccagcaccacggcccaataggacgggctgggcaggcccgcgaacgcgaaccatcgccagaagaaaatcatgagcagcagcacgggaaccgcacggcagaactcgacgatcacggcggagacgccacgtaccaacgggttcggcagcagtcggcccacgccgaacaccaagccgaacaccacggcacccaccacggccacgatggtggccttgatggtcatccacagtccgggcaggtagaagtcggtccacgcctctcgttcgacggcgggcttccacagctcccagctgagctggttctcgccgtccggcgggttgtgcaggcgcatgaggataagcacgagcaccaccgcgaacagaatgcccgcgatccagttgacgatgcgaatggtgcgccggcccttgggaccgggcgcgtcgaacagcacggaattcgaagtatcggccatatccgtcacctccttacggcgagtttgttggacaggtacgtggtgagcatgccgatggggatgatcaggatcacgtagccgagcgcgaagatcaggaagatttggatgatcacgtcgggacggaattcgatcatctcgctcatcagcgaggatgtttcggtggccacggatgcggcggcggccacggtggagttcttgagcagggcgatcagcgtgttgccgagcggtgccacggagcctcggaaggcctgcggcagaatgatctcggtggcggactgcatgaagcccaagcccagcgctcgtgcggcctcggcctggccaatcggcacggtgttgatgcccgaacgcagagattcgcacacgaacgccgccgtgtacaggctcaggccggtgaccgcgagccagaagaagttcgtggtgaaggtgtcggagaagctgagcttcagctgcgcgtaggcacccagcaccatgaacaccatgatgatggtcagcggcaggttcttgaacagttccacatacgcaccggccacggccctgagcgaggaaatcggcgagatgcgcatcaccacaaggatcacgccgaggatcagggagaacagggcggaccatagggtcagttcgatattgaccagaaacgcgccgagcacgtcatactggctgaagagttccaggaatccgctcatcaggcctcctctccttcgtccggggtgggcgggttgtagcgtacgtcgggcgtgtagttggtgcccttggtgttatcgctgatggcgttctcccacgagccgtcctgaatcatgtccacgatggcgttgttgattttggtggccagctgcgtatcgcccttcttgatgcccacgccgtagtattcctgcgtgaacggtttgccgaccaccttgagcttgccgcgcgaggcggaggccaggccggccaggatgatgtcgtcggtggttaccgcgtccacgatgccggagaacagggcggtggcgcattcggcgtaaccgggctgttccatgagctggacttcggaggcgaacttctccttgacggtggcggccgaggtcgaaccggtgacggagcataggcgcttgccgttcaggtcttcggggccgttgatggagttgtcgtccttgcgcacgagcagatcctgtccggccacgaagtacgggccagcgaaggagacggccttcttgcgctcgtcggtgatggagtaggtggcgaggatcatgtccacgtcgccgttctgaatcatggcctcacgctgcttggagggggcttccttccatatgatctggtcttcggaatagccgagtttcttggcgacgtatttggccacgtccacgtcgaagcccacgtaggtgccggacttcttgaagcccaggccgggctggtcgaatttgatgccgatgcggatcttgccggtttcgtccgcgccgcaggcggccagcgacattgtgcaggccacggcggcgagcgcggcgatcacgcggcaagccttccgtttgaacgtattggtgaatgtcattggattacgtacccgtctttcagtgggttcgtcagtgggtgaggatcttcgagaggaagtccttggcacggtcggtctgcggatgctcgaagaactcgtcgggcgtgttctcttcgagaatctggccgtccgccatgaagacgatgcggtcggcggccttgcgcgcgaagcccatctcgtgggtcacgcagatcatcgtcatgccttcatgcgcgagttcgaccatcacgtcgagcacttcgttgaccatttccgggtcgagtgcggaggtgggctcgtcgaacagcatgaccttggggcgcatggcgagcgcgcgggcgatggccacacgctgctgctggccgccggagagctgggagggcatcttgctggcctgggagtcgacgcccacgcgggcgagcaggtccatggccagttgctcggcttccttcttgtccatgtgacgcaccttgatgagggccagcgtcacgttttcaagaatggttttgttggcgaacaggttgaacgactggaataccatgccaacttcggccctgaggttcgcgagctccttgccttcctgtggcaggggcttgccgtcgatgcggatgtcgccggaatcgatggtctcgaggcgattgatggtgcggcacatcgtggacttgcctgagccggacgggcccacgaccaccagcacctcacccttggcgacggtcaggttgatgtccttgaggacgtgcaaagcaccgaagtgcttttcgacgtgggtcagttcgactagcggacggttcgggtcctctttgccgggaaccagcggggtcaatttggccttgcttggtgatgttgtgcttgtcgtgcgcgaacgcactgctgtttcattgttcgtttcagacatgagtgggaggataacacaccgacgtttccaacgtgttcacagtatgtccacacagttgctcagtcgatgtctcatttccgcatcagacatcgtgaaggcggcattgggcatcggcatacattctcgctgagtcgcgcatcgctcggcgtctgctgtgcgctgattgcctgctgcgtggtggccgagacgttgctgcgacggcaaagcgggcacgtgttgtcctatctgctgattccatgtttggccttggtgtcgttggcgttgctgccgtgtatgccgcagtcgggcgcatggctggcggtcactttgtattgtgtggggctggtctcgccgtttcccatgtcgtattcgtataaatgcgctaggcattttgagcgtggctagctgttcgcacacgatgagtgctgttatacggtggacgacactcccgaagcgcggtggataaccgggcgcggcacacgatatgccggtggataaccggttcgcgccgcttaagttattcccatttttcggttttgcccctgtgccaccgtggaatgcgctacgctcggcgcatgaacggatacagcgaagtgccgcacaatggcgaaatcaacaactatctgcgcaaagatcttgacgccaaagccacggccaagaacacggcctgttggaatctgctgggcaaagtgcgcacgaaacgcacgttgtgtttctcgctgtataccgcattggaattatgcggcgtggagttgccgaggcacagcacgttgccgcagaaggatttttatgtgacggtgaggagcaaggggacccgctcttcattggacaatgtcgactatcgcatatggaatgcaaagttcaacagtatcgttttctcaaacggcgtaacctgcatgcatcccatggatgcatggatacagtttgcccaatatctcaacctcactgaattagtggtgctggctgaagcgctcatcagacgttatggatatgccattgaacaattcactcaacgactaacggcctttcaccgcgttattggccgtgcgcgttgtgaggcggcgctgaagctcgtaaaaccatcggattccgttcaggaaactcgtacacgcttggcgcttatgcttttcggcctgcccataccgcaaacacaatatggcattaccgattcagagaacggatacacctacaccgttgacatggcttatccacaatacaaagtcgctattgaatatgatggcgatcatcaccgtcgcttccgcaaacaatatgtgcgggaccagcaaaaacgtcgacgtctgcggcaattgggctggaccgtcatcgaggtgttcgccgatgacctgtggaacaccgccaaacaacgtgccttcgcacaagaggttgccaccgcgatgcaaataccgcttcctggccgtcctcaaccttcatgccgggtattaatagacggcagcctaccatcaatgcgcgcaaaggggaatacaggaggcggaaacaagcaaaacacaacaaagcatcacaacattgatcaaatacggagttgcgatcgctcctcatggggcggtaatttgcccatggggcggtttgaagaaattgtgaaaccgcggaattaagccattttgacctaccgccccatggggttttcaccgccccatgggttgtttaccgccccatgaggaagttaccgccccatggaaggataatcggcaaacgccaagggggacaccgcatggtgcgaggtttgccgcatggcggaggtgccatcgggcggagtatttggcaccccttggcaggtatttggcacattgggccccacccgcaaaaagcaaatggcccttggaattattccaagggccatttgcggctaatagcaccggagcattactcctcgaaaattaatctacgcgtgcggagaccgccgtccgaagccgaaggcgcactgaagtacgtcgagtgctgaggaaaagcggtatacgctccgtagattagttttcgtcggcgtccgggtcgtagtcgacgccagtctcggcgcgctgctcgtcggaaatcggggccggagcaccggtcagcgggtcgcggccgccgccggccttcgggaaggcgatgacgtcgcggatggagtctgcaccggccaggatggacacggtgcggtcccaaccgagggccagacccgcgtgaggcggagcgccgtacttgaatgcctcaagcaggaagccgaacttctcgtcggcctcttccttggtgatgcccagcacatcgagcacacgggcttggatgtcgtcgcggtggatacgtacggaaccgccgcccatctcctcaccgttgcagacgatgtcgtaggagtcggacatggcgtgctcgggatccttgtcgaacttgtcgatccaatccttggaaggcatggtgaacgggtggtgcatggaggtccacttggagtggccgacagccacatcgtcatcatccggatcgtcggtgggcttgaacagcgggaagtccacaacccaagtgaaagcgaacttcttcggatccagcaggccttcgcgggaggcgagctccacacgcacggcacccagcagcagctgggctgactcgcgggaaccggcggcgaagaacacggcgtcgccttcctcggcaccgacggcctcgcgtaggccgttgcgctcctcatcggataggttcttggcgacggggcccttgagctcgccgttttcgccgaagaccacgtaagcaaggcccttggctccacgctgacgagcccaatcctgccaagcgtcgaactgacgacgcggcgtggcggcaccgcccttgaagaccacggcacccacgtacggggcctggaacacgcggaacggcgtgttcttgaagtactcggtcagctccaccagcgggttgccgaagcgcaggtccggcttgtcggagccgtacttgtccatcgcatccttccaggtgatgcgcggcagcggcagctggacctcatagccggcggacttccagatggcggcgatgaccttctcagtcatggccatcacatcttcctggtccacgtaggccatctccatatcgagctgagtgaactcgggctgacggtcggcgcggaagtcctcatcacggtagcagcgggcgagctggtagtaacgctcgacaccggagaccatgagcagctgcttgaggagctgcggggactgcggcagggcgtaccaggaaccaggcaccagacgggccggcaccacgaagtcgcgggcgccttccggggtggacttaatgaaggtcggggtctcgacctcggtgaagtccatgtcttccagcgcgtggcgggcggccttagccatgtcggaacgcagcttcagattgtgctgcatggacgggcggcgcaggtcaaggtaacggtacttcagacgcacgtcctcgccaggcagcttgttctcggactcattctcaagagcggtggaaacctggaacggcagggcgtcggacttggcgaggatctcgatggtctcggccacaacctcgatcttgccggttgccagatgggtgttctcgttgccatccgggcgcaggcgcacttcgccggtaatctgaatcacgaattcgctgcgcagcgggcgggccatatcctcgtcgtaaatgacgacctgcacgaggccggtcgaatcacgaaggtcgatgaaggccacgccaccgtgatcacggcgtcggtcaacccaaccggcgagggtgaccttctggccgaccagggcctcggtcacttcagtggcatgatgtgttctgtaagccgtctggctcattgtcttgtttctcctcgatttttcgcgcgaatacgtcagatttcgacggtttgctgggcaaccacagtatccggctcccacgacgtgcaatcggcggcaacctgctcgcccgtgacgatgttcttgacctcgtcgccagcgggctctgcgccttccgcaccttcggcagcggtggccgggaaccacacgtacggaatgccgagtttgtccgcgtacttgatctgcttgccgagcttggccgcggtgggtgccacgtcagtagcgatgccgcgcgcacgcagttggttcgcaatacgattggcggccgggcggtcctcttcattccacacagcgaccagcacggcggccgggctgacacggctggcgtgagcgccggcggtgtgcagcatgtagctgaccagtcggctcaggccgatggacaggcccacgcccgggtacttgcggttgccctgggaagcgagattgtcgtaacgaccaccggagcagatggagccgagtgatgcggcaccgtcgaggaaggtctcgtagacggaaccggtgtagtagtcgagaccgcgggcgatcttcaggtcggcgatgacggaaccggggcggatggcggcggcttcgtcgacgatcatggccagggtatcgagtccctgacgagccagcgtgtaggactcggaatccttggcgatgccgtgagcctcgcacagcgcatcgaacttggcggcaagctcggcaccatcggaggcggtgagctcggccaattcgaggcaggcgcgcgcctgtgcttcggtggcgccgcaggtctcggtgagcagtcgggccacctcatcggcaccgattttgtcgagcttgtcgatctcgcgcagcacgccttcgacgtccgtcagaccaaggccgcggtagaagccttcagacaacttgcggttattggcgtgcacggtggccttggggaggccatacgcgcgcagctcttccagtgcggagaccatgaccagcggcagttccacttcatagtggtcgggcaggtcgccggcgccgatcacgtcgatgtcggcctgtacgaactcgcggaagcggccttcctgcggacgctcgccacgccacaccttctgaatctgccagcgcttgaacgggaacgccaacgcacccgagtgctcgaccacataccggctcagcggcacggtcagatcgaaatgcaggcccaaacgctcttcaatcggagtgtcggattcatgaccgacctcctgcaaacggctcagcaggtaaatctccttgctggtctcgccttttttcagcaaagaagcgccggtttccaccgctcgcgtctcaatgccgatgaagccgttgagctcaaaaaccttacgaagcgtatcgataacacgctgctccacaacacgttcggaggggagccactccgggaatcctgatattgatgcacctttagccacgaaatcaatataataggtgagggttgcgtcaaaacttcctggttcgcccgggatgggagacgctcccgcttatgcattctacgctttaaggagctggccatggccgacgaaactgtcaccgaacccgtaaacaccgctgcgcccgaagagcaggcaacgacacccgcacccgaggccagcgcggccacgccggcgccgactccgtcccccgcttccatgccgaaaccgcacgcgccctcccccgccgccttcgccaagaagactccggcgaccaagccgcgcgctgccgccccggccgccgccaccgccgcctattccgaggctgatgtcaaggccgccgaggccttcggccgcgtggatgacaacggcaccgtcttcgtcaaggatggcgacgccgagcgcgaggtgggccagttcccggatgtctccaaggaagaggcgttggcactgtacgcccgtcgtttcctggatctcaaggccaagctcgatctgttggccacccgtctggcttccccgaacatcaaggcccgtgaaatcgacgaatccgtgaagctcttgggtgaagaaacctccgagccggccgtcgtgggcgatcttgccgcactcaaggcccagtacgaggagctgaaggctgccggcgaggccaagaagaccgaaatcgccgaggcacgcaaggccgctcaggccaaggccgttgccgagcgcaccgccattgtcgagaaggctgaagcactggccgcttctctgggcgacaacaccaactggcgctccaccgccgacaagttccgtaacctgttcgacgagtggcagaaccaccagcgcaccaccgtgcgcatcgacaagccggaggccgaggcgctgtggaagcgcttctccgccgcccgtaccaccttcaaccaggctcgccgcaagtgggctcaggctcgcgacaacgagcgcacggccgccaaggaagccaaggaagcgattatcgccgaggccaatgagctcaaggattccaccgcttggggtgagacttcccgcaagttcaacgatctgatggaccgttggaagaaggccggccgcgctggccgtaacgaggacgacgagctgtgggccaagttccgcgaagccgccgacaccttcttcaacgctcgtcaggccgatcgcgatcagatcaactcctccgagaaggagaatctggctgccaaggaggctctgctggtcaaggccgaggctctggtgccggtgaagaccgacgccgaggccaagaaggcccgccaggagctggccaagattcaggaagagtgggatcagatcggttacgtgccgcgtgacgatatgcgccgcatcgagaaccgtctcgacgccgttgacaagcagatcaaggccatcgaggatgccgcttggaagcagaccgatccggaggccgacgcccgcaagtccagcttcgaggagcagctcaacgcccagctcgccgagctcgacgccgagatcgcggccgaatccgacccgaagaagaaggccaagctcgaagccgagaaggccaccaaggagcagtggctgaacgccatcaagtaagggtctcgccagctcccctctcagacagagaggggagctggcagtaaggctgactgaggggagtttacggttataccgcaagctcccctcagtcgcctacggcgacagctcccctcagcgaggggagcgtcgtcatatttatgccgttttctcctgccctatactcataacttcaccccatagttcctcagtcacccagcaattggtgtcttacgcctgagtccctaccggtactgcaacaactgccgtgagcccttgatgtgcggccagatattcatgcaacggctggctgtatggcatatccagctcgccgtaattggttccggcacggaaggcggggtaactgtcgccgccctgaagcagatatgaattggacgcgataatcaccaggtcatcgtccgcaatcggtcggccgtcaacggcgaggttcgcgatacgaaccgccgcatgttcgtcggcagcacactcgtcagcgtcagcgttggtatcagcgccggaatcagtatcaacgccggcatcggcattgccgctctcaccagccgtaccgcattcggcataccgatacgtcacgttcgaggagatgccgagccagcgccgctccagtcgcccatcgtcacggcgaaattgctcggcgagcactctcttcacatcgcgcccggtgagcgtctcatgcgcggccttgaactgcaaggccatgagactatccacctcgcgcacggtgactttgccatcgccattcatatcaagccgtggagtccgcagactgccattattcgaaaatccgattaccggcaagcgattcccggcatacacatgcttcatgattgactctcggttcgcgtccgccaccagcacaccgaccgtattcccgtgcttgtccgaaccttgtttgtcgaaattcacgccggaggccaaggtgccaatcaccgcgctgccggtatggttcgcatatgttgccgacgcctggtaaatatgctgcgcgcgcgatacctcatcgttctcctcagcaccggcagacatccaagcggcttgcgccggatgcgcattaagcccatccacgcccagcacgccgtcaaccgccgtatggctggtgccattgccgaggtcaacgtcggccactcgcaccgtggcgcgacgcccggcaccggtgatgatcaaatcctgcacggccatgttccgcccgaagctgcccgcctcgtaaataggcgcgccacccgcggttgtaccgtgcttgatcgcgtgactgtgaccggtgtataccacatcaacatctcgcccaatatcggcggcggctgaagcatcggcatgcagcaaggccaccaccgcatccacctttccggagcgcttgagttcacgggccacacgattgatcgcgtccaccgcccgttcgtcaagatcggcatcacgagtgatctgcggagtggccaccgagccgagcgcatcagtaagggcgcccacgaaaccgatccgcttgccgttcaccgttcgaatcgtagagtcacgtacgtggctcagcagtccgtcagacgacttattggcggcagacgtgttggcgcacagccagtcgatgccgttgctgggatcagcgatgcgattgttgaaatcggcgacaccgcggtcgaactcatggttgcctaccgccgaaatcgtcaatccccacgctttggccatatccagcgtgggttggtccttctccaccgccgactcatacggggagcctcccaccaaatcgccggtcgataccggaatcatattgccgggattatggctgtcggccacggtgaaggcggtggcgttgtccgcaccacgttcgatatgcccgtgaaaatcagtgatgtcggcaatggtcaccgtacgagtgccggaagatggattatcaccggaaaaaggaacggctcccgtggttccagcacaagcataaggaaccaccagagccgtaaggataagcgctactgcaccaaaaacgatccccgatcgcttgccggcccaccgccggttcttcatattcctgctcacaccagtcacgctagaatcgtcgattgaatggccatgcctaggaaggcgactctcaggtgaattcttagcggcgtcttgggatgggaaaggcctgaccccatactatcagggtcaggcctttgcaacccgagtcactacgaatgcgtcagcaagaggagattactcgccaaattcctcggcgcagatctcagctaccgcatccacgcacgcctcggcaatcagacggccgcgttcggcgctcgagccggccggattggcgagtccgccgtgagcgggaacgtcaccttggcgcacagggtagcggacataggatttcgccgtggcaccggcttcctcgaccatacggtccatgtgcaccagttccggcgcatagtggagcatcaacgaagtttcggtgacggccgcatgctccaatgcccagccggggaacaccaatccatcgaacaccttgtcgataaccgactgcggaactggatcccaccaattggtttccacgatggtggctactccccggtttcgcggatgaccagatcgatggcctcgacgatgaacgcctcgttttcaaaatgcgcgttcatgacgacgatcttggtgaagccatcggcgatgagttcgctcagcacgtcgtgcatttggttgatcactgtcacgccgttcatgtcgatagtgcccgggaacagcggcccgccaccggagagcggcttggacttgtatccgtagctcagggtgggcagcacggtgccgtcgatgcgttccgccagatcttcggcgacccgcgtggcgagtaccgcgtcggtgccgatgggcagatgctggccgtgctgttcggtcgaaccgatcggcacgatgacgggacgagtcttcgcctccttgaattccggccaggtcatgtggtccatacggcggttgctacccattgcagtactcctttaggttggtggtggattggatggtcgatgaatacgcccggctccctcggggaaggagccggagctgaggagatcagatgtgattcagatccttgtcggtgttttcgtgggagaggatcatcgcgaccaaggcgatggccgcaacgcccaccatgtaccaggccggggcgatggacgaaccggtcagggcaatcaggccagtggcgatgaacgaggccgtaccaccgaagatggcgttggccagattgaagctgaacgcgaatccggtgaagcgcacggaggtggggaacgtctcggtcaggtagctggacagggtaccgtcgttggcggtcagggtggcgcacattgccagctcaaccagcagcacgggccagaactgggaggtgttgaggatgaggaaggcaggaacggtgaggacgatgaacgccacgcaagcgccgatgagcaccttcttgcggccgaatttgtcggagatgtggcccatgccgaacaccatgaacacgtaggcgaccaggcagatggtggtgatggtgccggactggggggcgtccatgccgacggtgtcagacagataggtcggcaggtaggtgagcacggtgtagaagccgaccgcgttcagcacgcaggctccgaagctgatgatcagagccttgagatggttgtggaacaactcggcgagcggggcgaacatgccgctcttggcagcgatttgaccgtcggcggaggcggcgcccttggactcaagcgcatcgttcatcgactggtagacgggggaatcagcgagcttggcgcggatgtacagcacaatcagaccgagcgggccggccagcaggaacggcacacgccatccccaaccgaccatcgcgctagagttcatgttggcggtcatcagcgtggccagagtagaaccggcgagcagaccgatagcggtggaagccggaatcagcgagcagtagatgccgcgctttgaagtgggcgcatattcgccgaggaacgtggccgcaccggcatattcaccggaggcggagaagccctgcaccatgcgcagcagtagaagcagaatcggcgcgccaacgccaatcaccgagtaagacggcaggcagccgatcaggaagctcgcaccggacatgaacataatcgagtgggccagtgcggctttacggcctttcttatctccatagctaccccagaacagtgcgccgattggacgcaggatgaaggatagcgcgaacacgccgaaggtctgcagcatggcgacggtgtgattgtcggttgggaagaacaccagggcgatagtggtggcgaagtacgaataggaggcgtagtcgaaccactcgatgaagttgccgaggaaggaagataccgcgacttttctgaccatggcctgttcttcagtttgcggggtggaattcatcagtcgtgcagatgtagtaatcgttgcggaactcatgatgtcaccgtcctttcaaggatgtgctgttcgtgtgactgaatgagattcaagtgggaatccgtttcgcagcaggtcgaccagcgccgcgatagcctcgactatgcccttgagtatttgctgaaacgtgaatcgtcgattaaccagttcggcgtagaagtggacaggttgcccagtggcactgccgtattattcaccatgctgttcttgccatgatttcgtgagtttggcggcgaatagcagcatcacccagttcggtttgtcgttatagtcgacgccgaccatttgtgtcactttgtccagtcggttgtacagggtttgccgtctgatacccaattgctcgcacgcgccggttttgctgtcgaggttgtcgaagcaggcgcacagtgtgtccagcaacagcggggaggcggcgacctcgaatccgatggtctgcaccacgagcatgcgcatcgccttgtccatatcagaggatgcgacgaaacggtcgacgagtgcggacatggtacttacgactcgcccgtatgccggttcatgattggcgatgtcacgcaataccgcgaacccgtcgaccagcgtcaccgtgtccaatgccactcggccatgcaccacgtatataccgtcgccttccagtacggcaagcgcatccatgcaatggcgtccgaatgcggccgcaccgtctgaggaatcggtggtggagcaccatccgaccatcaagtcaccttccagcatgcaggagacggcgcatcccgacagttcttcgaaccgttcgaccatcgtcgatacatggttgatgccttccaccaccgatctgaaccgaaaagcgaatggcatatagatgcatgatccggcaaaacccagcgcttcgagcatcgcatgcgcttcctgcgcctcaaatgtattgacgtgcacgccgtcggccggacccatactcagatgatgcatcatgcccatgcgcgcaccgccgtcaatataaagggcggccaccggagacacgatggtggcgatggcccgacgcatcgtggcgtcggaagtcatggtgcgttgcgtgatctccaatgctcccaccggccgggagcgactttcaagggcgatgacggcgctcgattcgttgccggcatcgaacgcacgacccgctcgagcggccaacagaccgtcaccatcgaaaatggcgacgctttcgccgaacagcgacgcaatggtttcggccacagcctcgatattgccggtacgggacaatccctcacgtaatgaagtggacattgtgtccacctccaattgcaagtgcatctgttcgtgcacgatagcggtattgacgctctgacagatgtcgacaaaaggtacgcgagatttcaaaccaatcaacgtcaacccatgcagcctggccgcagacaccagttcgtccggcatccgcaccacaccctccaccagttcgaccaccagagcggcgacaccagcctgtgccaggcttgctacatattgtcctagcgtgccgtgccaatcggcggcgagcagagcgttgccctcgataatcagcatctcaccgcccgaaaggaagctggagacatcctctcgctcgttggtgaacacccatcgcactggcgtatcgaggtctttgccttcgacctccaccacaggatcggctcgtttgaactgcgtgttatgaagcacactgcgaatcgatacagtcatacaatctgtccattcccccgcggaacaccggtcgttccggttaacctcaccgcaaagcgtgctgttgacaataacctcagttggttacgcgggcagtcggttcacgtaaccgttcggcaacacaccagttgaaggagcgacgatgactaccacactgttcaccaacgcacatatcgccaccggagaacccggaagcacggctgcaagcaccctgccattgcaggacattctcgtcacggatggcgtgttcaccgcattcggccccggactcgcgcaacaatatgaggctcagggtggtgatctggcggccattgaggtggtcgatctgggcggcaaacttgtctgcccaccgttctgcgatacgcatctgcaccttgattacgtattcacggcccgcaagcccggtgcggtgaatgaaagcggaaccttgtttgagggcatccagcgatggagtgagaccaagtccgacttgacggtcgacgagatcaagcagcgcgcgaaaatcggcattaagaaagaaatgctgcatggcgtgcagctcattcgatcccatgccgatgtgaccgacccgaacctgacctcgttaaaggcgctgctggagcttaaggaggaattgaaggatacggtcactctccagatcgtcagcttcccgcaggagggcatgtactcctacgagggcccgcatggcgaatcgggtgccgagctggtggaggaaggactcaagatgggtgccgactgcgtgggcggcatcccccatttcgaacagtgccgtgagtttggcgagcattccatgcacacggtagttgagttggcttcgaaatacgacaagctcatcgacgtgcattgcgatgagacggatgatccgaattcccgttacgtggagctgctttcggcgctggcatataaggctggcattggcccgaaggtcaccgccagccacacctgttcgctgggatcggcggacaacgcctacttcttccacctgaccaagctgcttaaggcggcgcatatcaacttcgcctgcgcccccaccgagaacctgtatttgcagggccgtcaggataccttccccaagcgccgtggcatcacgcgagtcaaggagctcactgaggcgggtgtcaatgtgtcattgggccaggattcaatgcaggacccgtggtacccgttgggcaatggcaatatgatgctcattcttgattatgtgctgcatttggcacagatgatgagctttgaagaaatcgacgatgcgttgaagttcctgaccgtcaacggtgccactacgttgggcctgcgcgatatgtacggcttggaaacgggcaagccagcaaacttcattgtgctggacgccgatagcgtgttcaacgccgtgtatgagcgctgctcggtattgcgttcggtgcgcgccggccgcacgctgtttacccgcgaggagaccatcgacaccggactcgccctgctgtaataatccgacacaaacagtagctccccttgacaggggagctgtcgccagaggcaactgaggggtagaccacaaacgtgcacatcatgtgtgcgcaggtctacccctcagtcagcttcgctgacagctcccctgtcaaggggagctttgctggtatgcgctagctacgctatcgaaacggactactcctgcggagcgtcaccggaatcggcgggagcggattcggccggctcagtggccggagtggcgtcggctggagtctcgccatcagtggcggcaccgtcttcggcgggcttatcggcggcggccggctcctcgaactcctcacccttgaaggtgaattcgccgaggataccctcgccttccgcatccacaatcacgcgctgaccgtcttcgagatcgcccatcaggatcttctcggagatggcgtcctcgatgtcgcgctgaatcacgcggcgcagcggacgggcaccgagcagcgggtcgaagcccttctgcgcgagcaggtccttggcggcgtcggtgagttcgagcgacatatgacggtcgaacaggcggtcgttgagctgcttgacgtccagatccacgatctggcgcacctgcggctcggtgagctgcttgaagacgatgatgtcgtccagacggttcaggaactccgggcggaactgctgcttcaattcggagctgacctggtccttcatgcgctggtagctggactcgttgttggcacctaggttgaagcccgtgttggcggccttggcgatgtctcgcgtaccgaggttggtggtcaggatgatgatggtgttcttaaagtccaccttgcggccctgaccgtcggtcaggtggccgtcatcgagcacctgcagcaacgtgttgaagatgtccggatgagccttttcgatctcgtcgaacagcaccacggagaacggcttgcggcgcaccttttcggtgagctcgccgccttcctcgtagccgacgtatcccggaggcgcaccgaagagtcgcgaagccgcgtacttctcggagaactcggacatatccacgcgaatcagcgcgtcctcatcgtcgaacaggaattcggcgagcgtcttggccagctcggtcttgccgacgccggtggggccggcgaagatgaacgagccggacgggcgcttcgggtccttcagacccacgcgagtacggcggatagagcgggacagggcggaaaccgcctcgtcctggccgatgatgcgcttgtgcagttcggcttccatgttgagcagtttcttggactcggcctgagtcagcttgaacaccgggataccggtggtggagctgatgacctcggcgatcacgtcctcgtccacgaccatcttgacgtcggactcgccttcgcgccaggagtcttccttctgcttgcgatcggcttccagcttctcctgcttgtcgcgcagttcggcggccttctcgaagtcctggcccttgatggcctcgtccttgtcggcggcgatcttggcgatcttctcgtcgagttccttgagctcaggcggggcggtcaggcgcttgatgcgcaggcgtgcaccggcctcatcgatcaggtcgatggccttgtcaggcagattacggtcctggatgtaccggctggacagctctgcggcggactgcagcgcgccatcggtgatggtcacgtggtggtggttctcgtaacgggaacgcaggcccttcaggatctcgatggtctcggcgatggtcggctcgtgcacctgaatcggctggaaacggcgttccagagccgcgtccttctcgatgtacttgcggtactcgtcggtggtggtggcaccaatggtctggagctcgccacgggccagcatcggcttcaacatgtcggaggcacccagcgcgccgtcagccgagccggcgcccacgatggtgtggatctcgtcgatgaacagcacgatatcaccacgggtcttgatttccttcagcaccttcttcaggcgctcctcgaaatcaccacggtagcgggagccggccaccatggaaccgaggtccagcgagtagacctgcttgcccttcagggtttccggcacgtcgccggcttggatcttctgggccaagccttcgaccacagcggtcttgcccacgccgggctcgccgatcagcaccgggttgttcttggtgcggcgggagagcacgaccataacacgctcaatctcgttggtacggccgatgaccgggtccagcttgccttcagcggcttcggcggtcaggttgcggccgaactgatcgaggatggcggaaccggacttgttctgcttgtccgtcacgccgccggcgttggccaagtcgcccttgccgtcaccggtgccggtgccggagttgccgcgaatcatatcgatggtcgcgctacgcaactcgcccagatcgacgtccatcttgatgagcacctgggtgcccacgccttcgccttcgcgaatcaggccgagcaggatgtgctcggtgccgatgtagctgtggcccagctgcagggcttcacgcagcgaaaactccaacacctgcttggcgtgcggagtaaaggggatgtgcccgttcggagccgcgttgcccttgccgatcatttcttcaacctgcttgcgggtggcatccagctccacgcccttcgaggcgagtgccttggcggctacaccctcaccttcgcggatcaggccgagcagcaggtgttcggtgccgatgtagttgtgctgaagggccctcgcctcttcctgcgccaacacgatcacgcgccgtgcacggtcggtaaaccgttcgaacatgcttgtccttcctcaattgacattccgtcttactctaccgattcacgatgacgtttattcatcggattccacgaattgcgccgtgagaggagaagaaaacgatatgctggttctagattcacccgtagtcgattacaaggaggctcgaaatgagtgaagctgcaaccaagcccgacatcgttgtcggtgtggatggttccgatgaatcctttgccgcgctgaagtgggcgcttgaggaggcctcgttaaccggtcagagcgtcaacgccgtgtttggctggacgcattcctgggatatggggtccgaaccggacagcgacgaggcctgggccaaggtccgccacgatattgccaacgagctgcgtgtgtgggtcgacaaggccgctgcaggcatcgacttcgatccggcgaatctgaagctcacctcggtgaaggcctccggtacttcggccctgctgcagatcggccatgattcgcagcagatcgtggtcggccgccgctcgctgagccgtatggcccgctggttcatggggtccctgtccgcttcgctggccgaggccgccgaagtgccggtgaccgtggtgcgcatcgccggcagcgaggatgagaccgtgaccgaggccattgccaacgccctgactccgggagacaagcccgttcactacacgcagcctcagccggtggttgaggaggctcgccgcccggtggtggttggtgtggatggttccgagacttcccgccgtgcgttcgatttcgcactggaagaagcacgactgcacgacgcgccgctgcatgtgatgttctgctggcagctcaaggatttgggcgttattccgggctatgagaacgccgtggcaccggtgaaggtcggtcagcgccgcgccgaggagattctctctgagctgatggccaaggcccggattcccgatggcgtcaaggtcagcacaaacgccttccatattcccgcatccaaaggtctgatcgcggcctcgcggtacgccagccatctggtggtcggctcgcgtggcctgtccgggctggacgcgcacttcctgggatcggtgtcccgccagatcgtgaacttcgccgaatgcacggtgaccgtggtgcactgattcaccaaaatcggcatggagtgctaacgcacgcctcggtgatgggcttgcagggaggaattctttattcctgcaaccccatcaccatctacttttcgcggaattcggagtttattcctcgtccgccctgttctggcgcagctgctcaatgagatcgatgacggtttcgagttcaggagtcacatcgtctgaaggacgaacgttatcctcttcgtcgtccatctcatcatcctcatcatcatcggcaacggtgttgttgaggatatcctcttcggtggcctcgtcgtcagcatcagacttggactcgtcgctggaatcagctgcatcaacatccacaacggaatcggatgcgttctgtgcaacggactcatcaccggcagactgggattgcgaggtcccgtcgcctgccgcctcctcagcgggctcagtatcgacggcgttcccgtcaacagtcttctgtgcttcgatatcatcaccggcaggctcgcctgtcttgtcggtttcgccttcggcctcgtcctgggcagccggttcctgcttgcgcggacggttggccaccacgtcgatatgcagatcgtcgaaagcaggcttggactgcacccacagctggcttggctcgggaggttcgatttcggaatgctcaccgcagccgtggtccaaggaaaccacgcggccgtcatccggactccacttgttggcgcacacgccgaacatacggtcgagttcgcccgcgagcggcacgaagaaaccacaggtggagcacaggttgccttcggcggttttggtgctcaacgctttggggcctcgcggaccttcataccagcgcttggcagcctgcgcgcggcccagcgaggtcagcacgtgacggcgggtcagtcggaaggtctcgacggcgtcgttgacatcctgcagcgaggattcctcgacttcgccttcctcgatgcgctcgtcatccggatcggtaccgatcgaatcggtgggagccagatccgtgggctcaaggcgatccctccaaggaatccacttgggcggcatcaacgcgccctcagtagggatcaaggaggattcgttgacggtccaggagtcgatctcctcgtcgtgatacagcgtcaccgaccattgccatccttcgtagccacggatattcgcggcgaagcggaagtcagtgacgtgatcctcaagatcatatgaggtaacgaaatcccccacctgatcgctctcgtcggccacttcgagcagcacggcgcgcgcgatggcgtgagggtccggtgtcacgatggtttcggtggtatcagtcatagatcagatcagtcctgtacatcgaattgatccgccaccgcacgcagcaacgtggccagctttttgctgtcggcagcagatgggtaacggtgacggcgcaacgtattgccggccgcatcaagcatcttgatgaggtcctcgcagatggcggccatgtcatccgccttcgggcgggtggccttgaccaagctgggagcggaggcgatcaggcgaacatccatggcctgcggcccacgacggccgtccaccacggaatactccaccttggcccccttgcgcaacgtggtgacgccagtgggtagggcctgagccggcaggaacacgtccttgccttcctcactggtgatgaagccataacccttggctgcgtcaaaccaacgaactcgaccggtgggcattgcgaaccttccttaatcctcaatggaaatagtaaaccgaaggtacagtttacctcacagggcttgacctcacgctttgggctgagtcgcctgagtcttacgctcagagctgaaccaagaagtcttctgtttggcgtccttggttttgccggtggactgcttgggctcaggagcggcgatctgctcaatcggcagcaccacggtgaaggtcaggcctcccccatcggtgccggtggcgcagataaagccgtgatgtgctttgaccacggattgcgcgatggccatgcccaaaccagtaccgcccttttcgcgggcacgggatgggtccgcggtgtagaagcgttcgaaaatcttcgagcgcgattcaggcggcacgccggggccatggtccacgaaacgcaatacggcatatcgatagccggtctgcatcgaggcacctacttcggcagcgtcgatgaaccgccgcattgacgcgtcgctggcgggcatgcgggcgagctgtcttggatcgatggcggccggcatcacaccgagcgcggcttcagcgggcgaatcggcaggcgtgtagcggtggatgttgcccacgatgttggtcaccacctggcgcagtcgagaggcatcaccgggcagtacgacctcaggccaatcgccttcggcaaggctgaattcggcgggatggttcaaatcgcgcgccggttcgagggaaatctgcatgcggcgaacggcacggtccgggtcgagcgcatgcaaatcgtcgacggcgtcggtgaccagcgacgagagtttcaccgtgccggtcatatcgatgccgcgcccctcatcgagacgggccaaagacagcagatcctcaacaagaacagtcatgcgctggctggaccgttcgatatgttcgatggactcgtccgcacgctccaaggcaccaggcatatcgcgctgcatcttatacagctccgcatagccatggatggcggccaacggggtgcgcagctcatggctggcgtcggagacgaaccgtttcatcttgtcggtggtctcctcctgctcatggaaactggattctattcgggtgagcatggaattcagcgaggcggccagagagccgacctcggtgttttccggcgcggaaggaatacgttggctcaggtcgccggctgcaattttcgcggcggtcttctcgatgcgcttcagcggcgtcatcgtgtgctggatgatcagcgtggacagggagccgccgagcagcaccacggcgatgccgaccacaatgcagtatcgggtgagtgtgttgacggtgtcgatttggtcggccagcgacaagccgatgtacaccacggcacggtccttgccgttttgctggaaggtcaccggcagaatacgccatggtgccctcgccgtgacgatggcggcatggttggcattggcagtggggttggccagtaccttggtgatggtgtcagaggaattggagtttccgttggccggatcgttctggctgtccgcactgtcggactgcaccgtgatgatctgcttggccaccgcctgcgtagtgaatgcctgaccgagcgtgatgccattggtatcgccataggtaggcagaatcggcaccgatacgataccgtcctgcatctgcggcatcagcggggtcacgaccagaggattgccttctttgtctttggttccgtcggtgtattgaatctgcagaaagtacgagttcggccccgatgagtcattttttgacagcagatcgatattgttgaccaccagttggctttgcgagcttaactgggtgtcggttttctgcagcatgtagttgttcaccaacgcgcggatggagaaggaaatcaccgacacgccgatgagcagcacggcgatggtgcaggccaccagcttgctgctcaacgagatacggtcgatatgccgcatcagcatgtttttcttacgctcgcgctgctcttggaaatgggcggcgaacggcgacattgcaggcatgggattcgtgttcggggcggcgttcggcgtgctgctcggcggtacgccgcctgactgcttatcggggatactcatgagattgcgatacgttatggatggaggcgattagttcttcggttcgcgaatcatgtatccgatgccgcgcttggtttcgatcagcggagtcaccttgcgcttgccgccttcgccgtcgtcgacctcgatgccgtcgactttcttgcgcaggtaggagatgtacgattcgacgatggctgcgtcgccgccccagtcgtattgccagacatggtcgagaatctgtgccttggacagtactcggccctcgttgtccatcaggtagcgcagcagcttgtattcggtagggctcaggtcaaccggctgccctgcacgggtcacgtcgtgggagtcctcgttgatttccaagtcggcgacgcgaataatcggatcgtcttccacctgttcgcgggtacggcgcagaatggcgcggatgcgagccacgacttcctcgaggctgaacggcttggtgacgtaatcgtcaccgccgacggtcaggcccatgatcttgtcttgggtgtcgtcacgagcggtgagaaacagcacaggggcgttaatgccttcctggcggatgcgacgggtgacggtgaatccatcgatgtcaggcagcatgacgtccaacacgatgaggtcaggctgcactttttcgataacctcaatggcttcggaaccggaagcggcggtgtttacctcgaatccggcgaagtgcagggaagcgaccagcagttctcggatggacggctcgtcgtcgacaacaacaatcgatgcttcaataggcttactcatgcttcctagagtgtcgcgctcttctgggcgtttcctgaatgtcatcttggagttcggccttggaatccttcttgatctccttgcgccgatgaatcaccaccatgaccacgatgatgatgaccagcgccaccaataccacacccatgatgattatgcctacgatcaccgtggacgatgaggtggaggcttttttggatttcacgatttgatccatcattgccgttgccgcgccagaccagctcggcgggttttccagtaacggctgctgtgcggcttcggatagcttatcgacggttttgttatcgagaagccacttatcggagttcttggacacgacgaccaccaggttgccgtcattcgaggccacggcaagcatcactgtgttcggcttgggattcatggactccatcacggttgccgcccagtctcccggtttctgttgactattgaaactggaaagatacagcagatgcacgtgtacaccggtttccttctcggttttggcgatggcatccgtgacttcggccgcatgggagcccaggagattttccgtatccgtgatgttctcggtgatggtcacgccgctgtcggtgctgctgctggagctgtcagagctgtcgctcgagttatccccataggcatttgcggttatccacattgcgttcatcgctactgcagcaagggcgcaaatggcgcaaacaagccattttcggaccatattcccgaaggccgaataggacggctccgaagctaggaccacaatagttgtttttccgtcttcccgattcgttgttgacatatcctccaccttaacggccggtattggcaatcggccgccatacataccattaaccctctagaaaaggagcaacgatgccccaatatcaggtagattccgagcgaatccaatcatcctcggccgcagtggccacttcgatctcgcaaatcaggcaggccgtgggcggcatgtacaccaatctcaatgccttgcaggacgcatggcgaggttcggcggccacccagttcaccgcggtagccgaacagtggcgtgcggcccaacagcagatggaggcctcactcgagtccatccaacgctcgctgacgcaagcctccaccgtgtacgctgacgccgaaatccaagcttcgcgcctgtttgccagctagtttcttggctcccctcaaagaggggagccagaatacaaaaaagggactcccgaaggagtcccctttcagctcaatcagctagcgatcgtttgcggatcagtagcccatgtcggcaccggcggccggggcagcagacttcggctccggcttgttggcaacgacggcctcggtggtcaggaacagaccagcgatggaggcggcgttctgcagagcggagcgggtcaccttgaccgggtcggtcacaccggcggccagcaggtcttcgtaggtgtcggtggcggcgttgaagccttcgccatcaggcagggagcggacggtgttgatgaccacgtcaccggacacgccggcgttctcggcgatctgcttgatcggggcctcgatggcgcggaacacgatggcggcaccggtagcctcttcgccggtcagggaggtgacggcctcggtcttctcggccttggcagcagcctgaacgagggccacgccaccgccaggcagcaggccttcctcgatggcggccttggcgttacgcacggcatcttcgatgcggtgcttgcgctccttggcctcgacctcggtggcagcgccgaccttgatgacagccacgccgccagccagcttggccagacgctcctgcagcttctcacggtcgtaatcggagtcggtgttctcgatctcagcgcggatctgggccacgcgagcgtcgatgtcttccttggagccagcgccctgaacgatggtggtctcgtccttggagacgatgaccttcttggcgtggccgagcacggaggtgtcgacggactcgagcttcaggcccagttcgtcggagacaacctgagcaccggtcaggatggccatatcctgcagcatggccttgcgacggtcgccaaagcccggggccttgacggcgcaggacttgaaggtgccacggatgttgttcaggatcaaggtcggcagtgcttcgccgtcgacgtcctcagcgatgatcagcagcggcttgccggtcttcatgaccagctcggccacgtgcacgatgtcctgctgggatgagaccttgccggaggtcagcagaatgtacggatcttcgagcactgcggtctggtcgtcagcgttggtgacgaagtacggggcgatgtagcccttgtcaaaacgcatgccctcggtgaagtcgaggtccaggccgaagcggttgttgtcttcaacggtcacaacgccgtcctggccgaccttgtccagagcctcagcgatcttctcgccgacctcagggtcagcggcggagatggtggcggtagcagcgatctggtccttggtctcgacgtccttggcggcagcgacgagttccttgacgatgacctcggtggccttctcgatgccgcgacgcagggcgatcgggttggagccggcgaccacgttcttcagaccctcgtgaaccagggactgagcaagcacggttgcagtggtggtgccgtcaccggcgacgtcgtcggtcttcttggcgacttccttgaccagctcggcgccgatgcgctcgtacgggtcttcaaggtcgatttccttggcgatggacacgccatcgttggtgatggtcggagcgccgtaggtcttgtcgagcacgacgttgcggcccttcgggcccagagtgaccttgacggtgttggcgagcttgtcaaggccctccagcatgccctgacgggcttcctcatcataagagatgatctttgccatggttgcgtattcctccaaatggctaggtataccggttatcactcgcaagcgtcgagtcgtgacgaccagccgtcagctgccgattatcactctcgacctccgagtgctaacccagacattagcactcgcgcccgccgagtgccaacaccatcggcggcgattgcgctttgggcatgaaaaagccccaaccgtcgaaacggtcagggccttcaatgcacatccttgcgtgcgtgttactcactcggagcgggcttcacccgaagacagcttgacaacatcctttgcctgcgtgcctttgccggacgaagcgggcgtatactccacgcgatcgccctcgtacagcattttgaacttattggtgctgccgtcgtccttgatttccgcgtagtgcacgaaaacgtcctcgccgccgtcgtccggctggataaacccgaaccccttcttggcaaggaagaacttcacggtaccttgtgccatatctggtctttcctttgttcccttgggcgtcgcgacacaaaacctatagggaacgtagaaagaaccgcatcgcgctccccctacctcgcgactagatgacgattgtacagtgacgagggaacaatctcaaccgcagtggcacattttcggtacgaattattccataggcgtgagaacgctcacagttttcgatgtatttctcgccgatatcaggggcgcatcaacaacgctagttgagcaacaccaccgtaatgggaacggcgagtccttgcacctgctccacagccgaaatgccaagcgtggtcgccacatcctcagcggtggccttatcggtctcattctgataccacaccacggaagaagccggcaatgtgccgctcggattggtcgcctcgacactggtgtaaccggcggtctgcagcacatcggcctgctgacccgcatatccttggattcctgtggcgttgaccacacgcacctgcgtggccttattcacagtcgcgatggcttcggactgctgagactgctgatcggagttttgattctcattcgaggatgtcgtgtcactgtcggtatcggactttgccgaatccgaagtcgagtccttggacgaatcggtcgaagtggacgaggaatcatccttggtgctgttcttggtctcagccttgctggacgaatcggacttggacgtggtcgccgtctgggacgatcctcccactacattcttgtattctccggaaatccatgcccaggccccgacaccgcacagcgcggccaccagaataacgacgatgaacgggcagaggcgggccattaccgaacgagcgccacggtgaactcccaccggtcccttcggaggattgtcgaaggaatccggttcataggattcgtaggtcatcgtgtcgcgtgccataatcgccctttcttcctatcaaaactacccatgagtgtaatcggcaaacaactcatcagtccaccacaccacgccccatgcaccggatatgcacgtttgactacagtggtgagtcatgatcaaaccattgagcgaactggtagagccagggtgggcccatgccttggccgacgtggagcccaccatccaccatatgggcgattttcttcgtgcggaaaacgccgccgggcgcccgtggctgccggcaagccacaatattctgcgcgcgttcaccatcccgttcgattccatcaaggtgctgattgtcggccaggacccctacccgaccccgggtcacccggtgggtttgagcttctgcgtggcgccaaatgttcacccgctgccgaaaagcctgatcaatatttataaggaattggttgacgaccttggggtgcccatgcccaccaacggcgatctgacaccgtggacggaacgtggggtgatgttgctcaacagatgtctgactgtcggcgtcgggcggccaaattcgcatcagggcaaaggctgggaggaagtcaccgaggccgcgattcgtgcgttgaacgcgcgcacggacgccgacggcaagccccagccgctggtggcgattctctgggggcgtaatgcgcaaagcctcgagccattgctgaccaatgccttcattatcaaatcgcctcatccgagtccgctgtccgcttcccgcggattcttcggctccaaaccattctccagagccaatcaagccctagtcaccatgggtgccgacccggtggattggactctttaggcaggccaacagtcattgtgagtagttacagtggggggcatgactttgttccccacgcaaccgaacataccttcgccgaccaccgccgcacgaccggtcgccgttcccgcgcccggcgtgtcggctccgctgggtgccgatgacgccaaacgcgcacgtatcctggccgacgccattcgggcgaggttcgcccagacactggtgggtcaggataatctacgcgaatcgcttatcgtgaccttggtggccggcgggcatattcttatcgaatccgtgccgggcttggccaagaccacggccgcccagacgctcgccacctgcgtatccggctcgttcaagcgcgtgcagtgcactcctgatctcatgccatctgatctggtgggcacgcaggtcttcgattttgcgtcgcagaagttcaccacgcagatcggtccgattcacgccaatttcgtactgctggacgagatcaaccgttcgaatgccaaaacccagtccgccatgcttgaggccatggccgagggtgccacgaccatcggcgggcagcgtatcgccttgcccaagccgttcatggtgatcgccaccgagaatccgatcgaggaggagggcacgttcaacctgcccgaagcccagatggatcgtttcatgatgaaggccgtcatgacctatccttcgcccgacgaagaggctcggatgctggccatgctcacccgccgcggctccgatatgatcggtcccgacaccatcaccggcgaacgcatttccgtgtccgacgttgattttttgcgcaaggcggcacgccgcgtgcatgtttccgacgcgatcatgcgttatgcggtcgatatcaccgccacgtcacgaggtgccggctcccgccccatcaagggactgtcgtccttggtgcgtttgggcgcctcgccgcgcgccaccatcgccttgacccgtatcggccaggcgaaggcgttgctgtccgggcgcgactatgtggtacccgaggacctcaaggcgttcgctcatgaggtgctgcgccaccgtattatgctgacgttcgaggcactggccgatggcgtggtcagcgatcagatcgtcgacaagatcgtcgaaacggttcctgttccgtgagttccgattccgttcgcaagaagatcgaggcccttggcactcagctgagcctgcctaccgtaaggaaggctttgggcgcgctggagggcgaacacgcatccgggcgtcgcggcggcagcggcgatgcgatggatgtgcatgcctatgagccaggcgacgaatcccgtcttatcgattggaagaccagcgcccgccaaggccgccccatggtggtcgagcgcgagcgcctgtcgacgtcacgggtctggttgctgatggacgtgggcctggagatgactggcgtatgcccttccggagaacgcgcatggcaggttgccgccaatgcgctgcgtatgttcgccgcactgtcgttgcgccggtcggacgatatttcgctggtgttcggcgatgagtccagtatcacccgcgtgccgttcaacggtgggttcgcgcagttcgaacgcacgctggacaaggcgcttgaccgtgattgggatcatcaccgtaatatcgacgcgctgctggaatatgcgcgccgtatcaaggatcgcgaggcattgatcgtattggccaccgatgagcatgcgatggaggagcggcatatcaccacgatccgtcgtattacccgcacccatccgatggtgctgatcgatgtggcgacgatgaatccgttcaaggccgtctcatcccgccacgctcccaccgacggcttgagtgcacggcgtgtgccggcattcctgcgcaacgccaaggcagcggccgaggtcgatactcatcgcgcgtatatggccgcggctttggaacaggagctcacccgtgccggttcccatatcattcgatccgcatccagcgaatccatgttcgatcgtttcgtcgccctggtgtcccgggcattggcccgcaccacacgcaatagactgggtactgcacccgaactggtcggactgactttggctggtgatctatgatgcacagcatgttccccatcatcccgctcgccactgatcccggcgatctcaggcccgtggagtcgttggccttgaccactcccctggtggtggccatcatcgcatgcctgttgctggcggtaggtctgatcgcgttgatcatcatgctgtctcgccccgcacgcaaacctcggaacagcgaccgcgcgcgtggcgctcatagcaatgccagctccaaggccgagtggcgtgcccgcatcgacgatgtggtggcccgtcatgaatccggagcactgccccggcatgaggctttcgtcgaattgtccgtcatcgcccgtgatttcgccggtgccgcatcaggcaaggagcttagttccagtacgctgaccgatttggcgtacctgaatcgcacgcccgcgaatcgccaaggattggacgcattgaagcagaccattggcgcgttgtatccaccggaatttgccgatgatgcccgcaaccgaatcgcccagacgaccagcgtgcagcaggccgccgagtgggtggcgaatctggtggaaaggtggcgttcatgatgctggcatggcattggccttgggccgctctggccggcgtcttggcgacgctggcgattatcgtgctgattgtcgtgttcgcccgccgtaacgccgccgacgacacccctgtattctcgatggacgacgatctcaataccgagcacgcttcccgcctgttccgtcaatggcgcgctttgggccgtctcgccatcagcgtgctggtgcttgcgctggcgctggccattgtgctggtggctcgccccagccaagtggatgccggtgacgaacgcgcttccagccgagatatcgtcctgtgtctggatgtgtcggggtccacgctcccctatgatcgcgaggtcatcgacacctatttggaactggtcaagcatttcgagggggaacgtatcggtttgagtatcttcaactcgacctcacgcacggtgttcccgctgaccgacgactacgaactggtcaccaaacagttgacctccgccagcaaggcgctgaaaggcgtcgagtcgcaggatgacatcgataagatgtccgatgccgaatatcaggacatcgccaattggctcgaaggcacgcagaaccgcaaggacgccacctccttgattggcgacggcgtggtgtcttgcgcggcgatgctccccggtttcgcttatggcgaagccaatcatgcgaatgccgaccgtcagcgtgcggcatccatcgtgctggccaccgacaacgtcgtgtcgggcaagcccacctattcgctgaccgaagcgttggatttgacccagcagaccaaaatcaccgtggacggcctgtattccgggccgaaagccagtgaatcggaccaaaccacaacggatatgaagtccgcgatcgagtcgcatggaggcatcttcctcacccaatcgaatggcgcgtcgatagatgagctggtacgggatattcagtcgcgtagagatacggatgtggagaacaaggcgaaatcctcgatggtggacgctcccggtctgtggacgcttgctctggccgtgatactcattatctggatcgtatgtgcatggaggttgaggcgatgaacggattcaccttctcccccgccttgggctgggtcgccggcggactgctggcggccgggctcgccgtactggccattctcgaaatcgcattatttgttcgtcgccgtgcttccagtgacgagaccgtgtgggcttgcatacgacgtacgcttatgctgctcatcgtcgcggtgatggtactgactcccagcgtggtatcgtctaccacctcacaggccatcaatgccaccgacgtcatcgtggcggtggataccaccgggtcgatggcggtggccgatgccacatacgggtccgagaagaccattacccgcatcgatgccgcacgtcaggccgtgcatgatgtgaccgccgcttatccggacgccagtttcgcggcgttacggttcggtgcttcgggaacgcttgatgtgccgctgaccccggatgcgccggccatcgataattgggccaacacgttggcggtggaagccacatccgtgtcagcgggctccagtctggatgctccgatcgatcaattgctgctgaccgcgaagtcgattcgtgaagcgcacccggatgatgcgattgtgctgtacctcatcactgacggcgaacagacctcgaatgtgacgcgtcgtacgttctcgtcactgcgccagtatctcaatgatgggtttaccgtgggcgtcggctcgaccgagggcggcaagattcccgtcatcgccgatggcgtcagtgccggcgattccaacaccacggaccactgggtggtcgacccggataccggcgaacccggcatctccaagatggatgagaagaaccttaaagacattgccgacgagatcagtggcacgtatgtggccgtgaacgcttcacagactttggcggattcggtttcggccaagtcatcgaagcagtggcgcatgaccaccacggtcaaggagcgcacacgcaccacgccggtggtatggccgctggccattgcgttggcgatattgcttgccatggaagtcggtgcatggatcgcaacctcaaggagactgctgtgagaaacagtaacgaaatccacgagaacgatggctcggcgaatactcggatgcgggcgaagtgcccgctttggacacgtatcgtcctggcttgtggcgccgtattgctgttgctggttgccggcgtggcggcagtaaacctgtccgcttcgattacgttcaatcaggccaccgcatcattgaacgccaatatcaaagcggctcaggacgagtccacggatatcaccacgctcaaggcgcaacagcagcagaccgatgcgcaattcgccgaggccgggcgaatgcgcacgcttctgttgccgcaagtcaaggacgccatcgacgccaatgcttcgatttcttccgagctgacaaagatcaccctgaaacaggccgaggcgcagaacagcggttccgattccgggcaagcccagtcggcacagcaatccgagagttcctcatccaatgccaaaaagggcggcgcgttgaccgacgaacagaagaagcaggtcgaggagctgatgaaggccaatcagcaatccaccgatacccagtcgaacaccacccaatccgagcagaaagcgacgcagaacaagggtaccggggccaccaagccgtggtaagcagtcgttcacagttgttctttttctcacaccctcatgggtcatggccttatcgcggctgtttcccggtttcggctgtcggctttgacgtttgtccaatttttcgataggccatggctgatccaaggtatgtccaaacaggctatttgtggataatcgttacgactatgcacaacacttggggataacttcgcccaaaatcggcaagctagaaccacattggtcgttccggctggacaagcatgagtcctgtccttttagctggatatatgaatacctacaccagcaacccagcacccatcgatcccaccggcggctttgccgacaatacggtgacgccgttcgattacggcacttgcccttgccatgcggcggtacagcgtagtcgcgacctcgtgtccgtccagcgtgcggccacactggcgcaatcggaccagacggcggtggccgtgaaccgctccagcaacatcgtgtggaccggtaaagccgccgatctattccgatcgcggctcagtcgcaccgcacagtattcggccagtctcgcgcaagacatggagaccacccaccgattggcttgggggtcatcatgagcgagcacgattactggcaagtggaatcgtccgtttacggcggagtgggatatgcgccagccactcttgaagaatatgtcgtcatagccaaggctctcgatgacgaggcggcaggatttgcggccatagccacggcttgggaatcggccgcattacagttgcagtcacatcggcatagtgcgccgatgtgcgtcaccttgcagtcgggcgatccgagcgccgttgttcccggccatgtcactgcaccatatgccgcgctgggcaatcggtgttatgaccatgcaacggcatgtcagcggttgagcgatgatctgcgtggcgcggccgatctgctgattcgcgcacactctctgtattctcaggcggagatgacggctcggcgcatgtttaccgaattattgcaggccggcacacaggccaaaccgggatatgccgcggtgggtgttgccgctgtggcggcgggcggctttctggccggctggactattgacggcaaaccgaattcggcatggatgtccacgttcacctatccgttccaggaaggagtgcttagcggcgcgggcggaatcattggcggcgtacctatcggcaagagcattgcgcacaccgatgaggtcaacaaggctgcggggaaaatcgccaatttctccggcccggcgaaagacgtcgtccaaggcaatcatctggacgtgcgcgaggtgcaggcgaatgccgacgtcgtccgcgcaagcggatcggtggccgagtcaatggagaatctgcgcaggctcgccgaagagcggctcggcaaaatcgagctgaacagcggactcgaatatgggaccatcgccattcaacgctatgaacgatctgatggaaccaactcctggctggtcaccatcccgggtaccgatggacagcctgactcaccatttggctgggcgcagaacgtggaactgatgagcgccgatcaggagcgccgcaggaaagcggacagcgctcgcatggttgccgaggcgatgcgtcaggcaggcatcggcaaggatgagcccgtggcgctgatcggccattcccagggtggtatcgttgccgccacgcttgcctcggattgggcggaggaatataccatcgagcatgtggtgacagccggatcgccggtggccaatcatccgattccgcaacgcacgtgggtcaccagcgtggaaatcgatgatgaactggtcgccgcactggatggtgccgccaacccggtcaccgataactggctcaccgtacaagggcatgtatcgcccgcgcccgcggcaacaccatccacagtgcattcggacggctcatgcactcccggcgcaacgcccatcaccggcctgaccccatatgacgccgcacccgtggctggttcgaccaacggcagggagttgtcgcactggatcaaataccatcaggccgcctatcagaacgccaccgacctcggctcccccgccgtgcaacgccacgaagcccatttccaggaagttatcaacggagagctcaaggaaacccgctactaccaaggccgcatgacccagtccgcgaccattgcccctagcgagcgaaccaccgagttcagcacgttcggcggttaaaagtaaataccacacttgacagagttgtcaagaaaggagttaacaatataatgacgagtaggagatggctcatcaaactgatgaagcaagcggcagaacgcaagaatgtcacgtttgaaagtatcaggcaaggagggagtcatgagatattccaactcgacggacttatgattccccatcccacgacataacgaaatcgacaacaacctcgcggacattatttgcaaagaagcagaagccaaactcgggaaaggctggtatcagcagtgaaaacatatcaggtcatcgttcgccctggcgaaaaatactggattcttgagattcccggtatcggtttcacgcaggcaagaacaacagcagagattgaaagtatggcacgcgaccttatcaccgtcatgacacaagatgctgatttcgcactcaccgtagagacaaagctgccgcaatccgtgcaggagcatcttgatgaagctcggcgactgcgcaaggaagaagcggaatgcagatcgaacgcagcgcgggaaactcgcgccgcggcacaagaactacatggcatgggtctcgccctacagcaaataggcgatatactcggggtctcacggcaacgggcacatcaacttgtcaatgcttagcatcaatcggctaccccacaatgcaatcaccgcagagacgcggctagcgccactttcccgggattgttgcgccagcatgcccgaaccccccctctatcagcgcaacattcccgggagagtggcgcgcaaagagtgtcaggcgcgtcgctcgatgagtgcgcggccggatgcgaggcggtcgagcacaccggttttggcgatggccagcatcagataccaggccatcacgccgctgataagcacgccgccggtgacctcggaaatcatgtgcacaatgccacgcgggctgacgaatgacacacccacgtagcgaaacagcatcagatatgtgccgtattccaaggcgaccaacgcaccggatgcaatggaaatcggcagattgaacatgcggtaacgggtcaaggcgaacggaatctcagcgaaaacaccttgcaacagcgccgagataatcacgaagcccaaatcgaactggctaccaatcaccgtttcgaccagcgtgccgataaggttcacgtacagcgccgctccgggtttgcgcagaatcagcaccgccagcgtaccggagaagtaccagacggcgtgcacgatgctggcgaaaccgggcagaatcgcgccgaataccgaagagatcggcatgtacgcgaagttgaatccccagaagatcacgccgcaggccgcacccagcgtggcaccgaccgcgatatccaacggctgccatttcagtgacgatacggcaatcggacgtttcggaagagtatgaatggtggttgcaggcatggtgatctcctagccttaaaggccgcacacagtaatcgaaccacgggcgttccttgacctgtgcggctcgggcgggaacgccgcaccacagtatagccgctcggttcacggctggaagtacccttggaggttatgaagcttaccgatatttcccccgcaatcgcattgaccccactcgacggccgttatcacaaggccaccgccccgctcgtcgaatacatgagcgaacctgccctgaaccgcgaacgcatgcgtgtcgaagtcgaatggatgattcttctggccaacggctttgagggcaacggcaaccagccgatcgttgacggcgtcaagccgttcactgccgaagagcaggccttcctgcgcgccattcccgaggacttcggcgccgaaggcatcaagcagcacgccgctcatgaggccatcacccaccacgatgtgaaggccgtggagtactacatcgatgatcagatcgacaaggctccggccgagctgaccaacatcaacgacgagctgaagaccctcgtgcacttcgcctgcacgtccgaagacatcaacaacctctccatcgcccgttgcgtcaagaacgcgatggaaaacgtgtggaccccggagttcaagcgcatcatcgaccacctcgccggcaaggccgaggaattcaaggatatgccgctgctctctctcacccacggccagccggccacgccgaccacactcggcaaggagctcgccgtctacgtctaccgtctgaaccgtcagctcaagcacatcgaaaaccaggagtacttgggcaagatcaacggcgcgaccggcacgttcggcgcccacctggccgcatgcccggatgtcgactgggtcgccgtctcccgcgaattcgtcaccaaccgcatgggcctgacctggaacccgctgaccacgcagatcgaaagccacgactggcaggccgagctgtactccaccgtctcccacgccaaccgcatcatgcacaacctgtgtgtggacgtgtggatgtacatctcccgtggagtgttcgcccaggtgccggtcaagggtgccactggttcctccaccatgccgcacaaggtcaacccgattcgtttcgagaacgccgaagccaacttcgaaatcagctgctcgctgctcgacaccctctccgccacgctggtggaatcccgttggcagcgcgatctgaccgattcgaccacccagcgcaacatcggttccgcgctcggctactccttgctcgccctgaccaacctcatgggcggccttgagtccatccacccgaacacccacgtcatcgagcgtgagcttgatgagaactgggaggtgcttggcgagccgatccaaaccgccatgcgcgcctgcgagctcaagggcctgccgggcatggacaagccgtacgagaaggtcaaggagcttatgcgcggccacaccatcaacaaggaacaggtcgagcagttcatcgaccagcagtccttcgacccggaaaccgccgctcgcttgaaggctctgacccccgccacctacaccggtgtggccagccagctcgtcgctttcgaccgctgaaataggtgcgatgcgagtccctcgagcccctcgaatccctcgcatccaccacactactgcgctgagtcacaaaccgaaccgcaaactgaaccgaacaaggacaggcgtcaggtaaccatttcatgactactgaacaggatcagtccactacggaagatcgcccgaacaaggcgacctcctccactaccgaccggccgatcgcctctggtgacggccggtcggccagttttgctgtcagcggaccggacagcccggcaaccgacgacagcaacgattccggaccgtacatcgacgacatcgctccgcgccgcacgcgcgacttcggcgatctgacccgggccggtctgtcgctgttgatggccgccgtggtcatggtgttcgccgtgtatctgggcggcatgacgcgcggcgtcgaatccgacgcacacaccgcagcccaggtcatcaactggttggctgacttcccctccaccgtgctgacgcagctggccaccacggtcatcgtagttatcgtgctcgctcagttgctcttggcccgcgaatggctgcaagctgcggtgtccgcgctggccatgtttgccggatacggcatggtgtgggtcatatcgacggcaatcagcagtctgaacgatttcaccctgccaatggcactggtctcagccgccacctcatacggctccgggctgttgcccgacatctacgccggcatggcgtccttcctgaccgccgccgggccacgccgtacccgctccacggtcaaatggagttggaatatcctgtatgccatcgccgcggtgatggtggtgctttcgtggcattcggttaccggcatgctggtttcgatggccgccggtcgcacggtgggcatgcttatccgattcgtggtcggcacgcagaataaaggcgtgtggggcaaagatctcgtcgcagtgctctcaagcatcggattagagaccacctcactcatccggcatcaggagcccggaatcagccatggctcattgtctgccacgttggatgacgatttgacggaaggctcgcgcatctacgatgtggagaccgcgaataaccgtcgttttatcgtttccgtcatcgacgcgcaaacccataccgtcggctatctgaagcaactctgggattgggtgcgttttaccagcgtgtccattcgacgcgatcgttccgtgcgcgacgccgttcagcatcactttgccatgctgctcggcctgcacaatatcaaactgcccgcgccctccccatacggcatcgccgatacggacgagtccgcgattctggtgctggatgcgcacaccatcgagttgcccgccaacctgaacacgcttaccaaggcggatgccgtagcgtatatgcgatatctgtccgtggcaaatcgccgtggatatacgcaccgacgcatcacgcctgatacgctcgcccggctcgaagatggcactgcggttatcgccggctggctgaatggcgacagcgcttccggcccggccaataccgcacttgacaaggttcagctactcgcgttgttcgccgcactgatcggcgtgaaaccggcagtcgcggccgcccgcgaagcttggggagacacgacgttgaccacgttggccccgttcattcagaaagtcgcggtcccctcccccacacgcgcattgggcacgtgggacaagcagctgctcaaggaactgcgagaccacatcaacaccataatcgatgaggagaccgccgaatccgccgagccggtgacgctggcccgcttctcttggcgttcgatgatcaccatgctgctggtcatcgtggccgtggtcgtggtcttcacccaactgaagcccgaggagatcatcaccgcgctgaccaacgccaacccgttgatggcggtggtgacgctcgcgttcggtgtctgcggctggatcggctcgtcgatttcgctcggttccctgatggcgcggcacaagcgtgacaatatgggcgtcttcatgagccaggtggcaggcggcttcgccaccgtatccatgccagccggcgtgggcccctcgttcgtcaacctgcagttcctgcgcaaatccggctatcgcaacacccaggcgaccgcaattatgagcgccgcgctcgtggtgtattacgccgtgtacttctccatgctggtcatcatcggcctgttcaccggccgcaacatgttctccggcgcaatcccgacaaacacgttggttatcgtgctgggcgttgtggtcgtggtgctgtccattgcgatgatgattccgccgttgcgccactgggtgacccgtcgtcttatgccgctggccaagacgtatatcaaccagctgctggacgtgctttcccagccccgacagctcacagtcagctgcctaggcgcgctgttccagaacgcgaccactgggctcgctttctgggcggccctgcaagcgttcggctattcatcgaatccgattgaaacgacgttcgtcttcctgctggcctatgcattgggttccgcagtgcccactccaggcggtctgggcggtgtggaagcggcgctgacattcgcgttcgtggcggtcggagtgccgcagggcgtggcgctttccgccactttgctgcaccgcgtggtgttctactggctgcgcattccgctgggcgcggcggccatgaagtggcttgacaagcataatcttgtctgattcgtctattttcatacccccttcggggaaatagatgtgaaaacccttataaaacgcgggttttcgcagaaacatgcgctagtatcattgatgacaacatggactaagcaaaagtgcttgtcccctgacccaagaaggatgctttatggcatacaacaagtctgacctcgtttcgaagatcgcccagaagtccaacctgaccaaggctcaggccgaggctgctgttaacgccttccaggatgtgttcgtcgaggctatgaagtccggcgaaggcctgaagctcaccggcctgttctccgctgagcgcgtcaagcgcgccgctcgcaccggccgcaacccgcgcactggcgagcagattgacattccggcttcctacggcgttcgtatctccgctggctccctgctgaagaaggccgtcaccgagtgaccttctgctcgtagcgattacttcgagcattactgacgacaaagaccccgaccgagatggtcggggtctttttgttgtggtgctgtgacgtgttgtccaaccgtattattccggactagttcagcgcttccataagctgctcgaatcccagggtgggctcggcctcgaagggatcgaggagtatggcttcccggcgttcgggggcggtcagggtcaggtgggtccagtcggcggagaactgggctccgacgttcagggccgcgtccacgaaccggccacgcagggcggcacgggtgtcggtcggcggattgtgcacggcgtattccacgttgtctcctgtcagcagctcacgcatctggttgcgggctacgagcgaaccgtacaggcgaccgttggcgatgtcgtggtagtcgagctcaagctgttccatctgagcgaaggtgacgtccgggcgacggcgtttgagcgcgtcgaacagacgcttcttggcggcccagtccacgcggtcggcgagcgcatcgtatgcaccacgctccagcgcgtccagaacgcggctccactcccccataatcgtgtcgatcgtggtggccggcagcgaacttgccagcgcatcgccatgggtttcgatgaaggccttgaccgccgcataataccggcgctgcagacccagtgcggacacggattcgcctgattcgagcgtcagttcggcgcgcggattgtcaaggaatcgactgaccgtgcgattggcggcagccggatcagcaaaggcatactgctcgaatccggacggaacgccatggcggaaggcgtcttcgatcgcgcacagcacaaggtgcgtgacggcaagcttcatccatgtggaccattgcgaacggttcgagtcgccgatgatcacatgcagccggcggaaggagtcggggtcggcgtgcggttcgtcgcgcgtgttgaccatcgggcgggagcgggtggtggccgaggagacggcctcgtccaggaagtccgcgcgctgggtgatctggaagccgtccggggtcatgcggccggcaccggtgtacagctggcgggtgatgaggaacggcagcagctggtgttcgatggtctccaacggcacgaagcggcggaccaggtagttttcgtggcagccgaaggcgtggccggcggagtcgacgttgtttttgaacacatggatcgtggcgtgtgcgccgtaggattcgcgcagcttgcgctgggccttcagggctaggttgcgcatcacgtgttcgccggcgaggtcctgggccagggcctcgcgcggatcgcgcgcttcggcggtggcgtattcggggtgggatccgacgtccagatacagacgtgagccattggccagatacgtgttggtggagcgggaacgggagacgatgggctggaacatggtcatcgccacctggccggcgtccacggggcgttcggcaccggtgaccgccacgccgtattcggtttcgacgccgaaaatacggcagaacccgtccatctcggcggatggtacgggttccgtggcgtgcagggagcgggtgccgctgtcacgcagttggggcatcactcgccgcctttttgcacgaagctgttgacgtattcctcggcgttggtttccaaggcggattcgatgtcgtcgaggatgtcgtccaacacgtcggcttggtcggtggactcggtttgggcggcggcctgcgtagtggcgagggcgtcgtcttcctgggtcgcggcctgctgtgcttgaggttgttcgaattgttgtggcatgttgtcttcttcttgggctgtcaaactcccctcagtcagccttcggccgacggctcccctcacccgaggggagccggaggagacaggaattatcgaattatcgctggttgatggagtcgggccacggatactggtgcaggtaatgctgtagttcgcggatgatgagtccgttggaggccactacatcgttatcgtgacgccagtggatgcgttcgccgtcccaacggctcagcgtgccctgcgcctcccagaccaccacggtgccggcggcgatggcggggatatcccacacgtgcagcatcggctcgaagtaggcgtcgtaggtgccgtcggccactttgcacaggtcgagcgaggcagggcccacacgcttgatgtcggccgggcgtccggcgagcgaggatgccacgtcgagcgcacgctgcgattcgccgggcaagaaggacatgccgtagcccagcacggaaccatccagtgaggaggtcatcgacggcacgactttgtcgcgcttttcgccgaccgtggttttgtggatgcgcacggcgcccgctcccctggcggccaggtaggtcaggccgagggccggggcgtgcacgatgccgatgatcggcttgggctcattgtccgggccgaattcgaacagggcggcggtcactgtccattcgctcatatggcgtacgtagttgattacaccgtcgattttgccgatgtaccagtaacgctggccggggcggctttcggcgggtcgggtggtccagaagccgtcgaagtgggcgatgtcggcgattctggagctcataaagcgcaaaatcttgctgtcgacttcgagcttatagcggggaccacgatccgcgttctcggcgctcggctgggcgaggttacgcggattgagctggtcgtggagggcatgctgaccggcttcttcgagaaggccggcgactttgagcgcaaggttgcgcaggtcctgtggggtctcttcgcgtgtttcttccatagctaccaagtctatcgttcggcgttgatggccagcgacttcagcagatcgatggcgtgttcggccgaattgagttcggtttcgcagcgcgccttggtgaaggcgagcggatcggagatgtcgagggagaacaggtgatggtcggtagcggccatatggccggcattgccgtagaattcgacagcctcgccctcgtctgcggcgcgcgggtcgcgaacagtgagtcgggaccagctggcggcggccacctcatcgccgaattgcgccacgagttttgccctgagccaggcgcgggtgtcttccggcggttcggtagtggcgcgtgcgatgtcggcggcgctcaccacccgttcggtgcggggttcgagtttggtgaagatgctgtccgcggggtcgagcgccgcccatttcaggtcgatgaccttcagtcgcgggtcgttccagccattggccacgctgggcgcagctgccgcggtgattttgcggcgcagtttttcgagcagctgccatttgagcagccattcgatgcggctggcctcgccggtcatggccagacgttcgtcatcgccggcggtgtgacggatggaggcgcagtcgatgagcgcctgctgccacatcgccatgatggatgtggtggatttgtccggccaggcgggctcgccggcggtgtcggtgccttcgaccagtgcggcgacctggtagacggcttggcgcagtttgagctggataagccatgcgttggtttcgccgccgttggccagcggcaggcttgcgcccagcgtcaggtcgtgggagacggtgtgcatggcttcgactgggtcagacagttcgagttcgtcgaggaaggcgttcagatcgaatccggcttcgtccgcgtgttcgagcagccacagcagcatgctcgtggtgccgagtttcagggcctgcggtacctccatacggttggcgtcgccgacgatgacgtgcaggcggcggtattcgtcggtggagtgggattcgtcgcgcgtgttgataatcgggcgttcgaaggtggtttgcaggccgactttgacgtggatgtagtcggcgcgctggctgagctgatagccggggatttcgctgttctcgccgattcctacgcggccggagccggcgtagatctggcgggtgacgaagtggagggtcatcaggcgcgtgactaggtcaaatggcactgagcgggccatcatatagttctcgtgcgcgccccagcaggagcccttgccgtccacattgttgcgatgcagggcgatgggggcgccggtctgtgtgcgggcgcgttcggtggcggcctgcatgatgaggtctccggcacggtcatagcgggccgcttcgaacgggtcggtggtttccggtgccgagtattcgggatgggcgtggtccacgtagacgcggccaccgttgggggcgatcacgttggtgatgttgagttgtggggcgtcggtgagcatgtccggtcgggcggcggcacgttcgagtcgggtgccgcgcgcgtcgttgaccgggtcctcctgccggtagtcccagcggatggatttgctgtggctgtccgcggcgccgttcaccacgtcgaaggacagttgcaccgggttgtagcggtccggggtgttcagggataccgcgtattcggtttcggtgcccatcactcgtttgacggtcatgtagtgctccttgagcttgagctattcggcggtgcggatgcggcggatcgggtccatgccgttgatgcgcgaccattgttcggggtccacgtcggccatggaatcgcgggtctcgcggtattcgtcttccacggcggcggcgagcaacggcacggtgagtgccacgtccgagccggtttcgatggattccttgaccgctcgggtcttggcccggtccacgatgttcttgagcatcgcgccggagaccacatcggccaggaacaacgcatgccactggccgttctcctcctgcacgtcgcacagatggcggcgttcggaggctccgtaaatgtcatgcaccagcacggcggacaaggcgtgcgcgtcgacgccatcttccagaggcaggtcgtcggtcaagtaatggtccacgatggcgatggcctgattggctttgggccgaccaacgcgaatcttgacgtcgagacgccccggtcgtagcacggccggatcgatcatgtccacgcggttggatgcgccgatcaccatcacattgtcgagtgattccacgccgtcgagttcggagaggaactggggcacgatcgtggtctccacgtcggaggagacgccggagccgcgggtgcgcagcagcgaatccatttcgtcgatgaaaacgaccaccggattgccgtccgcggcgcgttcgcgggcgcgctggaagatcaggcgaatcagccgttcggattcgccgacgtatttgttgagcagttccgggcccttgacggacaggaacacgcctttaacgcgggtttcggccgggctgatcgagccgtcgccgttcgtatcgtcccccctcgcacagggcgttcgccacggccttggcaatcatcgtcttgccgttgccgggcgggccgtacagcagcacgcccttcggcggcttcaaatcgtaacgctcaaacagcgcacgatgctggaacggcagttggacggcgtccctgatacgaccaatctcactatccaagccgccgatgtcggcgaacgtgacatccggggtctcctccagcaccagatccttgtcgccctcggcgggcagcgcttcgatggcgaggcggacggacggatcgacgataatacggtcgccctgattgatgcccgcatacgcgagcgcgccggaacggcggatgagcacgggattgccggaggcgtcggtaacgatcagtcgaccgtcgtcaagtacctgcttgacactgcgaatctggcccacggtgtcagcatcgcgctgctcgaccagcacgagcttctcgttgagcatcacggtggccccggcggtcaggcgggcggcgttgacgttggaggccacaggcaccaccatgcggcgggtgccggaaatgacttcggccgacgcgtgctggatgccgtcttcatcggtgcgggtggaatcgaccttgaccatggtggcgaaggtgagcggcggctgagcgagctgggcgagctgtgacttcgccttggtcagttccttgccggcgcggctcagcgcttcggcgagcgcatggttcttggccatcaggcgatcgttcagcgcggcgagatcttcggtgtcgctcatgcgggttcttcgcttcccttctatccgggattttcggcaacttatggcagtcggcagaccctattcgttgccgtcggaggatttcctgttacgtattacagtacgcacttttcgcaccacgaaccatacgatgatcacaatcacggccgcgatgaccacgtcctcgaacacgccgagcgcgccttgaatcgagcaccactggtcgccgagcaggtaaccggcggaaacgaggatggtgttccacacggccgagccgagcagggtccagccggtgaagtgcaggaagttcatgcggttgaatccggcgggaatcgaaatcagcgagcgtaccacgggaatcacgcggccgatgagcaccgaccatgtgccgtatttggtgaaccagtcgttggctttgctcacgtctttgcggctgacgccggggattttgtctgccgcgagattgatgcgatgcaggcccacccagcgggagatgccgtacaaggtccaggcacccagtacggagccgatggtggcccagatgattgcgcccggcagactcagggtgccgcgtgcggcggtgaagccggagagcggaaggatgacttcggacgggatgggcgggaagatggattcgagggcgatggccaaggccacgccgataccgccgatggtttccatcagcatgatcagccagtcggtgatggtgccgatcaggccgggttcggtggtggtgcagatgggtgtggggtcggttgcaagaatagtggcggctgccatggaaaaactcatagagggcattgtcccaaggttttcccagaatcagaagcatgacgcaagaagatgtgcattttgttgacaagtccgccgagagcgaagttgggagcccggctgattctgcggtttctgtgccgacgctgagcaagcccggcctgctggttatggatgtggactccacgctcattgacgaagaggttatcgacgagttgggcgtggtggctggctgcggtgaggagattgccggagtgaccgcacgcgccatgcgcggcgaactggagttctgcgatgcgctgcgcgcacgagtggccctgttggagggcctgccgatctccgtgttcgacacggtgcatgacaagctgcatttcaccaagggtgcactggagcttatcgacacgctgcatgaacacggttggaagatcggcgtggtgtccggaggcttccatgaagtggttgacatgttggcggccgagggccatatcgactattggattgccaaccggcttgaggttgccgatgggtgcttgaccggcaaggtgctcggcgaaatcgtgagcaagactgtgaagttacacgccttgcagacatgggcggaccgtttgggtattccgatgagccagaccgtggctgtgggcgatggcgccaacgatattccgatgattcaggccgccggtttgggtctcgcgttctgtgccaagccaaagacccagctcgccgccgacaaagccatcaacgaccgcgacctaacccacgtactcgattacctgcgccggtaaaattttaccgacctcggctccggcacttatagttgagccatgactacttcaggcgcagaacagttgacgcttgcggggctggctccccgcaagcgtcgtaaacgtgcgcctgcggagcatacgccggccgagcagcatcccatagcgcaagtcgtgctggatgtgcaggcgctccacctcggtcagacattcgattacttcattgatgaaaaagacagcgaggccgcacaaccgggtgtgctggtgcgcgtgcggtttggcggtcagagggtcagcggtgtgatttgggcacgcaccgataccagtgatacgccgcgctcttcgattcgctatatcgagcgagtgctaagccccgatgtactggttcccgcttcgatgcgcgaggatatcggtctggttgccaaagcctatggcggcacacgggccaatattctgcgtttcgccgtgccaccgcgcgtggccaaggtggagaccgagcagcggttggccgcgtcgttccgtcggccggtcggcggctcattgccggataatacgcaaggcggttttgccgggcgtggcaccaatcccgatgggaccaaacttgctggctctacctttgccgttgctagcaccgtttcggagggagctgcgcaggggtatcgtcgtctgaccgccaattacgccgatgtcaatgtgcttcatgacgcgcttaccggtcaacgtttccaatcttttgtgtttgattcgttgcccggtgcacaggagtggcaacgaaacatggcatggatggtggccactgcgttgagtgccggtaaggctgccgtagttgaattgcccaccatgcgcgaggtcgaagacctgatgcatatgctacgcaattatggactcaaaccatttgcccctgctccggccggcggctgggtgggcgacgtcgccgtgcttaacgcggagaccatgcccgcggccgaccggtatcgcacctatctggctgtggcgttgggacaggtgaaggtggtgatcggcacccgtgcggtgatgtatgcgccggttgaaggcccggcgctgttcgccattctggaggatgccgcctatcagaacatggacggtatgatgccatatccacaggcccgtggcgtgatgcggctgcgcgccaagtcccatggcggcgtgttcgtggccatggccaatgcgcgcaccccgcaaagccagtgggaaaacaccggtccaggtacagtggagaccccagtgagcggctattccaccacaattcatccgctcgcctcgccgctgaaggacgccactccttgggtgcgttggctcaatcgcgatgaacttgcgcgtcttgccgacccgtccatcggggcgcgcgtgccgcatacggccgtccacgtgctatctaaggctttggagagcggccccgtgctgctgtccattccgcaagacagcgtcagtgagactctgagttgtgcgaaatgccatcgtcaggcgcgttgtgccaagtgttccggaccgttgcaactaccggccgaccgccgggattccacaccgcgatgccgctggtgtggggctgctgccatcaattggaagtgcccgggctgtgggcatgaacgtatgcgtgtggtgcgcgtgggtgctgcaggcactgcggctgaactggccgggttgttccgcggcgtgccagtagttttgtccagcaagacgcagggcctggtgcgcgatgtggcttgccagccgatgatcgtcatcgccactcccggtttcgaaccgcgcgtgcgtccggtcagtgccgagcagggatcggctggccatgagtatcgtgccgtggccgtgctcgacgcttggaccagcttgtatgcgttgggcgtggatgctcgcttggatacgttgaccgcgtggatgcgtgcggtgtcgttgtgcgcgccgcgttcccgtggcggccaggcgttgattctcggcgaaaccgacccggccctcgcccaatcgctgatgctctgggattcgaggattcttgcagccaaggatcttgaggagcgtgtggagaccggtatgccgccggccgtggccgccgcctgcgtatggggacgccgtgatgcggtgatgacgctgatgcagcgtatcggcgcgctgggcggcgattggacggcctgcggcgagctgcccggcatgttgggcccggtgccgatcgcgcaaccggacacggtcgacgcccgggagctcgaagccacggccgaccgggtgaaggcagtaatccgtgtgccgcagagtcggcgagccgagctggcggcccgactgcaccgggaaaccgctcgtcatgtggcgtcccgcgaacccggcgagcttcgcttccgagtagatcccaaggacctgatctaatcgtcttcaacacgtgaaacgataattacagaatgaacatcgctagaaggaggacaccatgaagggctggcctggagagccggatatggattacgacgtgctggtcgcggacggcgaggccgctgcgaacgccggcaagccgatcaccgacgtgatcttcgatttcggcaacgtgctgatttactgggatccggccgccgtactcatcccccgctacagccagaagaccatcgacgaattcctcgacaacgacatctccggcttctacgatgtcaacgacctgatggacggcggcaccagcaccgacgaggccatcgccatcatgcgccgtgacaagggcgataagtgggcggacatcctcgactactacatcaagaacttccgcgactccctgaccggcatcgtgccgggcgcgcgcgtgctggtcaatgacctgaaggctgccggcatcggcgtgtggggcctgagcaactgggaatccagtctgttccacgtggccgaggaacagtgcgatattttgcagcagcttgatggcaaactcgtctccggttttgtcaagctgcgcaagccacacaaggaaatctacgaggccgcgttgaaccagttcggcatcaaggccgatggcgcgttgttcatcgacgacaaggccatgaacatcgtcggctcgaatgcggccggcatccgtggcgtacgtttccaggatccggtcaagctgcgtgaactgctcatcgccaatggcgtgaacattccggccgtgcagtgagcatcgacgttttaaggaggaccatgctcaaactcgtgttcgccggcacccccgatgtagcggtgccctcgctcaaggcctttgccaccgatccacgttttgatgtggtcggcgtcattacccgccccgatgcgcctaccggtcgcggccgcaagctcacgcccagcccggtcaaggcgacggctctggagctcgggttgcccgtcatcgatctcaaaccccgctcccccgaattcatggaggcgttgaacgacctgcatgcggatatcgccgctgtcatcgcctatggcaatatcctgcccaagaacgtactcgacgcagtgcccctgggctggtacaacctgcatttctccaacctgccgaagtggcgtggcgccgctcccgcccagcgtgcgatttgggcgggcgacccgaccaccggcgccgacgtgttcaaggtgggcgagggtttggacgatggcccgatcgtcgcttccctgaccatcgagctgaccggccgtgagacctccggcgaactcctcgaccgtctggccgaggaaggcgcacccatgtatgtggatgccttggccgccgtgggtgaaggcactgccacattcaccgcgcaaccggccgaaggcctggaatacgcgcacaaaatcacggtggaagatgctcgtatcagctggacggacgaggccgaggccatcgaccgtcaggttcgcgcctgcacgccacatcctggggcatggaccgaactgtttgcggaggggccaatcgccgataatgacgagccggccgccaaacccctcaccctgcatattctcgccgcgcaaccggccgaccagtccaatcccaacactccggccgagcttcagcccggcgagctgaaggtgggcaagaagaacgtgtgggttggtaccggcagcacgccgctggaactcacccaagtcaaggcgcagggcaagaaggccatgcgcgccgccgactgggcccgaggcgcgcgcctctcccccgccgcctgcgtgcgataacaagcaatatcgctcccgcccggaagcacagcaaaaagcccggcatcttcgcgaggaagataccgggcttttcagctatgcaatcggcgatcagtcgagaccggagagcttgttgatcagctccgggtcacgcgtcgcacccttgtcggccgagcgggcgaaggcggcgtacgccttcagcgcctgggagacgtggcggttgcggtgagccacgtagccgtcgccagcctcaagctcgcgacgacgctcgtccagctgctcgtcagtcagttcgacgttcacggaacgggcttcgatatcgatatcgatgatgtcgccgttcttgataagcgccaccggtcccttattggcagcctcaggcgccatgtggccgatggccagaccggaggaaccgccggagtagcgaccgtcggtgagcatggcgacctgcttgccgatgcccttgcccttgacgaaggaggtcgggtacagcatttcctgcatgcccgggccacccttcgggccttcgtaacgaatcacaagcgccatgccgggcttcagggtgtcgttcagaatgacctcgatggcctgctcctgggagtcgaccaccagagccggtccacggaacttccagatctccggcggaacaccggcggtcttgaccacgcagccgtcgggggccaggttgccgcgcagcacggcgaggccgccttcgtgaatctccgggtggttgatgtcgtggatggcgccgttggcgcggtcacggtcgagcgaatcgaacagggtggtgtgggtccacggctccggggagatgatgtggccaggagcggccttgtacatctgctgggcttcctcggtgcaggtcgggcgcatgatgtcccaatcggccagcttggcttccagcgtcggatagtcgatggagtgcacgttggtgtgcagcttgccggcgcggtcgagctcgccgaggatgccggtgatgccgccggcgcggtgcacgtcggaaatctcccacttgccggacggcgaggccttgcagatgcacggcacggtgtgggaaatacgctcgatgtcgtccagggtgaagtccacgtcggcggactgggccatggcgaggatgtgcagcacggtgttggtggaaccgcccatggccacatccatggtcatggcgttctcgaaggcttccttggtggcgatggagcgcggcagcacggaatcgtcggaatcgtcgtagtactggtgggcgatcttgacgacctgcttggcggcacgctcgaacaggtccttgcggtaggagtgggaggcgaggatggtgccgttgccgggcagggccaggccgatggcctcggtcaggcagttcatcgagttggcggtgaacatgccggcgcaggagccgcaggtcgggcagacggtcttctcatagttgagcagttcctcatcggagacgctgtcgtcggcggtggcgtacatcacgtcgataaggtcggtgctcttgacggtgccgtcggcgagcaccgtggtgccggcctccatcgggccaccggagacgaacacggtcgggatgttgaggcgcagggcggccatcagcatgcccggcacgaccttgtcgcagttcgggatgcagatgagtgcgtcggcacagtgcgcgttgcactggtattcgacggtgtcggcgatgatgtcgcgggagggcagggagtagagcatgccggtgtgacccatggcgatgccgtcgtccacggccatcgtgttgaactcgcgcgggatgccgccagcttccttgatagcctcggaaacgatgcggccgaccttgttgaggtggacgtggccgggcaggaactcatcgaacgagttggcgatggcgatgatgggcttcttgcccatgtcgtctccgttgacgcccgcagcacggtagagggctcgggcgcctgcaaagacgcgccctgacataatttttgcagatcgcatttcagtcatggttctattcaagcccttgtgagggacacgccacttgtcaagagtcgaataatggaatttgcaaaagcgtaacgtttctcacacatatttttggaatacattcctccactggaagtctggcggaggtccggcagaagtcccccaaacggctacacttgcttcggttgagatagattttccaatgtctggagataagaacaatggcttttggtactgacccgacacccgacggtcttgcgaacccgccgatcgacgacctgatgaagcacgccgattccaagtacgcgctggccattttcgccgccaagcgcgcacgccagatcaactcctacttcacgcagctcaacgagggcctgctgcagaacatcggcccgctggtcgaataccagaacaatgagaagcccctgtccatcgccttccgcgaaatcgacgagggcctgcttgaggagaccttgggcgaggacgacgccaacgagggcaactgatcgattccgacaattcgtttggattgtttggacagttcgtcgccgaatgatggtgtgagagttctctcacaactgattttgagcgacacgcttgcctgagttatcgcaatcggctataactcaacatcgggagcgaataagacgcaaggctcgcgccaccgcgctggttggcacgagcctttatttatgcccgcttccacagtgacaagtaaaaattgacaccgtatcattgtgcctcgcatcccgcggggcgataagtcctgaagaaagggatgatatgacagaagaacatcggcttatttccgccgaatccgtgaccgaaggccaccctgacaaggtctgcgatcaaatctccgacgccattcttgatgatttgctggcccaggattcgtccagccatgtggccgtggagacctccgccgccactggcgtgttcctgatcttcggcgaagtcacgtccaaggggtactgcgacgtgcagtccaaggtccgcgaaaccctgcgcaacatcggctacacctcctccgaagtcggccttgacgccgattcctgcggcgtggtcgtggccatcaccgagcagagcgccgaaatcaaccagggcgttgcccgtctgactggcgatcaggagaccgccgccagccgcgaagagcgttacgaagcacagggtgccggcgatcagggcgtgatgtttggctacgccaccgacgagaccccgacgctgatgccgcttccgatctacttggcacatcgcctcgccttccgtctgaccgaggtccgcaagtccggtgaagtgccgcacctgcgcccggacggcaagacccaggtaaccattgagtatgacgataacgataagcccgttcgtctggacaccgtgctgatctccactcagcacgatcctgaggttacgcaggattggcttgctgttgagctgaagaagcacgtgattgacccggtgcttgatgaggtgctgggttccaaggtgccgcatgacaactaccgccagctggtcaacccgaccggttcgttcatcctgggcggcccggcggccgacgccggtctgaccggccgcaagatcatcgtcgacacctacggtggcgccgcccaccacggcggtggcgcgttctccggcaaggacccgtccaaggtcgaccgttctgccgcatacgcgactcgctgggttgccaagaacatcgtggccgccggtctggcccacaaggttgagatccagatcgcctacgctattggtgttgccgacccggtatccgtcaacgtggagaccttcggcaccgagcaaggcgtgacgcgcggccagatcgccgccgccgtacgcaaggtcttcgatctgcgccccgctgcgatcatcgacgagctggatctgaaacgtccgatttatctgaagaccgccgcgtatggtcacttcggccgcacggacgttgagttcccgtgggagaagaccgacaaggtcgaggagctcaaggccgcgattggcgcgcagtagacgttggcgcattcttgcgtcgcaccccgtgcggggtgcgacgcaagaatggactccatgtcccaaaatacgaatactccgcccgtcccacggcatcgattgcacggtacaatccatccgtatcttccccgatacgcaaccgctgaagcgacatgccagcagatcactcactcttgagttatcaaacaacaagaagaacacacaccgtccccaaaaaccataatctgcggcgcaaacgacccagtgcttcatgagagctcagagctcacaccgcacaagacaacttgacagaatacaacgagcatcgcgaacgactgtgccgtgaactgactcaccgccagccagctcaacagcggcgcgattccgccgagcgtcaaggcggtgcgacatggagaatgggacactttaggcacagattcgtaagcaggaatctggctttgctgactgtgcacagcgtgaatagctcttactctgatcacattgctccaatgcatccgtccggctaaatgattatttagccaacttgtgtgaaacgattgccagtagatactgtaatgacagaaattcacgtcttcgagatatctgctatcaggttgctgaccacgtcgattatgacaacgcgaatcaggagacttacgtttcgactgagtcactaatgcagaacaagggcggacggcaactggcgtcttcgctcccagcaacgggcaagattacacggtataaagccggcgacactctgatttctaatattcggccctattttaagaagatatggtacgccccgtttgaaggtacatgttcgggtgatgtcatcgtttttagagcgaatgatcccagcaacgcgccatatctgcatgcatgcctacggcaagactcattctttgactacgtcatgcaaggtgcgaagggaacaaagatgccccgtggggataaaaaacaaatgatggagttcaaggttgccagttcatgcagtacgaaagatttgatcctattagattccgcaataaagcaaagatctgataacgattcagagacagtaaagctccaagcactgcgcgatacgctccttcccaagctcatgtccggcgaaatcgacgtttcgaaggttgacctcacgcagctaacaaataatcatttgccagcgcgtgggcacaatgttcctaactgttattggaaggaacccctatggaaaccatcattaatagtgttctgtcgcagatgcagaacatgcttgatccgtcacagctcaaacatctggccgaagtactcagagtcacgctgctgccaactcaggaaacatcagcgccgcagaatctgctgacgctattcctcacggcaaaagaggtcgaaggctgctcgccgaaaaccatcgcttactatgagagcacactccagcacatgacccaggccctcgccaagccttgtacgcggataaacagcgatgacttgcgcgagtacctcaacagatacgagaacgaacgtcatgcgggcaaggtcaccatcgacaacattcggcgtatcatgtcaagcttcttcgcgtggcttgaggacgaggattatatcgtcaaaagccctgtaaggcgcatccaccgtgtgaagaccgctgtaatggctaaggaagtcctgagcgacgaaaatctggaaactctgcgggaccgatgcggcaccttgcgggatcttgccatcgtggacattctcgcatccacgggtatgcgagtgggtgaactggtcggcttgaacatagccgacgtgaatcttcaggagcgggaatgcttggtcacaggcaagggaaacaagcagcgtcccgtttatttcgacgccagaacgaagcttcatctcaccgcatacctgcaatcacgtaacgacagcaatccagcgctattcgttgctttgaatggcgatggtgaccgtatcagcatcggcggcatcgaaagccgcctcagacagctcggcaaagatgccggcattcatcgagttcatccgcataagttccgtcgtactctggccacgcacgccatcgacaaaggcatgccgatcgaacaggtgcaaaaactgctcgggcatgcgagaatagacacgaccatgcactacgtcatggtcaaccagaacaacgtgaaagcttcacacagaaggtatttggaatgagctggcgagagacgacccttggtgagattaccgacttaaaaagaggatttgatttgccgaaaagccagcgtttgcaaggggatgtgccggtttattcatcatcgggaattaccggatctaatagtactgcagcagtagaggggccctgtgtaatcacagggcgatacggcactatcggagaagttttcttttcgggtggtccatgttggcctctcaacacagctttgtattctaccgaattcaacggcaacaatcctcgatttatttattatcttttgcagacaattccttggcagggatacacaacagctagtgctgtgccaggcgtcaatcgaaatcacgtgaatctctgccctgtcaagatacctgacagggcaacgcaagatgcaatcgtagaagtgcttgattccattgtcgacaaaattgcccttaataatcggctaaatgattatttagagcagcttgtagacggtaagtttcaagagttgtttggtggtcttaatttcaacgctacgctctctgatgttgccgaaataacgatggggcaatcaccagcaggaagttcgtataacgaagaaggtgctggcataatcttctatcaaggaaggggtgaatttggatggcgtttcccaaagcgtcgtctctataccactgagccaaaacgtttagcctgcgagggtgacgtcctaatgagcgttcgtgcgcctgtcggggacctcaacgttgcctttgaaaattgctgtatcggacgtggtctggcagctatccatagcgaaaccccgtcatttgctctgtacttaatgcgattccttaagcctcaacttgaggcttacaacggagagggtactgtattcggctcaatcaacggtaaggctctcaaaagcttagaagttgcgcttccatctcataacgaagtgatgcaattcgagtcatttgcggcaccgatagatgcactaattaggagtaatgaaaacgaaacacggaaattaaataacctaaggaattatcttcttcccaaactcatgtccggcgaaatcgacgtttcgaaggttgacctcacgcagctaacaaataatcatttagctggttgttaagctcgattttcctatcaaacaaactaagaacatttgcaatagcattttgttccgccatcgaaggaagaggcaatttcatggcacaaagattactctggctcagctttggctgcgtagatcctgttacgtaggcagaaatatcagtcatattaagaagatgtctcagaaaaacgagattacacttttcggactcagcaataacatgcgcatgattattcactctgaattttccagaagccgcattcgcaataggattcttgcgactcctaagattttccccatcttcagcaaccagtaggtaatctccctcataggtgtaatcatctagataatcgacaataccttgagctccgtaataaggataggaaccttttctgtcctttctgtccctagaagatatcggctctctcttgacatcttcaagctcgataacatcacctagacgcgtcagctgctcacatgccatagccgatggcctccagattcttcttgatctgctcttgcagacggttggattcctcgaagcatttggcgatctcgccggtcagacgggtcatcttctcctcgaatggctcatcgtcttcttccacttcggcgacaccgacgtaacggcctggagtcaggatgtaatcctgcgccttgatatcttccgtcgtggcgatggcggagaagcccttctccgtttccagagtgccgtcacggaacgcgtcgaacgcagtcgataccttggcgatgtcctcatcggtaaactcgcggagcctgcgggacaccatggttcccatatcgcgcgcgtcgatgaacaacgtcttgccggactgcttcttgttcttggtgatgatccacaagctcacaggtataccggtgctgtagaaaagcttgtccggcattgcgatgatgccctcgaccagatcggcatccacgatcttggcgcggatctcgccctcgttgttcgtctggctggacaacgcgccgttcgccagaaccatgcccatgcggccggaacggttgagatggtggatcatgtgctggacccatgcgaagttggcgttgccctccggtggggtgccgtactgccagcgtacgtcgttctcgagtttctttcctccccagtccttcaggttgaagggcgggttagcgaggatgaaatcgaatttctcggtcttgtgcaggtcctcgaagaacgtgtcggcattatgatcgcccagatccgcgtcgatgccacggatcgcgaggttcatggtcgccattttccacgtggtcggattggactcctggccgtacacggagatgtcgttaatgttgccctgatggcgtttgacgaagtccgcggactgtacgaacatgccgccgctgccacagcacggatcgtacactcgcccgtggtagggttcgatgacttcgaccagcgtcttcacgacgcacgcgggtgtgtagaactcgccggcgttcttgccctccgcttcggcgaatttggccaggcaatattcgtaggtgcgtccgaggatgtcgcggctatcgcccttttcggccatcttcacgttggcgaacaggtccacgacttcgcccagacgtcgcttgtcgagctcctggcgtgcgaagttcttcggcaggatgcccttgagcttgttgttctcggcctcgatctggcgcatggcctcgtcgatggccttgccgatctcgggcgtgtgcgcggccgctgcgatggtcttccagcgggcgctctcgggaacgaagaagatgttctcactcgcgtattcgtcgcggtcctcctcgaagccctctccctcctcaacgagttcctggtatttctggtcgaacttgtcggagatgtacttcaggaagatgaggccgagcacgacgttcttgtattcggaagcgtcgatgttgccgcgcagcttgtcggcagcgctccagatctgttcctcgaagccgatctcggcggtattgtccttcttctttgccatgtcttgtattatcctcctgctcgtcctattcgctgatcttggtgtcggcccacagctcgcactgttccatgacggtcttcatggcgtcctcgacgccttcgggcggatacttgtatttgcgcagcaaacgtttgatggcacgccgcatgccggccctggcgctttccttcttctgccagtcgatcgtggcgttgctccgcatcgcatcggtcaactcgcgggctatcgagacgagctggtcgttgtcgtagaagtccttgaccgcctgcggctgggtgatcgcgtcgtagaacgccatctcctcgtcgctcaagccgagcttctgcgcgtcgtcgcggtccttcatgatctccttggccatgttgacgagctcttcgatgacctgcgcgttcgtgagcatgccgttgagatacgcgttcaacgtgttctggagcatctcgctgaacttctgggatttgaccacgctggtgcgcccgtacgcccgcactttctccttgatgaggcgtttcaggctctcgatcgcgatgttcttctccttcatgccggcgacctcctggaggaacgcctcatcgaacagggagatctccacgctgtccttctcgaacaggttgagcacgccgtccgcatgcacgctctgctggaggatctcgctcacctgcttgttgaactccgtgtacgtcatgccgctgcccccgccggagccacgtccggtcaggcgaaggacctgcacgcgcaatacggataggtaagccgcctcatgcgcgtcctcttcgcttaccatgcttttgcacaggctcagcgcctggttcatgagctggcattgcttgaggaacgattccgtgtcttcgtgccgttccagatcgagcagccagtcggttccctccgcgatggcgtcggcaagcgcctccctgctgttctggaagatgagtttgcggtagttgaagccgtacatgagatcacggcacacgtcgagcttttcgaggaatttcggataggcggtctcggcgatgttcatgtcgccgtaattgtgctggtcacggctggtatagtccttcatcgcccgcttgagcgcgcctgcgatgccgatgtaatccacgaccagaccgccctccttgcccttgcacacgcggttgacgcgggcgatggcctgcatgaggttatggcccttcatcggcttgaacacgtacatggtggacaggctgggcacgtcgaagccggtgagccacatgtccacgacgatggcgatcttgagggaatcggaatcgtccttgaacctgcgttccatctccttcttgtgcgtggtgccgccgcacacgtcgaaccattcctccggatcctggttcgacatggtcatcaccacgccgaccttgtctttccattcggggcgcagctccatgatcctgtagtagatcttcatcgcaatcggccggctgtacgccacgatcagggccttgccggccaggacgtcggcgcggttgttctcgtaatggtccacgatgtcgcggcacaatgcgtcgatggtttcaggagtgtcgaagatggcatcgaggccgccgaggtcatgcttggacttctccacgctcgcctcgtcggcctggtccgcgaactccttgtagaccgcgtcgatgcggcccagcgcgttctcgtcaagatggagcgagaccacacggctttcgtagtagaccggcttggtggactcgtcctcgacggactgggtcatgtcgtacacgtcaatgtagtcgccgaagatctcgcgggtgttgcggtcatccgtggagatcggcgttccggtgaaaccgatataggacgcgttcggcagtgccttgcgcacgacacgggccgcgccgaccgacacatgaccgtccgcgttgatccgttcggtcaggccgtactggccgcggtgagcctcgtccaccatcaccacaacgttgctccggtcgcacaacggctcgtcgccgtccgagaacttctgcatggtcgtgaagatgatgccgttcgcctcacgaccctcaagcagttcctgaagattcctgcggctctcggcctggaccgccttctggcgcaggaacctggcgcagcggctgaattgtccgaaaagctggtcgtcgagatcgttgcggtcggtgatgaccacgatggtcgggctttcaagataacgctgcagcagatgtgcgaagaacaccatcgaaagcgattttccgcttccctgggtgtgccagaacacgccgatcctgccatccccattgacggcctcttccgctctgacgatggctttccgcaccgcgaaatactggtggtatgcggcgatgatcttcacgaccttctcggaggaatcgttgaagcatacgaagttttggatgatgtcgagcagccgttccttcgggagcatgccgtcaatcatggtgctccatgccgcggctttcgttccggaatagtcgccgtccgccgacttccaagccacgtaacggtcctcgtcggatgtgatcgtgccgaccctggtctgggtcatatcgctcatcacgcagaacacgttgggcacgaacatgctcggtatctgcttcatgtactggcgcaattgcaggtacgcgtgtgaagcgtccgtctcctctctcgacggggacttcagctcgaacaacaccaacggcatgccgttcacgaaaatgatgacatcgggacgtttctcggaatactccacgaacgtccactggttcacgacatggaaatcgttgttctcgggatcgtcgaaatcaagcagccggacgatgtcatcacgctcttccttgccgtcaaagaagtgcacttcgactcctgattgcaggtagtcattgaatatctcgttgcgctgctccaagctgccgatctcgacattctgaatcttccggatggcctcctcgacggctgcttccggcagatttctgttgattcgtcgcaacgcatccgggagaatatcaggaaggaatacgtcgcgatacgagtcgtcggtgcggcgaacatcgggcccgtacaggtgctcatatccgagtttctccgttagatgttcgacgatcagattttcgtaccattcctcgttcagtggatccatggacgtgatgttgttcagagaacactccgagaccgtacgagattcgactttggaaacagccattgcttaccccacaaacatatggattctcaagcaaaccacttttcggttagtctatcaaccagcctatcgttcgggtgtaatcaacatggttgtccatggctattttccggcttccatttaatcatgtgagagcgaagaaacgccatattcaaaatctgcatgccgaccgcattgaacagttgaacaaatacctgacgtaaactttatggcataccacggaaaaaaagtggtcccgccgctaaacggcaggaccacttcgtgcatttcacgcgcccgtgcaccacgcatcaggcgcggtcagtccgccacggcatcacgccttggcgacctcaacggccagctcggcaccttccttcacttcgaaggaggtagccagcgtctcatgggcgatcagatccttgaactgctcgaccttggccacatcggcggccggaacggtcagcaccagggagatgcgatcggcgatgtccagaccggtgtccttgcgggcgtcctggatggcgcggatggcgtcgcgggcatagccttcggcgagcagatcggcgtcaagcgccgtgtcgagaatcgcaaagccgccggtcggcagggcggtggacaccgaggaggcggcctccgtggcgttctcctcctccacacggttgatcagctcatactcgccttcgaccagcgcaaggtcgccggacggcgtggagaccaccggcgcaccggacgcagcatcgacatgccagtcgccggacttggacgccttgatggcgaactgcacctgcttgccgaggcgcggacccgccgcgcgggcattcacacgcagctcgtgaacaatcttcagaccgtgggcggaggcgtcctccagagtcgagaactcaatattcttgatattaagttcggccttcagcagctcgtcgtaggctttgacggcgtccacgttctcgaccaccacggtgagcttggaaagcggctggcgcacgcggatcttggcggccttgcgcagggacagggtgccggagacgacctcacgcaccttctccatcgcgtccaccaaggccggatcgtcgaccagcacacggccgagttcggtgtcttcaccggtcttctcgtccaccacgaacggccaatcggccaggtgcacggactcgccaccggtcagaccacgccacacggactcggcttccatcggggccagcggcgcaagcacgcgcatgaacgcctcaagcacggtgtacagcgtgttgaacgcggaagcgtcctcattccagaaacggtcacgggtgttgcggatataccagttggtgagcacgtcgatgaagtcggagaccgcatcgcaggcgtcggagattgcgaactcgttcagcgacttctcggcggccagcaccagacgacgggtacgggccagcaggtagcggtccatctccggcagaccggcgacctcgtccgcgcgcagctggcgggcgtcgaatccggccccgccgttggccgcgttggcgtacaaggtgaagaagtagtaggagctccacaccggcaacatgacctggcgcacggtgtcgcggatgccatcggcggtgacgatcaggttgccgccgcgcagaatcggcgaagacataaggaaccagcgcatggcgtcggaaccgtacttgtcaaacacgccgttcacgtccgggtagttgcgcaagtgcttagacatcttctggccgtcggagccgagcacgatgccgtggcagatcacgttcttgaacgccgggcggtcgaacagggcggtcgccatgacgtgcagcaggtagaaccagccgcgggtctggccgatgtattccacgatgtagtcggccgggaagtgctgctcgaacttctccttgttctcgaacgggtagtggaactgcgcgaacgacatggaaccggactcgaaccagcagtcgagtacatcggaaatacggtgcatgtgcgacttgccggtcgggtcgtccgggttgacgcggaccaggttgtcgatccacggacggtgcatgttgatgttgccgtccttgtcgcgcgggtagtcaccgaagtcggccttgagctcttcgagagaaccgtaaacgtccacacgcgggtacttcggatcgtcactcacccacaccggaatcggggaaccccagaagcggttgcgggagatggaccagtcgcgcgcgttggcgagccacttgccgaactggccgtccttgacgttgcccgggatccagttgatctgctggttcaattccagcagatgcggcttgatcttggtcacggacacgaaccaggaggagaccggcttgtagatcagcggggtggcgcagcgccagcagtgcgggtaggagtgcacgtagctcttctcctggaagaggatcgcgcggcgctcttccgggatggaagcgagcgggccgtcgccggcgcgcaggttgcgcaggatcggcaggttggcgtcgaacacgaaatcgccctcgtagtcggggcactgcgcggtgaagcggcagccatcgtcgagcacgtcggtgctcttgatgcccttggcattcagcgtgttcatatcgtcttcaccgtagggggcctggtgaaccagaccggtaccttcgacggtgtcgacgtagtcggcagtgaagatcgtgtagccgttcgggccgggcacatggccttcggattcggccgtctcgcccgcgaagtacgggaagaccgggtagtagcggcggccttccagctcggagcccttgagttcgcgcacgacctcgtagttctcgccgagttccttctcgtagtgcggcagcaggtccttgccgaggtagaacttcttgccagcgaacttgccttcggtcgggcggacctcgacgtagtcgatgtcggcgccgaccacgatggcgaagttggtgggcacggtccacggggtggtggtccagaagacggcgtaggcgtcgtcttcatcgcgcatcttcacggccacggacacggtggtgtcctggcggtcctggtacacgtcggcgtccatgcgcagctcgtgcgcgctcagcggcgtgcggtccttcgggcagtacggcagcacgcggtagccctggtaggccaggcccttgtcgtagagctgcttgaaggcccacatcacggattccatgtacgggatgttcagggtcttgtagccgtgctcgaagtccacccaacgggcctgacgatgcacgtagttctgccattcgttggtgtacttcagcacggaagcgcggcaggcgtcgttgaacttgtcgatgcccatcttctcgatctggtcgaccgagtcgatgccgagttccttctgcgcctcaagctcggcgggcaggccgtgggtgtcccagccgaacacgcggttgaccttgcggcccttcatggtctggtagcgcgggatcacgtccttggcgtagccggtcagcaggtggccgtagtgcggcagaccgttcgcaaaaggcgggccatcgaagaacacgaattcgttctggctgtggtcgccggaagggttgcgttcaacggacttctggaaggtgtcgtccttgtcccagtagtcgagaacggtctcctccatgtcggggaagctggggttcggcgcgacgtgcgcggtctcgccgccctcgttcgccttgggatatacgttttcgctcaccgtaaatctcctgttagtactgtgcactggtcctacaggagcgtcattgatggcgattgccgggcgccgacgtgtgccggctgggttcacgaatgtcacgtaccgaaccgtggggccgatcgcgtcaatcgcctcgcagccggaactgactgtgttccgcccggaacagccctgtctgccgttcctgcctacgaggacgatgacgggcgctggtatgcgctccgcaccgcggtaccacctcgcttatcgcaccggttgcgccgctccgaactgttgcactcggagccgcgagcctgcgcgaccgcttgtgttcggctgtctcgggccgatcccgtcggttctactgggcgattgccgccgttcttccgaagactccccgctgataacggatcactgcctcacaacggtgcatatcgtaacacgccacgcggtcaaatcgatgggaatgttcatcaggaatgttcattctttctcatttttgtattcatcgcgtgcaccattgtcagcaaacacgctaggctcctttaccggcgatattgcacatctggctcaggggcggctcccgtatgggccggagaaaggattattgaggaatgacgtacgatttcacgtcgattatggacaggcatggcaaggatgcgattgcggtcgatgggttgggaaccgacctaggtttcgctcccgacccaccgagggacggatttgacgtgattccgatgtgggtggcggacatgaatttcccgaccgtgcccacggttccgcaggccattatcgaacgcgcgcaacaccccgtctacgggtacttctcccccaccgacgactattacaactccattatcgactggcaatccacgcgcaatggggttaccggattgaccagcgaggcgatcggctatgagaacggggtcttgggcggcgtgatcagtacgctgaccgcgttcgccgctcctggcgacagcgtgctcctgcacagcccgacctacatcgggttcaccatgtgcatcgagaacaacggctatcgcatcgtccacagcccgctcaagttggacgagcacggcgtatggcgcatggattacgaggatatggataagaagctcaaggagcatcacatccatgtggccgtgttctgcagccctcacaatccttgcgggcgcgtgtgggagcgttgggaaatcgagaaggccatggaagtgtacaaggccaacgattgcgtggtcatttccgacgagatttggtccgatttgactctggggaatcaccagcacatccccacccagtcggtcagcgaggacgcacgcaatagaaccgcggcgttctacgcgcccagcaagaccttcaacctcgccgggctcgtgggcagctaccacattatctataaccccatgctgcgcgaccggatcgtggccaagggctcgaagtcccactataacgagatgaacgtgctttccatgcatgcgcttatcggtgcctacaagcctgaggggcatgagtggctcgacgaactcaaagaggtgctcaccggcaatgtcgactacgcctatgactacatcaccaagcatttccaaggggtgagtttggccaagccggagggcacctacatgctgctgctcgactgcgagcagtggtgtaaggctcatggtttgactttggcggaattggagaagcgcggctgggatgtgggcgtcgattggcaggacggcagcatgttccaggctccctacagcatccgtgtcaaccttgcgttgcccttaagccgcatcaaggaggccatgcgccgccttgaccaatacgtattcaacgcgtaaacggcatgcatccgcgattgcggtgtcctggaaagacgaatgccgccaacgaggtttgtgcccgttggcggcattcgtcatagagaagccgagccaatctaccttcacaactaatcgtcgaggctgtccacaccgagcttctcttccagctcgatgacaatgcgctcgtgcatcttttcgtcgatcttcaccgtgaacatgaagacgagaagactcagcacgatgaaggcaagcgggatgtagaacgcgaaggtctcgaaggtgcgcacgttggcggcggtcatgtcggcggcggtggcggagccgaccataccggcggccacggccacgaagccgacgatgccgttggacagcgcgcccgcgatcttgtcgagcatcggacgcacggagagggttacggcctcgttgcgcttgccggtcttgagctggccgtattcgatggaatcggtcagggagaggatcgcggtcatctggatgaacgtgccaggcaggtagaacagaatcaacgccacgatcaccacgggcaggctggccgaatcgagaatgaacagcacatagccgattgccataagtaccatgccgccgcagaacaggtatcggcgcggtatgcggcggttcagggccgggtagagcggcgccatgaccaagcccgcgatcacggggatcacgccggtgatggcgaaggcatccggcaggttaagcacgaacttgaacagatagaacatcacgccgttggtggccacattcgccactgcatacagcaggtagctcaacgccacccacagcagctggtcattttttacgatagcggcgaacgcctgcagcgggttgccgctctgatctgccctggaacgtaggacgctttcgttttccttggtgccgaacgccacggtccatgcggtcaggatgccgagcaatgcggtgatgatgccgaatgccgtccagcccgactgactttcggcgcgagaaccagtgaacatgaaactgaaagtggtcacgatcggtaccacgacaatggtgctgccgttatagccaatcgaaccggtgaacgtaccgagcgcagtatatacgctgcgttcgtgcgagtcggaggagatggcgggaatcatgccccagtaggagatgtcacgcatcgaatagaacacgtcgaggacgatgaacaccacgacgaacagcacgatgaaccaagtctggttcacgttgaccagcccgaacagaccggtgtagaccatgacgagcagcacggcggagaccaagccgccgatgaactgccacgggcggaaccggccgaagcgggtgttggtgttgtccaccaagttacccagtaacgggtcaaggaagatctctgcgatacggattatcacgataaggcttgtgatcagtgcgatgagtttggtggccaaggctttctcgacattgacgaacagcacgctggtcacgtaaacgacgaaataggtgctcagcgcgttatagaacgccgactggcctagattaccgaaagcataggcggcacggcgcctcagagtctctgctttggtaggacgatttatctggccggattcatctccggccggattcggtgattgggattcgctctccggtgactgcgaaacggacattgacattttctccttagagtcattctcggtgaggtcttctccgacctcgttggagagtgtacatcattaccaagatttaataaatcttttcactaattattgtcaatagaaccaatctcaaaaccaacgtcgcagcactcgcaaaaatcgcataattccaacgaatacacacctctatcaccatatgaattatcgacagcgcgacacaccgccacagaaaatacctccagcaacttgcaatctgcaccatcaggttttaccataatcagtaaagagttttaccctctgaatcgacaacgtggttatcaactcaaggaaagcggttatgcagcatcccatccccaccaccatcgcatcatctgattggctcaccgatccgaccgtattcgccgtcaaccgcgaaccagcccattccgaccatcgcttctacgatcacgtaccgcagccgaacgaaacgatgagcctcaagcaaaaccttgacggcttgtggaatgtcgccgtgacgaccgccccggttttcggcttccccatgaacgattccggcaacgctgaatctccggatttcaccgcaaccgattatgacgacaccggtttcagccgcatcgccgttccctcaacactggaaaccaagggcttgctgaaccataagtacgtcaacgtgcagtacccctgggatggccacagcgaccccaaggctcccaacatccccactgatagtcacgtagccatttaccgccgcactttcgagacaagcacccccgtctccgccgccatcgaaaacaagcgccgcatcacgctgaccttccacggcgcctccaccgccatctacgtctggctcaacggctccttcgtcggctacgccgaggactcctacacacccagcgaattcgacgtcaccgaggcactgatttccggaaccaatacactggccgtggcctgctatgaatacgccaccgcaagttggctggaagatcaggacttttggcgcatgcacggtctgttccgctccgttgaactcaccgcgcaacccactgtgcacatcgaagacctgcacatcaccgccgatttcgaggcgaccacccatgccggcaccatcgacgcccatgccgtgatccgcaacatcgccggcgccaagcagctcagcgccgcactcatggatgccaacggcacgccggtctggcaggattcctatgccatgtccgacatcgtcgacacctccggcgtaccctgctgcggcaccgcagacaccgcgatcgacagcaccgccgtgcaattccgcgcgaatctgtccaacattcgtccatggagcgccgaaaagccccacttgtacacgctgacgcttaccgtgcgcgcagcagacaacagcatcatcgaagtggtgccgcaacgtctcggcttccgccatttcgaaatcgttgacggcattatgcggctcaacggcaagcgcatcatcttccgcggcgccaaccgccacgagttcgacgcgcgtttgggccgtgccatcaccgagcaggagatgctcaccgacatcatcacctgcaagcgcaacaatatcaacgctattcgcacctcccactacccgaatcagacgagattctacgaactgtgcgatgaatacggcctgtacctgatcgacgagacgaaccttgagacccacggcagctggaccattcccggtgatgtggagacccctgaaaccgccattccgggcagcaatcccatctgggaaggcccttgcgtggaccgtatcgccagcatgatcgggcgcgaccgcaatcatccgagcgtactgatctggtctctgggtaacgaatcgtacgcaggcgaggtgttccgcgcgatgtaccgcttcgctcacgcggccgactccacgcgacccgtgcattacgaaggcgtggtgcatgaccgcccctttgacgacgtgaccgacatcgagacccgcatgtatgccaagcccgcggaaatcgaggaatatctgaccaatgatccgaagaagccctatatctcctgcgaatatatgcacgccatgggcaattcggtcggcggcatgcatctgtacaccgagctggagcgttatccgcattatcagggcggctttatctgggacttcatcgatcaggccctgtggcagcagctggacgacggcaccgaacgcctgacctacggtggcgactgggacgatcgtccctgcgactatgagttcgccggcgacggcctagtcttcgccgaccactctccctcaccgaagctgcaagaggtcaagcgtctgtacgctcccgtggtactgaccgtaagcgaccacgatgtgaccatcgaaaaccgcaatctgttcgtctccaccattgatttcgcgttcacggcgaaactgctggcggacggcaatgccatctggcaggccgactaccgctttgatgtgcccgccggcgagacccgcaccttcccgattgacttcccgtcggtggacgccgctggcgaaatcacctatgaggtcgatcagtcgctggcaacggcaacaccgtgggcaccagccggctatgaactggcgttcggccaacacaccgttcagtcagtcgtgccggcttccgccggaaccgattcgaccgcgtgcggcgcggttccctccacggctgattccgatacttccgataccggtacagtaacggttggccgctggaacatcggcgtggtcagcggtgacggacgtaccgaagcgttgctttcacgcacgcagggcggcatggtgtcattcaagcgtgacggtcgcgaaatggtgttgcgccgtccggcgatcacctgcttccgcccgctgaccgacaatgatcgcggcaatggcagcggcttcgaccgcgtgcgctggttcggtgccggccgttatgcacgtatagcgaatcagcagttctcgcaaaccgagactggtgtcatcgccgaatacacatatacgttggccgagccgggcgaaacccaagttgccgtgcgctatgaggtggatgccgccagcggacgtgtacatctggccgcccgatatgccggtgccaccgatgcgccgacgctgccggcattcggattggaatggacacttcccaagcagtacgagaacctgcgcttctacggccttggccccgaggagacctatcgcgaccgtctgcacggtggcaagctcggcattttcgagcgcaccgcggccgaagacaatgcaccgtatctggtgccgcaggagaccggcaaccatgaagacttgcgttgggccgaagtgcttgacgcccaaggacacggcatgcgtatcagccaggccggcagcgaacatttcgcggcgagcctgttgccgtacagctcgctcatgctggaagaggcgacccaccagaacgagttgccgccggtccgtcacacgttcctgcgcctgttggccgcgcaaatgggcgtgggcggagacgattcatggggcgcgcccgtccatgagcagtaccagctgcccgccgatcgcgcctacacgctcgacgtgaatctggaactgttctaacagcgataaagaagctccctccacagagggagcttctttatcgcacagagggagcttctttatcgtgctggtacgaaactgtcacgcactactagggtggtggagatgaaggtgtggtggtgcagcgtgcgccgactggagatggcctcggcaagcatcgtaatcgcagtatcggccatctcattctgatcgatatcgtaactggtcaatgtcggcgaagtgtactgggcgatggcctggttattgatactgatcacactggtatcgcgaggcaccagcactcccgcagcggtaaacgcctgcagtacgccgactgcaatcgtgtccgcagccacgatgaacgcatccggcatgtcatctcgatgatcgttagccgctttctcccctagagtgcgcccggtgtccacagtgaacgcgccttgcgcgtaaatcaggccttccgcatccagccccaaacgctcggtccaattgcggaatgcggttaatcggctgtcttccgggtattcgtgcaaacccatcgtgaagccagtaccgccgatatagccgatgcgtcgtttgcccgaggacaccaacacatccaatgcgtccaaaatggtttggcttaaatccggttgcaccgaatcgaacaggccgggcgcaggattgatgtcgatgaatacgccataaggcaataccagatggagtttcaacagttcatccgaagaaggtacggacggtccgatggaaatgaagccgtcgaaatcaccggcgttggcaatcagatcgtcgatatgggaaaacgacgtgagttccatgtgctgggctctggcattgtcgccgagcacggaccgcagttcatcgaaataggcgtccgccagttcttcctcgcgggtggcgttgtcgagtacggccacacggcgtggcaatacgatacggcgtgatccggtagcgtagccaagctgctcgctgacctcgatgatgcgacgtcgcgtctcctctttgacagacaatgtcgggtccccattgagcagccgggataccgtggcctgcgagaaacctgattcctgcgcgatttccttcatcgtgaccatagttgagccttccacgcctcagtacgtaacaatacgcagtatttcagtaaataactttactacatagtgtaactcacgtcatgcgggtatgacgccgtatggttgcagcatcgtcgatccgcagcgctgatgagaacgtgcatgtttcaggccctccgataattatcgggcaggcgggaatccccagaccgtggagtcaatgcgctggattttcccggacttgtcaaagacaacggtgatgtccggcgcagtaaaactgccggtcgaatccccgaatcggtacggatcactccagtcgataacggcatgcatcgtcacggtccgagttttcgcgtcataggactcattcgagtactcgatactgttatgcgtggccgtagtcccgcccagaccgccgccattgccttgatgcatttgctgacaatacttcgtaaaatccgcgccgagaacattcgacactgcatagcgcctaaatgaacgtgttaggtctgcatccaattcacggcctgcaagactctgcactcagcaattacttcgcaccaaaccgctcacgaatctgagcggcagtaccataagaggcttgcgcaccgaccccagtcgcggcgtacgcggaaacgtacgaggccaactgcgcgctgtccgccaacgcatgacccgaggcaagtccggccagaaccgtgcccataaaggcatctccgcacccggtagtgtcgatggccgcaaccgcaactggcgcaatacgatagatatcatcaccatcgatgaccaccgacccatccccgccaagcgtaattaccgcctgattaaagccgaagtcatgcatctgccgcgccacatcagaccagtccagtccatcccaatcgtcatcgtcaggctcggcgatgtccagcagctgtgccatttcatgttcattgaccagcagaatgtccgaagcctcgataagttcagcgggtagttcagcaacgaatggcgaatcgttgagcaataccttgagcccggcatcatggcagaggcgagcgcatgccgtgaccgtttccatcggactctccaaacacagtcccagcacatcggcggcaaccaatgcgtcagatgactggcgcacatagtcgacagacacctcaccattggaaccagccgaatatacgatggtgttctcaccattcgcgtccacggtaattaccgtagtgccactgggacctgcaacggcagcgatatgcgaagtatccacaccagcatcgcgcaaatgctccagcagaaaatccgcattggcatcttccccgactgcaccaaacatccgcacctgcgctccaattcgcgcagccgccgacgcctgattcgctgatttgcctcccggcaataaggtcagcgggccaccgttgacggtctctcccggtttcggcaaccgctcagtaacgaccgtgtaatcaacattcattgatccgaccacggacacactgccgtgcaggtggtcgagcaagtcaagacatgatgctgacatgatgcatttcctttcggccttcttgtttggcctgtcttctatgttctgcgcttgttctacgtttcagcaaaatcacgatggaaacacaatcgtgcgggtatgcaaatgcccggagtctgaagtcaaatcccgggcattgcacgtattcggggccaaatcgtctgcgcgattgatatgttctgctgacgactgacgcctagcggattgtgatggttatatcagcatcacgcacccatcggcaggaagattgccatggacaggatgaacatgacgattacgccagcgatcatcggcacactggtacggcgcacaatgtcgattgggctcttcttgatggagccggcgacgatcatcaccacagcggagaccggcgagacagcgcgcagcagattgccagcgagacccatcgggatggacacagcgagcacattgataccagcagcagcggccagcggaaccatgagcggaaccatcgcgaagaacagtgcggtaccggaaccggagagtagcacgatgagcgcagtgaggccgacaaggataagcggcagcacgaagcccataccagagccggacaggccggtcattgcgttctgcagttcggtgatcagaccaatggacttaagaccaatgacgaacacagaagcagcgaccaacagtgccacaatcggcattgcgccacccatgcccttgaagaaggactcggtgccagcgagggtttccttgcccttgcgagtgcggatgagctcgcagataatggcgatcacgaaggagagaatggaagcgagttcaacactcaggtcgatctttgcgccggtggtggaagtgatggcgaacacgatgagaagcatgatgatcggcagcagcggcaaaatcgcatacacagtgcggtagagagcgctaccttcgacagccttaacctcagccaggtcaacatcaccgtcggtcaaatccgagccagcgcgcttgtccatgaacttctgccagaagtagtgtgccagtgccatgacgagcaaggtcgggatggaaacgagcacgtgataacggaagacgtaatcgctggcggtcaggccggagaacatgtcggtcttagcgagttcagcggcgatggcaacattgtcggagccaagcggggtcggcataatcgttgcagtagtggcaatgactgcagctgcgctcagcaggctcataccagcttggcgaagcaccgggtacagcgttgccataaggatgatagccaggttggaagcactcggaatgaccagagacaacaggttgcccaacaagaaggtaatcggcacgagtatatacggggacttgatgtgcgcaatcggcttggcgagcacacttaccgtgacttcattggctccgatatgggacatgtagccggtgtagccaccaaggatgaggatgatgaagccagcagaagtgagcgtgctcacgaactgatcgcctacaaccttgaacggatcaagccaagtgacaccactggaaacgaagtcggtgaatgagatgtccttgcccatcagcaatgcgatgtacatcagcacaatgccgatgaggaacagggaaatcttgatgtccattttcttcacgagcataaagcccacaatgccaaccgcggcaattgccacgaggtacataatcaccagttccatcggtctggtcctttctttgttctcttattctctgttgttgaattcacgaatactgatgcgctcaggggcgccggtgttagcggcgtcgaagagacaagggactatgcacaatgggcgatgccgtccatgaaccagtcgcagaatcgatctgcgtgaacgccggtggtgacggtggcattcggttcgcgcttaaggtagcccttaagatcaacgaccgtacaccctgcagtgagttcgccagcgatttctacgtccacaaatgccttagtcatgtcgaataggtcaggctccagcaagcatgcgactgcgcaagcgtcatacattttgagaccggtgccgaagctgcgcttgcggtagcgctggaacaggtcatgagccatcagaccgaccttgcccatatccttaagctgagcggttttctccggcggaatcacagttcccaagccggcgtccagtgtggccatagtaatgtcaagaccagaagtgagcacaatcttggcggcttcagggtcaacgaaaatattgaattcggccataacacccttgttgccgcgagtgaccgaaccacccatgagcacaatgcgctcaatacgcgacttgacttccggaaaagtttttagcaacagtgcgatgttggtcagcggaccgattggcatgacggtgacgggttcagcagaagccatgatctcgtcgcgcattgcttcgacagcatgcttatccagcagaagttcagttttgggctcagggaaatcgaatccctccataccggttttaccgtggatatcgcttgcatcatcaagctgacggatcagcggttcagcagcgccacgagcgaccggtacatccttaccgtagtaggccatcagcttgagcgcgttcgtcgttgtcgcttcaatgctgacattgccagcaaccgtagtaatcagccgcacgtcgaagcgcgggttgaacactgccagtgcgatggcgacggcgtcatcgatgccggggtcagtgtcgataatcagagggatctgcttcattgcttgttcggttcctttcgtggtgtgttgatatacgtgttatgcgtagtgctcggcgagccgattacttgattccgcttgtggcggtggattcagctgcgctgagcggaacgggatcaacgaattggactaatccgctgccataacccggtgccggccggcgcaggaacccatgctcttcgtagaacgattccttgccaggtgttgccatcaggccaatgtacgcatggttgcagcagtgttctcgaatgcgtgtgataagtgcgcgcagcaccgccgtaccgactccacccccttggtattgcggtaataccacgagatctttgatgaagaatgcgatacgtccatcgccgaccacacgaccaattccggccacctgaccatcaacgtaggcaaccacggaatacagcccaccatccagcgccatacgcgcgtcttcgcggtcgtaatggtagaaacccacagcgtcgcgaacgctgacgtacagttcggctgtcagcgcgtcttgctgaatcgatatgcacattgcccgctcacctcctctgtgagtttcctccaaaccgatcatcgttgatcatcgccattgataaaacgtttaatcaactaatgaaaattatgatataaccttttaccaatgctgtcaacgatgtcggcacgtcagcactgttcagcgcataaacccagccttcatgcacctgataaacgctgcaatatcagggcacacgccacataggagccccaaccgaatcacgcagtacaaacgatgacgggacatagcgcgattcaccacgactgcaatcattatttataatcatgtcgagcaacatatccacgccctggcgacccatatcctcagcttgctgcgaaataatcgcgacttgcggagtcagcagacggaatacggcaatgtcatcgaatgaaatcactgacatttcactaccaatatcaatgccgcggtcatgcagcaaaccaatcatcgtgatcatgtcaggcgagtaagcgcaaataatcgccgtaacatctgctcttacaagttcatttagtcctgcttcgcgcgaaacatatgtagaatcacagtcgacaaccgccgcagttccctcccccaactgcgtcacctgtgccacagcagaacggaatgccgcttcacgctcatttatattggacgagcccagtgacgagtgtgacacaaatccaatgtgacgatgccctaagcgcacaagttcggcaaccgcctcgcaaacacctgggtatgggtcggacactacgaatggcaccgaatttactcccgataccaaacgatccacgaacaccagtggtagctcgcgcgcgataagcgactgcataccaggcgaattgacaccttgcggcaccacgattgccccgtcaatacgttgcccaagcagattgtcaataaacgcatcctggcgttccactgtttctgctgaagtaccaatcagcgtggaatagccctgggcatacaactcgtcttccattgacgagactaaatcagcgaaatacggattgcgcaaatcaggaaccagcaggccaacagtcttagtatccgacgagcgcatggaacgagcacgttgatcgggcacataccccatttcctcaacagttttcagcaccaactgtcgcgtatcactagaaaagcggcctttattgtgaagtatctgggaaacagtagcagccgatacaccggcacgttgagcaacatccttcaacgtcacgaacgccatagtcccctccttgcggccgatacatcgtcaaagcaacaattcaaatgtacccttttcaccgccaatattcgcaatcctgcgccaacacacggctctcaacatagaaaaccgcaccccaaccaccggatgagaattgcttcaacccgataatcgaggtgcggtttttgcaggcgtaccggctactccagctccaccgcgccggtgtacagctggtagtactcgcccttttgcgcgatcagctcgtcatgcgaaccacgctcgatgatgttgccgtggtcgagcaccatgatcacatcggaattgcgcacggtggacaggcggtgggcgatgacgaagaccgtacggcccttcatcaggttatccataccagcttgcacaacctcttcagtacgcgtatcaatcgaggacgtggcctcgtcaaggatcagcgcaggcggatcggccaccgccgcgcgagcgatggagatcagctggcgctggccctgggacaggccggaaccgtcgccttcgagcaccgtgttgtatcccccgggcagcatgcggatgaagctgtccgcattgaccagacgcgcggcctcgatgcattcctcatcggtggcgttcaggcggccgtaacggatgttgtccatcacggtgccggtgaacaggttcacgtcctgcagcacgatgcccaaagacctgcgcaggtcaggcttcttgatgccggccacggagataccatcatacagaatctggccttcctgaatgtcgtagaaccggttgatgaggttggtcacggtggtcttgccggcaccggtggcgccgacgagcgcgatcttctggccgggcttggcgaaccaggtgatgccgtgcagcaccggcttgtccgggttgtagccgaaggtcacgttggtgaagcgcacgtcgccgcgcagcagggtcagtcggccgtcgggcgaggtgatcgcctgctccttggccttcatcgccacctcgcgggccgagcccttgagcttttctgcggccttcagagacctcgtaccgtcgtcgccgacctcgcgcttccatgcccagtggccggtctcgtggtcgacttcggtcatggtgcggccatcctcgccaagttccacgttcacgagcgtcacggtgcccttgtcttcctcgatgggctcatccatcagcttgaagatacgggaggcaccggcgagcgccatcatcaccatggtcagctgctgagagacctgaccgatcgggttgatgaacgagcgggacagggtcagcagggagacgagcgtgccgagggtgagcggcttgacgccggtcagaccgatgtcgttgacgccggccagcgagacggcggcgccgacgatggcaagcaggatgtagagcaggtagcccatgttgccgacgaccggcatggtgacgttgccccaggtgttcgcttcggcggacgcctcgaagagttcctcgttcttctcgtcgaaggtcttctgggtggcgtcttcatggttgaagaccttgatgaccttctggccgttgacggattcctccacgaaggcgttcacgtcgccgatccactgctgctgcttgacaaagtagcggccggagcggctcacgatcttgcgcacgatgaagtagagcagaacggtgaacacgattacgaacgcggtgaatggaatggacagccacagcatggacagcagcgccgcgaccgcggagataatcgaggagaacatctgcgggaacgactgcgagatggcctggcgcagcgtatcggtgtcgttggtgtagtggctcatgatgtcgccgtgctcgtggctgtcgaagtagcggatcggcagcttctgctggtgggcgaacatgtcgtcacgaatcttcttgagcgtgccctgctcgacggtgacgatcagccactgccacagccaggacgccacgatgccggccacatacaggcccgccatcaggctgatggcccgcagcagcggggcccagtcggagttcgactcccccaccatcggcaggatgtacgtgtcgatgagcgactggaggaacagcgcggaaccggcctgcgcggcggcaccgaccaagatgcacaccacgatggcgatgacacgccacttgtactggaagatgtagctgaagatgcgcttgatggtgccaggctcggctttgcccatggcgggcttgcggttcttgaaactctggtcgctgctcatcgtgcttctccttccttggtatcggctgcattggcatcagctgcgctggtatcggccgtgggcatggtcactgtcaccgtcacggtttcggacggctcagcggtagatgactcagcagcctgttcggcagcggccagttcttcgggctgggcctggttcttggtctgggattcgtagatggaacggtattcatcgcaggtggcgagcagttcgtcgtgtgtgccggacgccatgatgcggccggaatccatcaccagaatcatgtcggattcctgcacggaggccacgcgctgggcgatgatgatcttcgtggtgtccagaatctcgttgtggaacgcggaacggatcagcttgtccgtcttggtatcgacggcgctggtcgaatcgtcgagaatcagaatcttcggcttcttcagcagcgcacgggcgatgcacaggcgctggcgctgtccgccggacacattggtaccgccctgctcgatgtacgtgtcgtacttatcggggaattcctgaacgaatccatcggcctgcgcgagctgcgcagcatggcgaatctcttcatcggtggcgttcgggttgccccacctgaggttttcggcaatagtgccggagaacagcacgttcttctgcaacaccatggccacctgatcgcgcagcgcctcgagatcgtagtcgcgtacatccacgccgccgaccttcagcgaaccggagctcacgtcgtacagtcgcggcacgagctgtaccagagacgactttgccgaaccagtaccgccgacaatgccgacggtcatgccggagcggatcttcaggttgatgtcgtcaagcacgggcttttcggaactgtcggagtagcggaaggtgacatggtcgaattcgatggagccgtcggccatgtcagtcaccggctgtgccgggttctgcaccgtgctttcctcctgcagcacctggcagatacgctcggcagaagcctgagaaataatcaccatgacgaagatcatggacagcatcatcatggccataaggatctgcatggcgtaggtgaccagtgcggtcaggtcgccggtggtcaggcccacggcggggttgttgccggaggcgacgatctgctgcgcgcccatccatgcgatgaggatcatcgaaccgtagatgcagatcatcatcagcgggctgttgaagctcatgatgcgctcagccttggtgaagtccttgaagatgcgctgggagatgcggccgaacttggagacctcgaaggattcgcggttataggacttgaccacgcggatgccctgcaggttctcgtcgaccacgttgttcaacgcatcgtaggtgtgaaacacgcgctcgaacaccggatgcacgagcacggccagaccgcacaggccgatggccagaatcgggatgcaggccaggaacaccatggaaatcgacggggagatacggaacgagaacagccaggatacgaccaccataatcggggcacgcacgcccagacgaatgatcatcatgtaggcgttctgcaggttcgtcacgtcggtggtcagtcgggtcacgatcgaaccggtggagaaccggtcaatattggtgaagctgaagccctgcaccttctcgaactggtccttgcgcaggttcttggcgaagcccgcgccggccacggccgcgtactttccggacaggaagccggcacccagcgaaaccatcgcgcacaccagcagaatcacgccgaacttgacggtggccggcatgctgccaccggtgataccctcatcgatcagcgaagccatgatggtcggaatcaggatttccagaataccttcgaccgccacgaacaccggagccaggatgctggctttcttgtattcacgaatcgaatggcccagcgtgcgcagtacatgtttgggcttgtccggttcgacggctttgcgcgcctgcgcgattgcctctgcggtatcactcattcgttctcctccttcgtgttagcaacctccgctccgtcttgatcgggagccatcaccacaggtgactgagggagtgtttgatgttcaaattcatgttgtgcgcggtcgatgttcgcgcgcatgcgactgacgtagtcacgtagggctgctttctcgctttcggaaaagccatcaaccaacagacgttcgacgcgttcgccgttcgctttgagatcggcgacgatggcgtccgccttatcggtcaggacgatacgcttgcaacgggcatcatgcgccaccgattcgcgggcaataagccctttcttttccataagcgccagcacgcgcgaagcggtggagcgggtgatacagaacttctgttcgatggtgtgctggtagatttcacgattccggttacgagccaggaacatgatgatatgcgcgttgccgccagtggtctccttagcggaaagcggcatgctctcaccgagatagcggtcgacggctttggtcaccgctcgcatctcaatgctgagaatatgctgatccattgtcctccgtaccatgcgaggccatgcgcgtatgcgccttcaccccacattgttgcatacgcaacaattcatgataaagagacccatatacaacagttgcatatacaacaatcggtgtgttgcctagacaacgaatcccacatatgccctatacacaaactggctcccttctctgaatctcagaaaagggagctggcagtttgcgtagtattacttgctcagcttggcgtactcgtcaaccatgaactgggcgatcttcttgccgccttcgcccaacagggtgggcagcgagttgatgggcatggagttgaggaacatgcgcatcatcgcattatccggaagcttcggcagctcgccggcctcgccggcggcggccacggcggccacgatcttggcgccgaacggatcggcctcccactcgccgtaggtggaccattcggtgagcggctgggtcttgccatcgccatcgagggccacggcaacggtgtcggcaatgtcgcgggagctcacgcccacttcgatggcatattcgccagactccacatgccagtcgttatacttttcggaccagtaggcgaacgcgcgctcgtcgaggtcgatggtcacggtcttggactcaccggacttgaggaacaccttggtaaagcccttaagctcgtgcttcgggcgagccacgtcagccttgcccggtgcaacgtacacctgcacggtttcggaggcatccacatcggaggtgttggtcacggtggcggtcacggtggcggtgttcgcgccggtcttggcaacggcgacgtcagcgatctcgaacgtggcatagctcaggccgtagccgaacgggtagtccacaaccttgccgtaggtgtcgtagtagcggtagccgacgaacacgccctcgccgtagtcgacgtggccttcctcgcccggccagttcagcatgctcgggtcatcgttgatgtccagcggaatcgactgggcgagcttgccggacgggctgacctggccgaagatcacatcggcgagcgccgggccaccggactggccgagcaaccaggattcgaggatgcccttggcgttcttggcccacggggccacggagaccacggagccgttggacagcacgaccacgacgttctggttcgcggcggcgacctgttcgagcagggcgatctgcttggcgggcatgtcgagggtgtcgcggtcgaagccctcggattccgcggcttccggcaggcccaggaacatgaggacaacgtcggcgttcttggcggtttccacggcctcggattcgagggccgggtcggccggttccagatcgagcgtgaagccgggggcgaagtcggccttgatgccgcgctcggcgagcgtgtcgaggaagctggtcatcttggtggggtgatgtgggaggagccgccgccctggtagcgcggggtgcgggcgaattcgccgataacggcgatcttctggggcgtggcggacggattggcgactgggtcggcgttcagcggcagaatcgcatcgtcgttcttgagcatcacaatggattcaatagcggcctgatgggcgacttcatcgtgggcgtccacatcgaaacggtaattatcgatgctcattgcagcgcgggtcttgtttaccaagtcaatcatgccctgagccatacgatcgagctgggcggggatgattaggccgtcgcggacggcgtagacaatctggtcgtcggtgtagctcggcggcatttccagattcaggcctgcattcagggaggccccacggtcatgatcggcgccccagaggactcactcgcttaggtgagattctgcgtcccctaagcaaatcctcatagagctttctaggaggaagacgacatcgcttggaatcatccagataataatccaagccacatagatgagcgaaatttcccgagtcccaaacaatggcaagagtcagatcatcttcacagtgattttttattgaacggccttcaagtcgctcatgatacaggagagccgcagcatgggcttgcgccaatgcatactcctttgtcttcgttatattcacggctccccctttgccgaaaaataagggagggacatctgagccagatgtccctcctgagatgaaaagccatgttttacagtcttctgcatgactatcatccactactttcgaagtggaatcggtagtggcttcggttggcccaaccgtatcacccagccactgggctaggcaccctgctttcgcggtattcgtccgcgcggacgaatcaagtgccagcggcggctgacttctcatctcgaacccgcaacccaccccgccgcaaaggataggccgggtcacgaagctcactctctaccttacacaattggctcgaatcatgccaccagagagcgatttcgttctcattacaccatccaaccggcgtgccagacgtgagtgagatcccaagggtcgaggcgtgacgtgtcggattgcgggtcgatggtaggcaagaaatcacgattaccacgtaattggtagctccaatagatttgcccggcggacacgttccatgccttgcgttgcatggcggcgatctcgcggtaaatagagcctctgatagatgcactgtgcatggcgttttccttggagcggccaccatcgcctgtacgcttatcgaccacccgatttaccagaccattagccacgcaccactcccctacaatcaccggcgtatagcgcgcggcccggcggatgcggcgttcgttccagcgcacgaacaagcgataccagcccatcagccaccgatccgggatcagacggaacagcgggaattgctcggccatgaccagatagacatgcgtatcgagcatgacgccccgcatgccctcgcgcacgaaccagtcccgccaacggcccagtcggaagccgtcatggaacacgatgacttgattccctgccagaatcgggcgcaaccggtggtatgtctcgcggtagaaacgcttgaggaacgccatcggaataggcccgcttcctcgcgcttcggaccggtctttcgcctgcctgctcgatggtgacatggcatacgtcagccagtcaatcggctcattcagcacttcgataccgaacagcgccgcgtggtcgcgataccggcgagccagacggaccagcacatccagcgcataggcgaccgctcgcgggctacgatgccagcgcaccacgccggtgaggccgccgttatcgaatccgttctgcgagccgggcaccgtgtgcaggtcgataagaatcttgagcccggtccgctcggcccagtcgaacgctctgtccagatactcggtacagcccgggtgaccgggcacatccccgaacacgaaatacggcactggaatacgcaccagattgcagccatgtgcggcaatgttccgaaaatcggcctcggtaatatacgtgtcgcgatgccgcgtcagcaaagcctccagctcagccgacttcgtagcccgatgcagccagatctcgtccgcctcgccgctggcggcaaaaatccccggcttcatccaccgctccagcaccagccaattgccgaggttcaccccattaattcgttcgccaacacccagcgcgcccgatgccatacctgtcacgctaatcgttcaatgcttcaccgtagcgagcgaccaacccctgatttgcacgctcaaactcggggatgtaatcagcgatgatggcgtccacaagacgccgagctcgttcttcatcatagatatgagcagaatcattgcgatcgcgcagcatgcgcagccacaacgattcgtccatgaaatcatagtattgaaaagcggttttgagcacatctcgcggagagccggaagcggaaacagggtctccctcataagccagcagcgccttgaacagtttccaaccaagctcgaactgcaacccgaacttgtcaataatgccgctctggatgaaatcattgccgagatcctgttcgggagccttgcgcagcgaattcaatgcggaaacgtaattctcatactttttcatacagcacctttccgctacgctcaatctccgccctcagcgatgaagaaatcggctcatccagattgatgacatcaactttaagcagtgaccacagattgtcctgaaggttctgctccaagcgattgaaatcgggacaaccggccacggcaagatcgatatcgcttttaggccggttcacgccctttgcgcgagaaccgaacagcacgaccttgcgagcgccggcatcagcggcaaacgcgcgaatctggtcgtacacgtgctcgataggaaccatgacacctcccgccgcatccaacagtcccggaccaatcccggaccacccgcgcttccatcatacggccgcggcccactcaccgcacggagcccgaaccacccgaacgcggcgacgtagttgcgggaggcgggctggcgctgtagggtgtgcgggaagttcctgacgtctacttttcaggaggtgaatcctcatgttcaccacgttttctctggccatcattctcgactgcaccgtacgcattgtgctcggcacggcattgggcgcgctgatagggctcgaacgccagttgcgcgcccgaagtgctcggcgtgcgctgggatgtggagcacatcaccacgtccgactgacgctgaccagcaacatcgcaacagtacaacaagccaacaagtgggatggggcatcgagcctcatcccactttgttattatccggcgattgtcagactcactcacgccacggtgaacgtggtgcgcttcaggtcctcacggcgcgaggagtggccgatgagcagttcgaattcgccgggctcgacgatgcggttggcgtccgggtccacgatcgtgcagttcgccaccgggatctcgaagatgacggtcttggtctcgccgggttccagtgcgacgcgctggaacgccttcaattcgcggtcggtccagctgtaggaggtcacgatgtcgccgatgtaggcctgcatgatctccacgccggcgcgctcgccggtgttggtgagggtgatttcggcacgtacggtgtcggtttcggcgaatgtgccgtcggcgttgcttgcgccgcccgtaatggtcggttcgccgtatgcgaacgtcgtgtagctcaggccttcgccgaacgcgaacgccggatcctgggtgaggtcggcgtaccggtcgccgtgctggccgcgaatctggttgtagtagaccggcagctggcccgcgtggcgcgggaaggtgatcggcagtcggcccgacgggctggtcaggcccaggattatttcggcgatggcctgaccgccgcgcatgcccgggttcggcgcccacaggatggagccggtgccggtttcagggtcgctgacgcgcttggcgaatacactggactcgcccacgatggaggcgggcaacacctgcggcttggagctgatgagcacggtgaccatcggcttgccggtttcgcgcgagacggcggcgagcgcgtcgagcagggcgttctggccaccgagcagttcgagcgtggcggtggagcaggtttcgccgaccagctggaccacgtcgccgaccacggccacgatcagatcggactggcgggcgttggccacggcttcgtcgatcattgctcgatcgacggcggcggaaacgccgattttcgggcgaggctggccgtccgggtagaactcgccggcagggtcaggcacgaggtcgatgacgttcgcgccgcgcgagtagaccacttcgcaatcgtcggaggcgagctgggtcaggccgtcgagcacggtggtaatcatgcctcgaggctggccatccggcatccaggagacctgaccggagttgccggtccagtcgccgagctggttctgggcgtcgtcggcaagcgggcctaccacagcgatgcgcttggccttgtttgcggcgaacggcagggcgccgtcgttgcgcagcagggcgacggattcgcgggcgagttccaggttggtctgctggtgttcggcggagccgatgaccgccttgatgcgttcggcatccggcaggcgcgggtcttcgaacaggccgaggcggaatttcagggccaggatgcgggctaccgcatcgtcaatcagggattcgtcgagcagaccggtttttacggcttcgatggctccctcatagaactgtggggtggtcatgaccaggtcgttgccggccttgaccgcatcggctgcggcgtgcacgtaatcgggcttgacatgctgttcccataccgagcggccgacgttgtcccagtcggtgatcagcgtgccattgtattgccatgcgccgcgcagcttgtcggtcagcagccatttgttgaacgtgaccggcacgccttcgatggactcgtagccgagcatgaacgtgccgcagccttccttggccacgcgttcgaacggcggcaggaaccaggattcgagcttgcggtgggagaggtcggcttcggaggcgtcacggccgccctgggtctcggagtatccggcgaagtgcttggcgcaggcgaggatcgcgtccttcggcagcgtctcgccggcctgggcaccgccctgatagcccttgaccatggcggaggccatctcaccgatgagcatggggtcctcgccgaaggtctcgtccacgcgaccccagcgggtgtcgcgcgcgatgcacagcaccggggagaacgtccagtgcacgccggtcgaggagacttcttcggcggtggcacggccggccgcttcgacggccttcgggtcccagctcaacgccatgccgagctgggaggggaagatcgtggcgccgggccagaaggagtagccgtggatgcagtcgtcgccgatgacgagtgggatgccgagacgggtcttggtgttcacggtttcgacggcgcgcggcaggtcctcggggctggtgtgcaggatggagccgacgtgcttgttcacgatgagctcgtcgaggtcgccaccgcgggcgtcgagctgcatcatctggccgaccttctcttcgagggtcatgcgggagagcaggtcggcgatgcgctcggaggcgggcaggtcggggttcttgtagggcagcgtttcgactgtggtttccggtgtggtcgcggtcatggttgtgttcgcctttctgggttccgtgcggtcactcgatgacgaaggtgttgaaggagcgcggggcgagcgtggccttgaagccacgggaggcgtcggccgggtcggcgaactcgaacgggcgttcgtcctccagcgcgttctgggtcacgaccacgatggtgccgtccgggttgcggaaggcgatggccatggagttgaagtggctggtggtgccgagcaccttcgcgccggggcgcacgtacttggagaagtggcgcatcacgtagtattcggggttgtggcgcacctcgtgcgtgtcggcggtgatggtgaacagggagttctggcgcgaccccggccagccgaccaccgaccggggttttcgtaatcctagaccaaacacacccggcacctggcaggccgcggccggtacgacaagggccagaacgcccgccaggacgctccggcccgaatcacggccggcatggaacccggtcagcgctggaacacgtcggggtgcttcggatctccgggaatatcgtcgagcaggccctcgaggccgaggaactcacgccagaagtcgagcggctggccatacgggttggattcgcggccgtgcgcctggatgttcgccttggcttcgaacacgtcttcctcggtgagcccgtcgaagtagctttcgagacggatgcggttggacggcacgtagtacagggacgcgatgatctcggtgagccgttcgacgcgttcgatcggcagcgaatcccagtggcggaactcgatgaagttcttgagacgcacgtcgttgaaatgcgtggagatgatgtggttgatttcgtacgcgttgagctcgcggtccgggtagacctcgccagcgttctcacggaaggcggcgcgatgcagctccttgcggctcagccccgattccaccgcttcgggcgtgtgcgtcaggtcggcgaacatcagcggcgtggacagcacgtcacgcgcgtagtcctcccagccgaaacgctggtcgaacaggccgggggtcacgttggtgcgctggaagtcgaggtagtcccacatgcgctggcgcagcagcggatacgggttgagacggccctcgaagtaggggtgttgcggaagaaccatgcgagaatcggcccgatggcggtgccgacgcgcatcttatcgatcgaatccttctcgtcgacatagtcgatgctcacctgggtggaggcggagcagcgcatcatgcacggaccgaactggccgacgcggccaaggaagtcggtcatcgcgtcatagcggcctttcggattgaccggcacgtcgacgaaactcgacttcggctggtatccgtagttgacgaaacggaagcccagctcctcgaggatcgggtccgcctcacaccggaagtcggcgtacaggccgttgaggtcgcccggctcatgaagcacgccgatggaagcctccacctggccgcccggttcgagcgacaccgcaacgccttcgcgcgcgagtccgaccagatggccgttctcccagtattccttgctttcgtcataatacggagcgagccgtttgaggaacgcttcgatgccgttcggctcgtagtagcttacggccgtgtcgtcggcgtcatgcaccggcagatgctcaatctcgacacctaaaccaccggtgccgcgcttggagcgccccgcctcgaagaacttcagaaggctctcgacatgcttcgggttcggctcggcgagcaggtgcgcatagctgattctgggagtgaccatgaacggtatcgtaggcgagtcgcgcgacgcgcgtcgccgcgcgcccgcgaatcggctatatctttttccgataaccggcacgtcgccggacatccgccatatcacgccgcaacgccgcaccgcgccgtcgcaccacaccgcgccgccacgcccccatcaccgcacgccacgcctccgcaacgccgcgccacaccgtacggctttgccgttatgcgcgatgtcggatacactcattgatttgtaaaccttgtttacagaaacgtccggcagagaggccggaccacaccatcaacccaccatcaacccacggcgaacagccggaataaaagaaaaacaacagaaaacaacagaacacggaaaacagcaacaacccatacaaaacaccggcaaccataagcacgtcggaagcacaccggaacgcacaccgaagcgcaccggcgaccgctccggttccacaccgaaaccacgccgaaggccataccggaaacggaccgaggacatatcggacacgcccggcaccccaccggcacgccggtgcgccacaatcgaaaggaaggaaagcggcatgacatcccgtcagggcagacaagccatagccgcgacggccgcaatgggcgtggccgtcgcgctggcgttgccgaccgctgcgttcgcgcagtcagcaacgcaaggaaaggagaccgctacgaccacgtcatcaggcaccacctactacgtgtcgtcggcacacggcgacgacgccaacgcgggcaccagcgaaaacgcgccctggaagtccctgaccaaggtcaacgacatcgcctcggacctcggtccgggcgattcggtgctgctggaatacggctccgaattcaacgaccagtacctgcacatcaaggacaccgccggcaacgccgacgcgccgatcacgatctccgcctacggcgacgccgacgaaggcaagccggtcatcgcgtcgaacggcgtcaaaggcagccagtgggagcaggactaccgtgccaacgtcggcaaccacaagaacaagggcaccgtctcaaccacgctgctactcaaggacgtgtcgtacatcaccgtctccaacctggagatcaccaacgacgacgcggacgtctacgatccgatcgacacgtggaagtggaccgacacccctgattccgacggcacaaaactcgaccgcagcgcctcgcgcatggaccgcaccggcgtggccggcatcgccgagaacggcgcgacgatgagcaacgtgacgctcgacaacctttacatccacgacgtggacggcaacatctacaacaagcacatggccaacggcggcatctacttcatggcccactaccccatggagaacacgagcgccgaaaccgacgtctggctcagggagcacgtctcacgcttcgaccacgtcaccatcagaaacagcaccgtcaaggacgtggatcgttggggcatcgccgtcggctacaccgcctacctcaactacatcgacgcgaactacggcgacggctccatcgacgacgccctcatcgcgaagtacggttccaccaacgtgcgcatcgagaacaactacgtcaagggcgccggcggcgacgccatcaccctgatgtactgcgaccgcccggtcatcgaacacaatgtgggcgacagcgtctcgaagcacatcaacacgcaggactacacgcagcccggctcctacggcggacgcgtggcggccggcatctggccgtggcgttgcaaggatccagtgttccagtacaacgagatgtacaacaacctcaacgccgagcacggcaacggcgacggccaggcgtgggacgccgactacggcgacggcacgctgtaccagtacaactactcgtacggcaacagcttcgcctcgctgatgatctgcaactggtacgcggttaacaccacgttccgatacaatatctcgcagaacgaccgtcagggcgtgttcgacctgccgtcgaacggccccggcaaccacatctacaacaacaccgtctacgtggacgccgacagccaggtgctgactaagcgttccaactcgcagtccctgttcgagaacaacatcttcatcaacgcgaccaacacgaagaagacggagacctggaaccgcggcagccagaacggcggccagacgtacgacaacaacatgtacgtcaactacgcgaacaagcccacctccgacgccaacgccatcgaggccgacgacgtgtccgcagtgcttgcgggcgccggttcggctccgacatccgccctcaagagcggcgccgagcatgcgcgcaccggcgagaaagccgcgttcgacggctaccgtccggtcgcgggctcgaaggcgatcaacgccggcaaggtcgtctccgacctcaacgactacgcggtggagaacgacttcctcggcaacgcagtcaagggcaggcccgatctgggcgccgtggaaagcgacgtggtgtccgtcacgatggcctcctccaagtacgagaccggaaccgaaaccgattccgggaccggtgacaagaccaaggtcatccacgtgaccttcaccgacaagaacccggtgaccgtcaaggaactgctctccaacgtgtccgccgacaagggcgtggacaaggccgtgtaccgagtcgccgacgccaagtccggcaagtccgccgacgccaggtccgccgagtccgaaccgaacatgctcgaccgcctgctctccctgctcccaggctccgaccggaacgccaaggacgacgagacgaagctcgccgactccgaaccggtccgcgatggcgacatcctgcgcttctccgccgaaggcacggacgagaccgacgagtacacgatccgccagcgcatcacgtgggattgggtcgcggactacgagcaaggcgtcgccgacttcgactggaaggcgcagcgccgcacgtccgccggcggcgagtggaccaccatctccgcatacgacggctcgtggccgaacaccgtgtacgaccagtactacggtgtcggcgtcaacggcaccctcgccgaactctccggcgaccgcaagcagacgcacggcctgctgatcgacaagcccggcgacggcctgcccacggccatggcgtggaaggcgccggagtccggcaccgtcatgctgtcgctcaagacgttcgccgacaagatcgctgaaccgtacctgcgtcagaacgcggacaacgccggcaagaaggtcacattgtcgctgatgcgcaacgacgagacgctctgttcggccgacgacctgtccgtctatcagaagtcctccgaacagttcgcgcagtgcctcgccgagcacggttcgatcgacgtgcaggaaggcgactggatccgcatcgtcgccgacgccgagaccggagtcaaggcgccgtcgctgcacatcagcccggtcatcacatatgaggacaaggcgcccgccgcgccgaagcagaacgtgcgctacgacgtctcgtacgccgcgacggacgccgtcgtcggcacgcagtcggccgtcgccgccgcgttcaccgcggacggcggcgaggccgacgcgccggacggcgtcgcgttcgccttcaaggacggcggcgatgagggcgaggcctcgcccgtcatcgacgcgtccaccggcgccgtcaccttcacgcccgccgccggacagtacggcgcgaccgtcacccgcaccgtcgtcgtcacgtacgcggacggttcgagcgacgagacgaccgtcacgttccgtgtcgcgcaatcgcacgcgcagcgtctcaacgtgctgtacccgaccgtgcgcggcgacgccggcacggacctgaagcgcacgccgaagttcacgctgaaggcggacggcgcggccgcgtctgtgccggaaggcacgacgttcgcgctcggcgcgaacgcgccggccggcgcgagtgtcgacatggcgaacggcacggtcacgctgaacagcggggtcggcggcaccgtcaccgtgcccgtcacggtgacgttcgccgacgacggcgccagcgtctcctccaccgcccgcttcgaggtgaccgcgcccgccgcgctcggctcgtccgagttggagaccgcgactgtcgacggtgtgaacgtcgtctacgcgccgttctccgccgacagtccgatgaccgtcgcgcagctgctcgccaaggtgacggccgaaccgtccggcgccgataagggcgtgtaccgtgacggcgtgcggttggaggccggcgcagaactcgccgagaacgacgtgctccgcttctccgcgaaaggttccaccgtgtccgacgactacgtggtgaagtcgaagaccacgtgggattgggtgaacgacttccaggtgcgcgtgcagggtccgatctggtacgggcagcgtcagaccgaggccgacggcgtgtggtcggatatcgccgacttcgacgcgacgtatccgaactggatgtacgagacctactacggtccgggcgtggactacgcgaaccacagcctgcccaccgaccgctccgccatccatggcctgatcagcgattcgcccgcgtccgctggtggctccgccatggcgtggaaggcgccgaaggccggcacggtgaaggtgtccatccgcgaggacgagccgtacctgcgccaggacggcagcaacggcaaggcgttgacgcttcgtctcatgcacgacgacaaggtggtgtgcttcgccgacctgaccgtctccaagcagcgttccgaggagttcgccaactgcgtcgccgacaagggcgagatcgcggtcgaggcgggcgattggatccgcgtcaccgcgacgtccgcgtccggcatgaacaagccgtccgcgcacatctccccggtcatcgcctacatggccgcctccacgccgggccccgaacccgttccggtggacaagtccacgctgaaggccacggtcgaggaggctctgggattggccgagtcggactacacggatgagtcgtgggccgcgctcgtcgccgcgcgcgacgccgcgcagaccgtgctggacgacgatgccgccaccgccgaacaggtcgagaccgcgcagaacgcactgcgtgacgccatcgacggattggagaagaagccggtcgatccggacccgaacccgaaaccggatccgaaccccgatcccgatccgacgcccgacccggaccccgaccccggccccgacaccaagccgggtgacggttccggcaacggttccggcacgggcaacggttccggttccggcaacggttccaccggttccggcagcgacggcgcgaccaccggcggcaagctgaccgccaccggcgccgacgtggccggcgcggccgcgatggtcgcgctgaccgcggccgccggcatcggactggccgccgcggcccgtcgccgcaggtgaccgatgccacgtaggcaccggttcgccgccgccatcgccgcagtcgcggtggcggcggtcctgctcgtcacattgaccgtcgccgtcgtcacgcacggcgacggcgccttcgcgcccgcaggcacgcctgcgggcgcgggcgcatccgccggcatcggctccgataccggctccaatgcaagcgaggattccgacatgttccccaccatcgtcttcggcgacaccgtcatcgaacgcaaggagtacgtcgcggcgctcaaggcgcaacacggcgcggcgcggctgtactttcggcagacgtacggcgtcgacccggccgaggacggctgggataaggcgcacgacggcgaggtcccgtgccgttggctcgcgagccgtgccatcgacgaactgcgacgtcggcacgccgcgtacctcatcggcgtggatctcgggcaggtggccgacgactcctatgcgagcatcgtcgcgcgcatggaggccgtgaacagcggcaacgcggaactgaaatcggacggcggcatcgtctacggccgtaccggcttcgacatcgacagctacctgagctacgaactgtccgcgttgaagaacgcctatacgggcgacgagtcgaaccccggcatgagcctgtccgacgacgaggtgcgacgctactacgacgagcacgactggacaaaggacggcgtcgacgggaagactccgctggacgaggtgcgcggcaacgtgaaggcgcagatgcggtcggaacgttacgacgagctcgtgagccagcgcgccgaagcgatcgacgtgaccgacctgccatgggacgcgctgtaccggttcacggcaggcaggctcgggtaggacgggtgtgaccggtgccggccgaaaagcaccagaacgaataaggcgggtgtcccgttccatacggaatgggacacccgccttgtcgtaggccgcagaccggtttgcccggtctgcgccggtctggtgccgaccgggcgtcggttggacgtcggtttgaggtcagtcggcggcagtgaagccctgcggctcgtcgccgtcggcgaacttcgccttgtgcgccttcttcgcggccgcgatcatcagcttgatgcggttgagctggttcgcctcggaggcgcccggatcgtagtcgatggacacgatgttggcctccgggtgcaggcggcggatcttgccgaacatgccgcggccggtcacatggttcggcaggcaggcgaacggctgcgcgcagatcacgttcgggcatccctgttcgataagctcgaggatctcggcggtgagcagccagccttcgccggcctgcacgccgatcgacgtgacctcggcagccttctcgacgagttcgggcatcggatcgtcttgcttgaacttgccgtgagaggtggcgatggccgccttgatcggcgcgttgtagcggtcgaggctccaacgcatgagcgcgtacaacgtcttgttgccgccggtgccgagatacttctcgttccagtcggtgatgtacgggcgcgtggtcatgaactccatgatgccgggcaccacggcctcgcaatcctgcgattcgatgacgtcgacgacatggttgttcgcatccggctggtatttgacgaggatctcgccgaccacgccgacgcgcaccttgcgcggcacgtccttcaacggcagagcgtcgaagctcttcacgatctctcgggcgagcacggggtacggcaggtagcggcgcttgagccacggggtcttcgcggccgtcttcgagaagccgtggtgttcgagcgcctcgcgcacgatcacgtcccactgctcgtacaggcggttcgccgcgcccttctccacctcgtacgggcgcacgcggtacaggcacttcatgagcaggtcgccgaggatcagcgccttgacggtgcggtgcagcagcgcgggcgtcaccttgaagcccggattgtcctccaggccctgcgtggagatcgcgatgaccgggatctgcgggtaacccgcgtcgatcagggccttgcggatcaggccgaagtagttggtggctcggcacatgccgccggtctgcgtaatcgcgagacacaccttgtctggatcgtatttgccttcgagaatcgcgtcgatgagctgtccgatgaccatgatggccggatagcaggcgtcgttgttcacgtatttgaggccagtctccacgtcttcgcgcgaggcgtgcttgaggatgtcgaacttgtagccgccggagcggatcaccgattcgacgagggagaagtggatcgggctcatctgcggggcgacgatcgtgtagtccttcttcatgtccttgacgaacttctcacggtgcgcgtaacgggacatggtcgcgttgttgtggccggacttcgacttcgcggacttcgacttggcgttcgcggcatcgttcgtggtgccgtcgccgagcgcggcgagacgcacatcggcgatgtcgcgcttcgcggcgcgcttggacgcgtcgcgcatcgccttggtgagcttcgggttcgcggccatcgtcgcgtcgagcaggacctgacggcccggcgtgggcgccttggagccggtcttgcggaatccggtggacttcggcgcgttcgcgggggcggcggcgtcgctgccggcatcggccgcgtccacgggcctgtcggcggccttaaccttcgcttcggcggcggcgacggcggcctgcgcttcggcgagcgcggcctgcgcggtggcgagatcggattcggcctgctcctgcgccttgcgggcggcggcctgcgcggcggcgtgagccgcgttgcgcggggcgtcggactcggcggaaccggactcgtcggacgtggcgagcgcggccttggccatgcgcgccttgttcgcctcgcgttcctcgacggcggccttgagcgagcgcaggcggatcttcgccgcgccgaggttggagacctcgtcgatcttgagcagcgtgtacacgtcggccttgtcggcgaggatctcggccacctggtcggtggtgatggcgtcgaggccgcagccgaacgagttgagctgcacgagttcgaggcccggataggaggcgacgaagtgcgcggccgcgtagaggcgcgaatggtaggcccactggttggtgacgcgcaacggcatgcggttgacggtgaccttgcggtcgtcgacgtggcggaatccgttcgcgttcttcttgcgcgggtcctcttcgccttcggacaggaagtcggtcaggtcgagcttctcccccggctgcagttcgcagatcgaatcctcggagaggacgaccatgccgagcgcgcagatggtttcggggatgccgtggttgatttccgggtcgatgtggtaggggcgtccggcaagcacgatgccgcggcagtcgtgctccttcatgtaggcgagggctttgaggccttcctgctggacgtcgtgtttgaagaccttgtcttcggcgtaggcggccttgacagcagtttcggcctcttcgcggctgacgctcgcccatgcgaactcctcgacgatacggtcgaccatgagctcgtggttggcgaggttgaagtacgggtgcatgtagcgcacgtcggggtcacgcagttcgggcatgttcgcgccgacgacgagcggatagttggcgacgaccgggcagttgtagtggttgtccgtgttgggcacgaggttgtcctcgtaactgacgcacgggtagaagatcgtcttcatgcccttgttgagaagccatttgatgtggccgtgcacgagcttggccgggtagcagatgttctcggaggcgatcgattcgatgccggtttcgaacagttcgtggctggaacggccggagatcatcaccttgaagcccagcgaggtgagcagcgtgaaccagaacgggtagttctcgtacatgttgagggcgcgcgggatgccgatttcgcctcgggtggcgttcttgtcggtgaggcggcggtaggcgaagcaacgcttgtacttgtagtcgtacaggttcggacggtcggagcgtttcttcttggcgtcgccgccgcgttcgcagcggttgccggtcacgaagcgcgagccgtcggagaacgtggtgatggtgagcttgcagtggttctggcacagcttgcacacgtcgcgttcggtggtcatcgacatttcgttgagggcttcgccggtgaggattgacgagacggtgtggcgcacgccgtcgacgacgatttcgccggcgtgcgcggcggcgttcggctcgtcgccggcggcggactcctcagccgccgccgcgtcgacggaacgcccgtccgcgccgacgtgcgcgttgtcgtcgtccgcgatgtcctcgtagtgcatgcgggcggtgagggccgcgccgaacgcgcccatgaggccggcgatgttcggtcgggtgacttcgcgttcggtgagcagttcgaacgcgcgcagcacggcgtcgttgaggaacgtaccgccctggaccaccacagtgtcgccgagttcgccggaatcgcgcagcttgatgaccttgtacagggcgttgcgcaccacggagtagcacaggccggcagcgatgtcctcgatggaggcgccttccttctgcgcctgcttgaccgaggagttcatgaacacggtgcaacgcgaaccgaggtccaccggatgggtggaagccagagccttttgcgtgaattcctgaatcgtcaggcccatggacatggcgaaggtctgcaggaacgaaccacagccggacgagcaggcctcgttgacggcgattgaatcgataacgccatcggtgatggccaagtacttcatatcctggccgccgatgtcgatgacggcggtgacgccggggctgaccatttcggcgccacgatagtgggccatggtctccaccacgccctcgtccaagtgcaggccggtggtgatgaggccttcgccgtatccggtggcgcaggagcgtgcgatccacgcgccttcgggcagctcagactgaatcttcttgacgatgttgatggcggcggtcagcgggctgccttcgttgttggcgtagctggaccagacgatttcacggtcgtcgttgacgagcgtggccttgatggtggtggaaccggcgtcgatgcccaggaagtgcgggccatgcgcgccttcgagggtgccgatgtggatgtgttccttgtggtggcgcttgttgaagtcctcgcggtcggcctcggtggggaacagcggcggcatggtgggcgtgttggagggcaggttcttcagctcgtccaaacgcttcaggatttcgtcgcaggtgtaggcctcgaaatggtggccctgatcgtcggaatccgtgtcggcctgcaatgccgaaccgtaggccacatacaggtgggcgtcggtcggcacgatgaactcgtcgaccttgccctcaagcgcgcgctggaatgcggcgcgcagctcggacatgaagaacaacgggccgccgaggaagatgacggtgccgtgaatcgggcgtccggaagccaggccggcgatggtctgcgtggccactgcggtgaagatggaggcggccaaatcgggcttggcggcaccatcattgatgagcggctgcaaatcggttttggcgaacacaccacaacgcgaggcgattggatacaggttctcgtagctcttggccatctcgttgaggccggcggcgtcggtgtcgagcagcgtggacatctggtcaatgaacgcgccggtaccacctgcgcacgaaccgttcatgcgttgttcgggcgtgggtttcaggtaggtgattttggcgtcctcgccgccgagctcgatgatgacatcggcctgcgggtattccttgtcgattgcctcggtttcggcgatgacctcctgaatgaaaggcacatgcagattgtcagcaagcgccagaccgccggaaccggtgatagacaggcgaatcggttcgtcgccgcgtccgaggtccacaagcttcttgtggatgtcgaccaacaggccggccacggtggcacgcacgttggcgtggtggcgtcggtaatcggagaagagggtgtctcccagggaatcggactgatcaagcaccacggccttgacggtggtggaaccgatgtccaatcccacacgcaggggcttcgggtgtgaagcgggctttacgctcgcgtcagtggcgatgtcaaccatgtgttcctcttaattccgacttccgggagtgcacgctttgaggcatcatgaaccgtttcgggacggctggcagataccctgcggacggcttcgcccggctacttcttatggaatattagtccgaccacctgcccaacatggcacgaggcgaggcgatttcgctcacgggaaggccttttcccaacagttccaacgatattgctgagtgcggcattccagaactgctactacgaggcctgttggccttcgccggcttcgcggtctttcaaatagatttcggggatatctcgttcttgatcgtggagcttggcccagatgaccggttcgccggcttccagagacttgggcacatcgaggatgcgctggtttctggagccgcggaattgcagcagcgagtccttctggtctctgaggtagcggccgtcgacgagaatgtcgatgagatgtagcaattcaagcttgtctggggtttctccggggcgcatgagttcttcccatgtgtagccggtccacgaccagatatctttggtatgaccgaattcctggcggatacgttgtgcgagcggcaccagcacgggagtgttgaggaatggctcgccgccaaggaacgtaatgccttgcacccatggggctttcagatcttcgatgattttgtcttcaagtttttgcgtgtattcgtggccggcttggaaatcccagatggaggcgttgaagcagtcgacgcagtggaaggggcaaccggagacgtaaagggagttgcgcacgccttctccgtcggtgacaatgaaggttttgtagtcggcgatcatccgcttggacatgcgccggccatcccattgaccggctttcggatcgttggcaagaccgttggagggtacggaggggccacgcccggtctcgccggccgcaaagtcatggcgcttgggttcgggcttggtcgtatgcagctccggcatgattccctccttacggaaagcattagctcccgctggcgggagctgtccgtcatcagacggactgagggtggtcaacaccataaaggatgaccgccctcagtctcgcttacgctctacagctcccgtcagcgggagcaagtataaaccctacttggtctcttcgaaccactcgcgagtggttccgtcatccagcgtcacacgaccggtttcgccgctcatgtgcttgactcggtgggcaatttcctcgtgacggccgtgcaccatcgggcgctggaccgggctgccgagatagccgcaggtgcgcttggtgacgttgcacttgtccgggttggagttaccgcactccgggcacttgaagccttcctcggtcggctcgaagtcgccctggaagccgcacacgaagcagtggtcgatcggggtgttggtacccaggtagccgatgccgatgttgtaggcgtaatcccacacggcttcgagcgccttcgggttgtcctgcaggcacgggtactcgcagtagttgatgaagccgccggaagcgtagtacgggaagtccttctcgtagctgagcttctccatcggagtgggctgcaaccacaccgggtagtggaaggagttggtgtagaagtcgtgatcagtcacgccttcgatacggccgaacttttcacggtccatgcggttgaagcggtcggtcagggattcagccggagtggagtacacggaatagtggtaaccctccgctttgctccactgcttgcacagctcgttcatgcgcttgacgatggacagcgcgaactccttgccttccggatcccagccgtggtcgcgaatccagttcttgccatagaagaccgcagtggtctcggcaaggccgatgtagccgagcgacacggtggcacgctcgttcttgaacagctggtccacgttgtcgttggcaccaagacgaccaaacgcaccaaagcggaacagggtcggggcgttgaccggggtggcttccttgcagcgcatgatgcggaactggagggcctgatgggcgacttccatacgctcgtcgaacagcttccagaagcgagccttgtcaccgtgggattcgatggcgatacgcggcacgttgacggtgaccacgccgaggttcatacggccgtcttcttcatccttgccggtctccgggttgatccaaccctgcaggaaggagcggcaacccatcggagccttgaaggagcctgtgatcttgacgatgttctcgtagaacaccacatccgggtacatgcgcttggtggcggactcgagggcaagctgcttcagatcgtagttcgggtcacccgggtcggcgttcacgccgtgcttcacagtaaagacgagcttcgggaagatggcggtgtggtgttccttgccgaggccgcgaatacggttcagcaggattgcgcgctgcacttcacgagagaaccagtcggtgccgagaccaaagccgacagtcacgaacggggtctggccgttggacacacggttggagttgatctggtattccatggtctgcatggcatcatagatggccttgcgggtacgaatcttggcgaggatttcacgctcttgctcaagttcgtcaacgtcggtgtggaacggggtgtccatcggcagcggttcacgggaaccgaaatgcagcttggcgggctcgttcttcttggcgctctcgacctgacgacgggcgaattcaaccggcatgccgtcggggatggtctcacgagcttcctcaaggaacttctcgtaatccttcttggcatactgggcaagatgctcgtcggcacggttggcggtctggccaccatactggctggaggccacgtccttcatgatctgggtaatctgggtggccgcaatggcgatggacttcggggaagccatcggagcgttgccaagagtgaagccattggccaacatgtcccagaagttcggcaaggagcagttggactgggcagtgaacggcgaatagtcggcatcgtggaagtgaatgtcgcccttcatgtgggcgttggacaccgccggcggcagcatgttgaacgcggcggccttggacacggcaccggccagcagatcacgctgggtggagtagacgttggaatccttgttcgcgttctcgtgaatcagggtcgggtcatgattaatgaagcgagcaacggcctcgttgacatcagtggccttggcacgctgaatgtctttgtcgagacggtaattggtgtaggcgcgagccacatcgtacaggtgggcgtcaatgagggcgtgctccacgagattctggatgtcctcgattttggcggggccggtgtaacgccccttgatttcgccttcgacttggttggcgaaaccacggatcatggcatcttcttcggggccgacttccttgttcaggtcgccgaaagcagacttgaccgcagagatgatgttgatggggtcgaagtcgaccacacgaccatcacgcttctcaacgagcacggtggaggccttggcggccaccttggtctcgttatcggtgacggtttcctccagcacctgtgcgcccatcgggcacccctttcctataaggcgaacactctcctgagttccgcattttggccgcactcgacgtgggccacacgaaattacattgatatcgttttcttgaacctctagaagaatacggcatccccacccctatatctagtgctcaacagtggtgtgtcgaactatttatagggtttttcggctatttttcgccaaaactacaagtgtgtgattagcgtaactgttttctgctcgcgtgtcgcacagcgagctcactgacgactctcaatcgtcagtgcaacgcatatctcactcctcttcatagcacccgtttcttcgccataatgactcctttcttctgatgcaccagaccatctccatcatcggctgatacatcgcttcgtacggttcttgcattcatcatcacaccgttttcaggcgacggtaaatttttaccgtcatcaaccaacgcacttatagtggagtgcatgactactgcaatgggctactcatctaccggccgtccaccgaccgccgcttcactggcctcgtctggctttgagccgggtcaaggcactttcgcgcccgatcggggcgccatcaatctgccgaatgagcctcgccctatcgatcagctgcctgcacgcgccgctgaaaccaccgcgcaaaatccgtggccggtaagcgtgctgagccagaagttctacggtgccgtggaacgatggccgtccgcgtgggtcaccggccagatcacgcagatcaatacccgtcgcgccggctcggcctacatcacgctgcgcgacgacttcgaggatatcgccatggaagtcaatggcttcggcaggttcgcggccgcagccagccagttcgttcagggcgaccgcgtggtgattcacggcaaaccgaacctgtggatgaagcgcacttcgctgtcgttgcgcggggacacgattctcaaggtcggagccggtggcagcctcaaggccatgatcgacgaattgcgcaagcagcttaagggcgagggcctgttcgatgccgatcacaaactgcctctcccggagtttccgaagactattggcctgatttgcgcacctcaggcacgtgcggaaggcgatgtgatcaccaatgtgaaccttcgttggccttccgtaaccttcaaggtggtccatgtgcatgttcagggcgagcaatgcccggccgaggtggttcaggccattgcacaactcgatgccgacccgagcgtggatgtgatcatcgtggcccgtggcggcggctcgtttgaggatctcatcggtttctcggatgagcgtgtggttcgtgcggcgtatgcctgcactacaccattaatctcctccatcgggcatgaggatgactggacattgctggatctggtcgccgatctgcgcgcctccacccctaccgatgcggccaagcgcgtggtgccggatgtgcgtgagcagtcgcagctcatcgaaggtgccatcgaccgtatgcgactgcgggtccgttcgcgcgtggagaacgagattcgacttatcgagggatatgcgaaccgcccgagcctgacacagccgcacaccatgcttgagcctcatcagcgcttaattgacgactcgttgcaacggctcgatatcgggctgcgacgcatcgtggacgatgcccagctcaccgtcgagcgagctcacgcctcactgaccgcactcagcccgcaatccacgttgaaccgaggctatgcggtggtgcagtccgccgatggccacgtactagacgatgcttcgcaggtaagccctggggatggcatcaccgtcaccttgaagaagggtgtcattaccgcaaccaccacatccgcaaccgcgtgacacgccatacgcagccacgcatatataccgtatatataaggagaacatcatgaccgaaaacgccacatccaccgacatgaacacccccgccacgtccctgacggacaaggaacgcgagctcatcgcccagatgccatatgaggaggcgcgcgacaagctgattcaggctgtccaggcactggaaaccggcggcctcaatcttgaccagtcgatgcgtcaatgggagatcggcgaggccttggctaagcgcgcccagggtctgctcaacgacgtccgtgccaagctcgaccaagcacaagccgagcaagccgccaacgaagccaccgcaggcacgcagtccaacctcgactgagttgcctcccggcgcggcatcccgcggctcgcacctgagtccggactggactgagttctgcttcccggcatacgatagtggtgattaggccacattggcagcagtttatagaagggaaatcccatgtcaacgttgattcttgtattccatccgcatcttaaggacggctcgcgcgtgaacgcccgcctgctcgccgaactcaccgcacagggcgaggacgacatcatcgtgcgcgacgaatacgccgaatacccgaacttctccgtcaacgccgacacagagcacgagctgctggaggccgccgaccgcgtaatcctccagttcccgttctactggtactcctccccgcgctgctcaaggaatgggaagacgaggtcatcaccgcaggctgggcctacggtggaggccacgcactcaagggcaaggagctcaagctggtggtcaccactggttccgacgccgccaagtaccgcaaggatggcgagtacagccacaccatggaggagctgctgagcccgtttgaggtcgtggcgtacaagatcggcatgaactatgctgagccgttcctggtgcagggcaccgccaccatcggcgatgcggagctggatcaggccgccgccgattatgtttcggcgattttggactgaataagctgaggccgggtgcaagtcgcacccggccttgttgtttcgcgggctagccgcggtctctcccagtcagcctgcggctgacagttccctcgtcagagagagcttattttttggatcagagggagttgatagctacttcttcaacggcacgtagatcacgtcgtcaatgagctcgcgatagtgctcaacgatttgcgcgcgacgggtcttcaggctcggggtcagcatgccgttggcctcggtgaattcgtctggcagaatctcgaacttacgaatcgactcggcgcgggaaacgccctcgttggcggcgttcaccgcacgctccacctcagcgtgaacgatggcgttcttggccagcgaggccagatcgggttccggcttggcgccctgggattccagccatttgttggcatccgccagatccagcgtgaccagagcggccacgaacggcttcttatcgccaataaccaagcactggttgaccacgggcgaggtcattacggaagcctcaagcagacccggcgacacgttcttgccgccggcggtgatgatgaggtctttcttacggccggtgatggagatgaagccgtcttcggagatatcgcccagatcgccggtgtgcagccagccatcggtgatctgctgggtggtgacttcggggttgttgtggtagcccttgcacaccagcggtcctttgaccaccagctcgccgtcctcggcgatgccggcggtgataccgcacatcggcatgccgatggtgccgatgcggttgtcctctggcaagctcacacacaccgggccgcaggtttcggtcatgccatagccctcaagcaccggcatgccgatgccgttgaagaagtgggaaagctcagagtccatcggggcaccgccggtaatggcgaagtcggcgttcggaccgaaaatcgtgcgaatcttcttgtacaccacctgctcatagaaggcgtgggcgatacgtccggcaatcggcagctgttcgcccttctgctcggccttggaccattcgcgcgcgttttcggcggcgcgcatgaacatcttgccagcgaatccggtgccggcgcgctgggaggcggcgttgtagaccttctcgtacacacgcggcacggcgagcagcagcgtgggaccgaaggtctcgaagtccttgaccatcgtcttcatattggagctcagggccagcgaaatcgtgccgccgaagctgaagaattccatgaatcgggcgaacacgtggctcaacggcaggaacagcagcaggcggcggttgggccatgcgccggcgcgcggcatgtactgcaatgcggagagtaccaggaaagcgaagttgcggtgggtcagttccacgcccttcggggtgccagtggagccggacgtgtagacgatggtggcgcggtcgtcgccgtgggaggcttccttgtattcccagaattcggcatcggtgacgctttcgccataggtcttgatggcgttcaggccgccggcctcgattacgaacacgttgcgcagggtgggtacctcgctgcgcacggattcgatcttgtcgcgctgtccgtcatcttcggcgatggcgagcgtgactttggaatcgttgaaaatccagctgacctggctggcggagttggtctcatacaccggcacagtgagcgcgccgatggacataatcgccatatccagcgcggtccattcccagcgggtgtgcgagacgatggcgactgaatcgcccttattgacgccaagtccgatcaggcccttggccagatcgatgaccatgtcacggaatacttgggcactgtacgggtgccaagtgccatcatcgcccttgtattcgatcatggcaccttcgggatcgcgcttggcgcggttatcgagcagatcgaacaggttgatgtcgctgtcaatcggctccttgacgggattggtgaactgcttgacgatacgagtatcgtttatggccttatcagcgatgttttcagtcatactccccatgtaactccacggatgctacaaaacacgcgcgaaacagcggattgtccagaccaaatggccccggcaatccgttatttcgggcaaaccaggtaaatctgccgcaccgtacattcagcagattactcggcggagttattggcctttttcagctcgtcgcgaatctcctgcagcgtggcgagagtctgctcttcaacgctaggcccctgttcttcagcgtcagcctcatcctggatagcagtaagatcacgaagcttattaatcggcaaaatcacgcagaaatacaccgccacgccaacaagcaggaagttaatcagcgcgttaagaatcgcaccaaatgaaacggtcgagttgttgaacgtgatggtcagtagtccggaaagatccggtacgccgccaatcatgccgattaatggactgatgagattgtcgacgatggaattgaccacagcggtaacggcagagcccatcaccacacctaccgccatatcaatcattgatccgcgcgacaggaatttcttaaagccattcaacggacctttatcagtcaaagcaacaactttgcgagcggttcctcccgtggccttggcaaagtcggtggcaatattcatgggattgtggttactcataacggcactccttacgaaattcagacacttcacttgtatccgactggttttcccacgactccattatgccgcttgttggaatatccctataccactgcggcgttcccgtacatgactatgtacgagaacgccgccaaccctgcttgcagagaacctgttagagctgtttagaactggatgtaatcgacttccgtatgctcgccggtttccaagtatttcgccacatcatcaggaccgacgaacaccagttcgaccgcttgcgcaatcatcagattgacacgatccattggcgtaaggttttcgaaatagccgtacaccgggattcccagcgcatgcgcatatccgatttcgaacatcgtgcccgggtcctcgtccataagattggcgaccacggctttagcagcattaatgccatggatatcgtccgcaaagcatccttcagggcctacttcttcgatctggctgacaaaccgcggcttgaacagtaccttgccatggtcttccaatatcttttccaaacgttccatacttgccgtttgttcaggatcgaagaacggaccggccacatagaagtcatactgtttgtcttcactcatggtctctagtcatagcgcagccgcgtcggacgccagccgttattttcactgtatggacaaggggtcgtatcgtgaacattactacgggataaccgtcaatgactacgtacgttgcccccgatcagcacactccgccactttcgccccctcccgtatcgtcgagcacgcgaaccaagccgaccaaatggccgccatcccatgcgctgatcaccgtatccgaatgctgcaatgccttgaacaaccgttccggccactgcgccgattcccaacctaccgacttgaacagcgcctcaacctgctcaacagtaaaccgcttctcttccgtgtattcgatagccatggaccctcacgacaaccgtgaagccccacatgtctttgcatagtttcacacgacgggatgatggatagtggaacctatacgtttacacatgcctaatgcccatggctcatcaccgatgaatagaggctgagataccgtcatgtttccgaagccaagtgcccgagatcggattcgaaccgacgacacccgctttaggagagcggtgctctatccactgagctactcgggcaacgacgtttcattgtacacggccacacgcccagtcgcatcatgttcgcgtggcagcttgcgcaagccatccggcaacctgagcaagccacatggaggaacccgacatcaggtcatggcccggtctttcgtgccagtttggtgcgaactgctcttgcgcacggcgaaaagacactgaaagacaagccgtacacggtacagtggcaaatcgcacgaaaagcaaagtaacagtaaacaagccggaggaaagggcagcatggcaaaggcacggagtactaccacaggcgcaagcgtacgagctcgcgccgctgccaagccacgctctgccagagccacggcacgcccagtatccaagtctgccgtgaagccacacaaacggcatcgtctgcttggttttctcgccacgatgttcgcgcttcttgcccttgccggcgctgccgcccgcgcgctgcctgccgatttacaggaactgccatttgcgccgattgtggtatcggcaacgccatggttcacgttgcttggcttgattgccctgctgttggccatcgtgtcgcggcgtatccttgccgcactaatcgccatcgccgcaatcgcatgcaatggctattggcaatatccgttcttctactcgaccgatccactcccccaagccgcgcagaacgccgtggccgcagcctcccccaacaccagcgatgcctacgcgcgcgtcatgaccttcaatgtgtataaggggcaggccgacccgcaagccatcgtcgagctggttcgcgatcagcgcgtcgaagtgcttgctttgcaggagaccaccgaggatttcgtcaaaaaactcaatgaggctggtattgagcattatctgccgtatgcgcaggtctcatcgtctgacggcgtattcggtaacggcctctggtcggccacgccacttgccgatccgaccgacgatgacgtgaattccagcgcctcattcatgcccggcggcacggtggatatgggtggccagcagattcgattcgtatccgtgcacaccaccgctcccgtacccggctactggcggcagtggaagcgatcgctggatgagttgggtctgatgcgcgagcatacggatacacggtatattttcatgggcgatttcaacgccacttacgatcacacgccattccgtgattttcttggcgaccggttcgtggatgccgcacgtgaatccggacatgggtttacgttctcatggcccacgaaccgtgcggctgtgccaatgttcgccggtattgaccacgtggtgcttgatcagggcatgaaggccggacaatgcaaggtggtcaaagtcgagggctctgatcatgcggcattgttggctaccgtggcggttgggtgattcccctcaataggactagaaaccgaggcgggtgcggccgaattggtcgagccagcgcaaaatcgcgccttcacgcagcgcccacgggcagatctcgacttcctgaatattcagggccttcatgatctcgtcggccaccacgccgccgcccacaatctgcatcgtgcgttcaggcgtgatgccgggcaaagccacgcgctgctcaggcgcgatcgccgccaaacgaggaatccagtcttccaactgctcacgagtcataatccatgaatcttcgcggcccggcgcacgcatcaccgcaccgcacaggcgagccagcgagcggaaggtcttggaggtgccaactgcatgattcgggtgcttggattgcgggaaaaccttgaccatcggctccagaatcttgcgcacgttcttacgcacgtcttccaactcgtcgggcgtggccatgccggaaggcagaaattcagtggtgacgcggcccgcgccagccggggcggaaagcgctacggtcggctcttcgtcggagcccatcgccacttcgagcgaaccgccgccgatgtccagcaccagcagtcggccggcatcccaaccataccaacggcgggcggccaggaaggtcaggcgagcctcatccgtgccagacagcacagtgacgccctgaccaatcagttcctcgatcttgtgaatcactttgttgccgttcggcgcctcgcgcagggcggaggtggccataaccagcagctgggtgatttcgtattcctcggccagccgcatgcactgggacacggcttccagaatcgcctcgatgccggacttcttgattgagccgtcgtcctttaaatacttcatcaggcgcactgtggatttggtgctggcctcggggtcagggcgagcgccgggggcggcgtcgacgataagcatgtggatagtgttcgaaccgatatcaagcacaccaagtcgcgtggtatgcgaacgcagattgaccatgattcctattcctgaccttacctaacccgtgatggccgaacaacgggccgaccatcgcaatcagccagccgtgcgccaccatggcgagtcgttcggccggcaaccaacaccgtgaggccagccgaacatcacacaaactcgactactgtacaacaatcacaccggctgccgcgccgttcacagcgattcgacgaacgttccgagacgttccagcccctcggtcagggcctcacgtgaggcggcatagctcaggcgcacatgcgtatccgccgtggccgcgccgaagtcgcggccaggagtcagagccacatgggcttcatccagcgcgcgttcgcagaacgtccaggcatccagaccagtgcgggagatgtcgaagtaggcgtagaacgcgccattcggctccacctcaaccggcaaaccgatgcgcttgagcccgtcaatcacaatgcggcgacgggccagcaattcctgacgacgagcttcgcattccgccaagctttccggcgtgaagcaggcgagcgccgcatgttgcgtgggcgtgtgggcgcacaggtagtagttggtggccagatcgtcaaccgcttccagcacagtgggctcgtccggcagaatcgcccagccgaggcgccagccggtcatgccgaagaacttggagaagctgttgcatacgatggcatcggggtcgcaggccagtacggacttgacttcggtaccgtccggctcccggtcagccaaatcaaggtaggtttcgtccacgatgcgccatgcgccgcggctggcggccaacttgcacacctcgtccaatacgttgaagtcgatggtggtgccggtggggttggacggcgacgtgatcattacggccttggtcttgctcgtccagtactggctgcacaggtcggcggtcaggtggaagcgggtggcggccgaggtcggcacatcgatgacccggccttcaaacgaccgcacaagttcgcggttgcatgggtaggaggggtcggccacaatcacatcgtcaccggggtccacggtcagcgcggtggccaacagcagagcggccgaaccgccggcggtcacgcagatacgcttggggtcgatgtcaaggtcatgacgctcgcggtagaagtcggcgatggcctgacgcagttcaggtaggcccatggcggcggtgtacggcagggcccggccgtcgtactgttcgcgcatggcgtcgcgtacggcgggcggcgcgccgaaatcgggctcgccaaggcttaatttgatgacgctggtaccttgggcgatcatcttgtctgcttgttcgccgaataccatggcacggaagggattggcctcacgcgctcggcgggacatgactggagacgcggccggagattggggctgctgcgctgcttcgttttccatatttcggttctatccgcctcacgggacaaggtttcttcttctataatcactgtaggtcgattgagtgcaccaacccgtattcaaggagaaataatgagtcgattcaatggcaaacgcgccgagttcgaggccagcggcgaaaagatcaacgtcgcgattctgggtgcgggccgcatagctcacaccatggccgacaccctgacccagatggctgaagattcactgtattcctcatggattcacccgtatgcggtagcggcccgtgatattacgcgcgcgcaggcttttgccgaccaatggcattttgacaaggcttatggatcgtatgaggagttggtggcggacccggatgtggatctggtgtatatcgccaccccgcacagtctgcacgccgaacaggcgatcctgtgtatgaaagccggcaagaacgtgctggtggagaagtcgttcaccgcgaacgccgggcaagcacgtgaggcgctggccgtggccgaggaaaccggcatgctgtgcacggaggccatctggacgcgctacatgcccagccgcaagctcatcaacgaagttatcgagtccggcgagatcggcgaggtgaaagcggcgaacgccaacctgtgctatccggtgtccggcaaggcacgtatgaccgatccggcctgtgccggtggcgcgctgctcgatgtgggcgtgtatccgctgaacttcctggatatggcggtcggcgccgaccatggccgtacacttgatcatttcgatacgtcgatggtgcccgccgaaaccggtgtggatgcgcagaattccaccacgttgtattacagcgacggcacgatggccgtgtccaccagttcgatgctggtttcctccgaccgcggcggctatgtgtggggcaccgagggttatctggtggtcaccaatatcaacaatcccgagtccatcgacatctatgacaacgcccacaagcccgtgcgcagcattgcggtgccgccgcagttgaccggttatgagtatgaggtggccgacgcggccaacgcgctgctggacggcaagatcgaatgcgaggcgatgccgcacgccgacaccatccgcatcatggagctgatggatgcgattcgtgaccgttggggcctgaagttcccgtttgaatcctgatttcagctcccctccagaggggagctgaaattattccgctgaatctgcatctccttcaacaatctgctcatacagccgtacgaggcgttcgtcgcgcacggctttcgttaattcgcactcccatacggtaattacacgccagccagcggcctccagttcggctcgctgcgcgatgtctcgattgtgattgcgcagtagtttcgcctgccagaattccacgttcgatttcggcatcgaatgtttggaacatccttcatgcatgtgccagaaacagccgttgacaaacacgatggcgtggtatttcggcagtactacatccgggtgtccggggtaacgcttgtcgttcttgcggaatcgcaaccccttgcgaaacaggtagctgcgtaccagtacctcaattttggtgtctttgccacgaatatgcgacatcgtgtacgaacgggtaccccgctcatacttctccactggctgtttcttgcgattcacgcactccagactaccgtgacgttgcggcgagaatgagagcctgaacgaacgatcacccatcttgcccgtccgtgtctcttatcgcgggcaacaatcatctgccggtcgagactgcccgattagactgagttcaatggatgacatgacgattcgtagggccacggcggccgatattccccagatcgacgaactgctgcggcaggtgctcgaagtgcatcatgccggccgaccggatctgttcaaaggcggtgtcaagaaatacacggacgaggaattgaaggcgattctggccaacgatcagacccctgtgttcgtggcggttgcgccatctgccaatgacggcaatgacgccgaacataacgccgactcccccgccaccgaccaagtgcttggctacgcattctgcgtgttccagcagcacctcaacagcaatatcctgaccgatatcaaaaccctgtacatcgatgatctatgcgttgacgagtggtcccgcggccaccatgtaggctccaccttgtatcgctacgtgctcgacttcgcccgtcaatccggctgccacaacgtaacgctcaacgtctgggcctgcaaccccaaagcccaagccttctacgaacgcatgggactcactccatattacatcggcatggagcaggtgctgtagcgccgccgtttcagcagcacgatgatggcgatgatcgcagcgaggctgcatagggccacgccatatacaaagcccggagttccgaaattcatgaggcagattgtgatgttaccggtagtggttaccgaaaacacgacgataagcgcgacgatacgaatcatatccagcagtccagctgcttgagccaacagacgctccggtaccaccaatttggccgccgtgcacagcaaagtcgcctgaacggcgagcagaatcgcccattcccagaacatggacggttctttaagcaacgtggtctccggaaacatagacaccacctcattgataaaccacggcgccacaacaatctccacatatgcgagcccaatacaacacacgacaagcaccacggcaatggcatagcgccaagcgacgtctgttttgcgagatttacgagaaatgaatgcgataccagcgttcatggctatgctccttaatccaatatcaatatcaatggatgaacctgcactgcaccgtatgccaccatcataatatatcgaatatcgatataaaaatatcgaaaaacactttcaccattcacctacacatccgcaaacccatgaatacacatgttcttaatcgggatggggagtgcacaaagaagctctgtcaccccagcagattgaggagatcgtccttggtgagggtggcgatggaggcgggggcttcggtgagggcgctggcgccggtgccggcttcgtcggcaagcaaggaagcgtcggtgaactggcgggcgagctcgctcttagtatgctgaagctccaagatacgttcttcgatggtgtccttggccaccacctgatacacgttgacgtcttcggtctggccgatacgatgtgctcggtcggtggcctgatcctgtgcggcggcgttccaccatgggtcggcgtggatgaccacgctggcaccggtcaggttcagtccggtgttgccggccttcagggaaatcaggaaggcaggcgtatcgtccgcattgaactggtcgacgagttcgagacgcttcttcttgggcgtggagccggtgatggtgtagtagcgcaggccttgcgcgtcgaaacgttcggcgatcagatcaaggaagctggtgaactgggagaagatcagcgccttcttgccttcgttcacacaggtttccaccagttcggtgatggcggcaagcttggccgattgatccttggcatcggcgtacagcagcctcggatcgcagcagatctggcgcaacttggtcaactcggcgaggatgcgaatcttcgacgtgttgaaatcggcttcttcgctgtgttcgagctgcattctgagccgctgctcgtgagccgcatacagtttgcgctgttcgccggcaagccgcacggtcagcgtggtctctagcttgtccggcaaatcggtcaacacctgggacttcagcctgcgcttgatgaacacgcccaccaacgactgcaattggcgagatacccgagcggcctcaggattgacttgtgcggcggcccgaccttcagccgtgctgccatccgcggcccgggcattggagatgggcaactcataacgctcatggaatcgcttatatgagccgagcagccccggcatcaggaagtcgaaaatgctccatagttcggagagtcggttttcgatcggcgtgccagtcaaggcgaaacgatggtcggcggccacggccttgaccgctttggctattttcgtggtgtgattcttgatgtactgggcttcatccaatgccatgacattgaaacgttgctcattggcggtgtaatcatcgacatctcggcgcagcaggtcgtatgaggtgatgagcacggtgggttcatccgcccggaacgcacggccgatggcggtacggcgctcggctttggtaccggccaccaccacggcattgaagctcggggcgaacttggtgaattcggcaccccagttgtacaccaaggacgccgggcacacgatcagcgatgggccaaggctgccgtcgcccatctcgccggtattccgctgatatcgagacaggagcaacgcgataagctgcacggatttacccaagcccatctcatcggccagaatgccgccaaaacccttgtcgcacaacgtgttcagccattgaaagccttcgacctgataagggcgcagaatatgcttgagactatccggcacttcatacgacttagggtcgatgatcttgagatcgtcgatgtattcggtgaacgaagcgtccttgactacatcggagccgtcatccggcagctcaccatccagtaggaatgctcgaccgcccggcaactcgatcagtccggagttgagctgctgctcgctcagatcgaggtcgctggccaatcggtccaacgtgctgagattcgcgccgctgagtttgacaagcgtgccgtccttcaactgatggaatcgttgacgccgacggtacgaagatagcaaggcacccacttcgtccggcggcacttcatcagcgaggggtgatatctccaccaagttgcctttgatggacaatccgactttgacgcttggtggcttgggcgcgatcagccggtcaaaagccggtgtggtgaagacctcccccacttcctttagtgccggcaatccctcgtcaaagagacgaacgatctgcgtggtgtcatcgcgatcgatagtggccgcatcagacacgaattttttggtggcctttcgcgcggccggcgttcggaacccattcaccgtctgatgagtggcggccgcaacgcgcttgcgctggtcaggcatggtaaagaattcacgcactacatcaatcgcaagatgctcagcgtcgaaatcacgcccaatcacgccccgagacaaggggatggaacgctcgccctcagcatgcaccgtcgggccatcgggtagcaacgggacaatggcatcgccgtagcgtgccttgacctcgcattgcacaccatgctcatcacgatccagataaaactggaggctgcattccgtaggacttaattcagccagctcgcgaggaatctcactggcctccaacagtccggcaccaaccagctgaggcaatagcgtgcgtgcgaatagggcgatgtcatcgccggcaatgacctgtccctcgccatcgggttcaaacaggtctcccaatagtcctcgcaacggaatcaatcgtttcgggcaacggacgaatcggcatcctgctgcgcttttacgctgagagcccgccaccatggcggataccgcaccggccggattagtggaggcgagcaacagccatacattcttgccgccgtcaatcacggtttccaccgctggcactccggtaagcaggtatccggcatccggaccatacgtattgaaatcacgccgcgcaatgcgcatgagaaaatctggctcgccaccatcaactggcaccgatgcaggctgcccggagaaccatgtgttcagcacgagctgtacgcctctgccctcacgtacggacagcaaccgggccacttccggtgctgaaagcgtcagatgacggtcgatggcgatatgcccgtaatacctgtcctgctgctcggccgcacgacgcacggccatcgcatcatcaaggacgtccagcagggggcgcgaatcatcatcgagcatatccggcgtatgaataaaggcaagcttctgcccataatccgcatagtcgccgttcgccatggcaagcacaaattgcggaatcgatttcagcacatagctggacccattggaagccgagccgatcttgaactccacgctccacacgccgtcgatgaaactcaatatcgggacaagctgcacctgccccaagcccacagtctcgctgtcaccctgatacccgccgcctcgggtgccggcacgagagccgtatccgctttttgtacgccgagcatttgcaccgtttttcccttgcgtggcatcaaaccgacgcataaccgcattgcgacgacgaattttggcttgagcgtcttgcctatcggcgtgctccatatagtcaatcagcgtccgagacggtcgtgcggccccggcacggtagccttcaaaacgctgcggatcatcgcagaatatgaaggcgagcgcaatcatgtgcttgcacatgccatagccacggccgtaagccgggcatgagcacttgccgccgacggcttctcccgtatcgaggtcgaattgcacgctggtacgatacctactcgatgggctggtggtgccacgtagaataccgtcaagctcggcatacccggttcgatgattttcgctgtataccggattgataaccatggtggccgctttgcgcgcaatgctacgggcacgagcgagcacggcattcgacgatgacgattccacatcgttgcgtaacgcaaggatagggacggcatgggcttcggcacgcttcgcagacccggcgaaatggccttcgtcctcatcgtcgaaccatacggaacgtccttgcctgaaacgatagggcatcaccgcatcggcggcggacaaactgtccgttccaccaaacgttacgtctctgctgccggccgcgcctgagctaccaagtattccacccgtctcaccagaaatgccgcctactccgccgcttttaccggcatagatgcccctgcccccattagtgtcatcagtgtcatctatgtcataccgaccgtcgtcgtaatcggcatcttcgtcgtctcctcttttccaaggattgcgacgacgcaacgcatggccccaggaaacgccggaatcatcatcctcataaggcaggaggccatcgtcatccgcattatcgggaacatggccaaacacaccataccctttgctcatgggcgagcctcctttccagcgaatgtatttcaacccaacgtttccatcctagacgaagcgcgcggtagccttaatgtatggatgcagacaagccggcgcaacgcaaatcctatgcagggaacaccaccctcgaaatcttcgaggtgctgtggcgtcacagttactttgggcatggcctgaccgtgcggcaaatactcgatgagcttgcccgtaaacaccagctggaagatccaagcgagctgccgaccgagaagaccatacgaaaccagctcaaaaagctgacctccacggaatttctcggcagacatatcgggcatctcaccgaaagcgaccttgccggcatcgaatgcaagaatccacaacccggctggtatcttgatgcattcctgtccactgccgaaatgcgactgctactagacagtcttaccctatctcgcatcagcctcgacaccatggacgacctcatcggtaaaatccgcgagctcgcaggcgccgccgggcaggcagtaggctacctggaccatgtggccacctacacgcatatcaacggtgagttcctatccactatcgaccagctgaatcaagccatcgaagaaggccacggcgtaaccttccaataccgtgattacggaccggatggcaccttgataccgcataaaagccgtacgggtgcaggccgaattacctacaccgccgacccttaccaaatggtgtacaagaacggacgctattacctcatctgccacctgcatggcgaagacaacctccgcattttcgtggtcaaccgaatcgccaacgtcagcgccaaaggcaggaacggcacagtgccactggaaaaaccagcaccagctgattttgacgcagtgaacttcatgcgccaccgtccataccccgtagccgatgccccgattcgcatccgcatggccgtacgagacgaatccatgctcaacaacgtgttcgaatggttcgacgaccctcaaatcaaacattcaccggacggcacacagttcgaagtcatcgtcgatgctcccgaacgcgctgtgttctggtgggcattgcagtattcctgggatggccgcgtagtgattcttgagcccgattcgctcaagcgcaaactctatgatgccgggcgtcgcatggccacagcctatgctcccgaatgatgcaacatcacatcgcacacctccttgtcgagttgttcaccagcgaatttcaccggagaacctatcatcccatcgccaatcacactcggtaattttttaccgggaaatacgatttcaagccatttcgcgggcatcgtccctcacctaggcgcacataaggctaaggtgggaatcattaatcgcatcgcgcgtccacaagcgtgcactagcgcgtacaacaataaggagcaactatgagcgaagagcgtaccgcatggggctggggtctggccagcgtagacgccgccggcaccaccctggacgtctggtaccccgaactgaatctcggtgaggcaccggccgagtccgatcgcccgaaccacaatttcggtactttggctcacgatgaggccgacgcccgtggcattcgccgcgtgccggtattcgtcgtcagccagttggacgagccgatcagtaatgccgcagacgcttacctgaagctccatttgatgagcatgcgcatggccaagccgaacacgctgaacctcgacggcatcttcgcccagctcgccaatgtggtgtggaccaactacggccccttcgccgttgaagacttcacgctgcgcaaggccgacgtcgaacgcgcctccaccgaagccgctctcgctttcgcctcccaggccggactgcctgccgcagctcctgccgccactgtcaacgtgttcggtgtggataagttcccgcgcatgatcgattacgtagtgcccaccggcgtgcgcctcggcgacgccgaccgcgtgcgcctcggcgcttacttgtcttccggcaccaccgtgatgcacgccggattcgtgaacttcaatgccggcacgctcggcgtttccatggtcgaaggccgtgtttcgcaaggcgtggtcgtgggtgacggttccgacatcggcggcggtgcctccatcatgggcaccttgtccggtggcggcaagctgcgcaattccatcggcgagcactcgctgctcggcgccaacgccggtatcggcatctctctgggcgataactgcaccgtcgaagccggtctgtacatcaccgccggcactaagatcaccatctgggacaaggccaaggccgccgctggcgaaccgctggaagtggtcaagggtgctgagctctccggcaaagacaacattctgtttatccgcaactcggtgaacggccgcatcgaagcccgctaccgcaaggtgggaattaagctcaacgccaagctgcacaagaactgaaattgaaataatggagcgttatcttcgttgcccctcggtcgacgtaccttcgtacgccttccctcggtgcgcctcgataccgcacacattatttcaatttcagaactagccctgctagttcttatgcagccgtcgcagcatagctggtttgcgctgtacatatagaaagcgcctcactggaatctccagcgaagcgctttctcaaaccaacaatcaccgctcgtccatcggcacgaaatcgcgctcgaccggaccggtgtagacctggcgtgggcggccgatcttggtattcgggtcggccaacatctcacggtactgcgcaatccaaccgggaatgcggcccagcgcgaacagcgtggtgaacatggccggatcgaagccgatcgcccgataaatcaagcccgtgtagaagtcgacgttcggatacaggttgcgcgatacgaaatattcgtcattcagcgcaatatcttcaagctcggtggccacggcgaacagcgcgcgctcgtcagacggcagcttctgcgtatcttcgcgctccatgatcttttccagatacttcctggcaatcgccgcgcgcggatcatacgacttgtatacacggtggccaaggccggaaatcttctggccattctccttggcatcacgcacgaactcggccacagacttgccggaatcacgaatcgccttcaattggcgcagtacggcctcattcgcaccaccatgcaacggaccagacagcgcattgacgccagcggccaccgccgaatacaggttggcgtgggcggaaccggcgatacgcaccaccgaggtcgagcagttctgctcatggtcggcatgaataatcaacaaacgacccaaagcatgcacatacagcgggtcggattcaaacggctcgtacggcacagcgaagcacatgcgcaggaagtcgtccacatagccgcgcgcgtaatcggggtacagcatcggctcatcgcgacgacggcggaagatgtacgacacaatcgtacgggccttggccatgatgatcttggcggcctcatcaagctggtcgttgtcagaaatatcggtggtgtccgggtagaacgtggccagcgcattgatggcggaggcaagcacgctcatcgggtgagcggagcgcgggaacgaacccatgaaggtacggaagtcttcgccaaccatcgtcttgtgattgatgtccgcacagaactgctcatactcagccctgctcggcagctcgccgtggcgcagcagccacgccacctccagaaaatcggagttctcgcacagttgctcgatggggtaaccgcagtagcgcaaaatcgaatgcttgccgtcgatgtaggtgattttcgattcgcactgcgcggtggtgaggaatccgggatcaagcgttacccagccatcgttgcgcagtttggaaacgacgatgccatccggccctgcactagccttaaccacgggcaggttgaacttgttcgaatcgacatcaagttgtgccgttgccattcgcgcaccttcctcttcatgaaccacttaccccaaacattaacgttcacgcgttcgcgaacactagtgttcggtactctatgtcttctgtgttaccgctggcgaatgccggtcgatacacgaaagccgaagtgcgctcatgctatcaaagcaaacgcacttcggcttgttacgtctcgaattcgcgggaaaaccgcgaacagacggacggctaatgagacgctgatcgcccatcacaggccaatcaggcacctaccatacgccaaacgccgatcagaggttggtgcgatcggtgaagacgatcgggccgttctcggtgatggcgatggtgtgctcggagtgggcgccgcgcgagccgtcggaggcacgcagggtccagccgtccttcggatcctggaagatctcgtcggtggtcttgaggaaccacggttcgatggcgatgaccaggccttcgcgcagcttgtagccgtggtgggcgcggccgtcgttcggcacgtgcgggtcgccgtgcatgatgtggcccacgccgtgaccgccgaactcgaggttgatcgggtagccgtattcgcgcgcgacgtcgccgatggtgttggagatgtcgccgagacggttgccgggcttggccacgtcgatggcggcggcgagcgcttcctcagtgcacttgatgatgcgcaggtcttcggggtccgggtctttgccgaccacgaagctgacggcggaatcggccacccagccgtccacagagatggcgagatcgagggagacgaggtcgccgtccttcaggctgtagtcgtacggcacgccgtgcagcacggcgtcgttgacggaggtgcagatgtagtgggcgaacgggccggtgccgaagtcaggagcgtagtcaacatagcaggattcggcgcccttgcggtccacgatcttcttgtggacgaactcgtcgatttcgagcaggttggtaccaactttggtggtctcctgcagttccttcagaatgccgccgacaaaacgaccagccggcttcatttcctcgatttcacgaggggttttcagttcgatcatgagattctttctaccttgttgagacttgttctcaactctagaccagcccgaggtcaaccgccagaagcctacctgaaatccactcgcagcccattaatagccaaggccgagaaaaagcgcccggcagcacatagcctgcacgggcgctttggattgattgtctggggactggttgcatgaagcgtgagattacttgcgacgcttgccgaaagtgaacgcgcgaatcactgaagtaatccccatcaccaccatggcgcatccgccgaagataatcatgaatacggcggagctcagcgggctcatcagcaccacgaagccggcgataatcgagatgatggcataggcgatggcccagccggaatgcgggatacgccacgattcaaccagcgacagcacgccttccataatccatccgaaaccgaccatcaaagtaatgagtaatgccagcgtctgaccggtcatgccgtagttgcgcacaaccaccacgccgccaaaggtcagcagaatgccgacgaacacgtccagcacacgccagccgcccggcagacccggctccacgagagcgctgacgatgcgcaccacgccggaaatcacgaaatacacgccgagcaacaatgcggccaaagccagcgtcttgttcggcaccagcaacagcgcagcgcccaaggcgatggcggccacgcccaccacgccgtaaatgatgcgaatcttggtcttggctttttccggcagccattcctcgatcaggcggaatggactgaaattgccgacataccagttggtctgctgccagccgggttgactttgatcgccccatggaccattcggctgcccgtccgcttggctattcgattggccgtccgcctgataccgccgaccgtccggcccccatgccggctggccgttcgggtcatagttcggattgtaggcgtacgggccgtagtacgggttctggttcggttcgccttgtggctggccgttctgcgcatgctgattctgagtgtcttgcgctcccggcgcaccttgcggaggatattggccgccatgattgctgtcatacgcaccatactgcggttggcccggttgacccgccggattcggctggttcggctggctctggttgggctggcccgtctggccattccactggtcctcgttcggattgctcatcgtaactccttagctcaaggtccatgttcagattccacatactatgatagacaagttgtctaatttgaaccatcaccacaattaggcaatctgtctagttcactgacagcgcaatgcccataacgcaatatctgcaccatcaacgcttctcccccgccgcgattaggcttagggccatgaccaacgaaaccgaaacgctgacgtcgggcatcgacccggcatcgttctcctccgtcatcaagccgaccaacgacctgttccgctacgtgaatggcccatggatcgacacctaccgattgcccgacgatcgttcgcgctacggctccttcgacaagcttgccgaagacgccgaaaaccaagtacgcgacatcctcgacgccgacgactgcccggctgtcaagtctgaggccctgtaccgctcattcctcaacaccgacgccatagaggccgccgggcttgacccaatccgcgacgagcttgacctcatcgattccgccatcgacaaggccgcactcacgcgcgtgctcggcacgatcaacccagccggcggccccgatctgttcggcttggccgtttacggcgacccgggcgacccggaccgcaacatcgcccaccttgagcaggccggcctttgtctgccggatgaagcctactatcgcgaggatcactacgctcccgtgcgcgaagcatacgtggcgatggtcgccacccagctggtgaacgccggatacgcgcccgccgccgagtccaacggtggcgatgagctgccgtccaacaccggcgatgacgagagcaacgctcccgccacggttcccagcgaagccgcgctcggcatggcccgccacttccttgccgtggaaaccaagatcgccgccaaccattgggacaatgtggccacgcgcgactcggtgaagacctacaaccccaccgattacgccgatctggccgccacgctgaaaaacttcgatctcggttcttggatcgacgcttggcagaccgcttatgacgccaccgaagccgccaaggctcagccgattgatttcaagtctgtgttcgcgcgcgtcattgtgcacgagccgagcttcctcactggtcttgatgcgttctgggccgaggccgatctggccgaccttaagctgtgggcccgtgttcacatgattctgggcttcgcctcctccctgtctcgcgacttcgacaccaccaactttgacttctacggcaaggtgctctccggtgccaagaagcagcgcgatcgttggaagcgcgcggtgagcctggtcaacggcatttgtggtgaagatgtgggccgcgaatacgtgcgcctgcacttccccgaaagctcgaagcgccgcatggaagagctggtcgccaatctgattgacgcctaccgcgtgtccatcaccaattccgattggctgggcgaggacaccaaggccaaggctctggagaagatctccaagttcacgccgaagatcggctacaccaaccactggcgcgattattcggcgctgagtgtttccgcggatgcgctgcccgccgagaacgccaaggccgcgaacctgtacgagaccggctatcagctggccaaggtcggcaagtcggtcgacaaggacgaatggctgatgaatccgcagacggtgaacgcctactacgagccgagcatgaacgtcatcgtgttcccggccgcgattctgcagcccccgttcttcgacccgaaggccgaggatgcggcgaattatggcggtatcggcgcagtgatcggacacgagatcggccatggcttcgacgatcagggttcgcagtatgacggcgacggcaagctcaacaactggtggaccgacgaggatcgcaagaacttcgaggcccgcaccggcgcattgatcgcccagtacaacagctttgtgccgctgcagctggcagagaagtacgctgacgagtctgataaggcgccgcacgtgaacggcgcgctgaccatcggcgagaacatcggcgatttgggcggcgtgaacatcgcgctcaaggcgtatgcattcgcgctcggcaaggcggcaggtaagcccgacgccgaagaagacggctcccccgccgccatcaaggcactgctcgataccgcccccgaaatggacggattcaccggcctgcagcgcttcttcctgagctacgcctccatctggcgcaccaagaaccgcgacgagctggccgaacagtacctgcagatcgacccgcattctccagccgaattccgcaccaacggcatcgccagcaacgtggacctcttctacgatgcctttggcgtgaccgaaggcgacgccatgtggctcgcgcccaaggaccgtgtgagcatttggtaatccccgttatgtaagagaaaaccgctgtgcttgcctcgattacaggcgaacacagcggtttttcatgatgtatggttggcactcagaattcggattcgctgggatcggaagattcggcgaaaccgtcgacgtaggtttgttgggctgcggactgtggctgattagcgccagcgtccggttgcgacatgacggcatcggccatggacgcagccgctgactcggttgatggcgacggcgattggccggaatcggaggtgaccccaaattcgacggggccagattccgacgaggtcgcatacgggtcaatgcccacaccggatgcggcaccgtccacactatattgcgttggcctcatgtgcggtgacgatgctcgttgcccgtttccgccatccatgccttcggcggcaccattgacattgccgttaccgttgccaccattgcctccgttcccattaccggcacgctgtggcttgatcagcgacgtggtgccgaaggtcaggtcatgcccaatgttggtggcttcgagaacggttctactgcgcggttcgccttgctcattggtccactgctcggtgatgagtgagccgaccacaatgatgcggtcaccgcggcgaaccgaactggcggcgttcacggccaaagcacggaacgctttgacgcccacccatgcggttccgtaatcctcccattgtctggtagtcgggttgagtcgactgcgggtgctgcccatacggaatgtcagcacgcggaaactctcagttccgcctagtgtcggatcaccggccacaaagccggtgacggtcactgctgcttgttgatttgccatgatcggtcctttcctcggcctgctggcctgttgtttggatgtggaccgccggagcctgtctccggcttcattgccggcttgcacgccccagcggtacctccactgtgaggcatgacgtttgaagcgcacaagggcaactggcaaatgtggatactgtgacgcagttgaaattttaagaatgtggataagtttcggttatccacaacaaagcgccattctgcgactgggcagaatggcgcttgatgcgattaacgccgaggctgagtaagtgggactcagctgagggcggcgaagcgctcggcgagcgcgtcggcggcttcggcggcgggcacggcgaccttgttttcgccgttgcggtcgcgcagttcgatggtgccgtcgttgacgtaatcgcggccgaccacggcgaccagcggcacgccgatcagctcggcatccttgaacttgacgcccggagacaccttcttgcggtcatcgtaaataacctcaaggcccttggcctcaagctcggcgaccagcttctcggcaccttcaaacgccacggcgtccttgccggtggccaccacgtgcacggcggccggggcaatcacggacggccaagccaagccggcttcgtcgtggtgtgtttcggcgatgcaggccagcacgcgggaaacaccgatgccatagcagcccatccacaccggcacggccttgccgttctggtcgagcaccttcaggtccagtgccttggagtacttgagacccagctggaacacctggccgatttccacaccacgctcgaagctcaacggaccggaaccatccgggctcatgtcgccgtggcgaacctcaacggcttccaccacgccgtcgaccttgaagtcacggccgtacaccaggttgtagtagtcgacctcgttctcatcggcaccagtgaaccaagcggaacccttgaccacgtgcgcgtcgatcaggtagcgaaccgggttcttcacgccagcagcctcggcctgcgggccaagcaccatcggtccgatgtaaccgggcaccagttcggggtgctgcttcaggtcttcctcagtggcttcctcaagttcggcgggcgcgaactgggcttccagtcgcttcatatccaccgtacggtcgccgggcacgccgacgacaatcacttcacgccacggctcgtcatgctcttcatcctcagggtgcttgacggtgatcaccacgttcttgaggatgtcggaagcctgccattcacggccatcagtacgcgggtggtcggcgttggcacgctcgatcatgttatcgatggtcttggcatccggggtggcttccttggaagcggcgggagtggtggaagcatcgatttccggtagttccggagtgctcagggcctccacattccatgccttgccggaaggtgccagcgcgaaggtatcttcgccgatcggcatcggagccaggaactcctcggatgcggagccgcccatcgggccggacatggcgaacacaggtacgtacttcaggtcaagacgctggaagatacgctcgtaagcgccgcgctcgtcatagtaggccttgcgcatgccttcttcatcgatggtgaaggagtaggcgtccttcatgacgaattcacgaccacggatcaggccggcgcgcggacggaactcgtcgcggtacttggtctggatctggtacagggtgacgggcaggtccttgtaagaggagtacatgtccttgaccagaagggtgaacatctcctcgtgggtgggggccagcaggtaatcggcctcgtggcgatccttcaaacggaagatgttatcgccgtactcctcccagcgatgggtggcctcgtagggttcgcgcggcagcagggccgggaagtgcacttcctgggcgccgatgccgttgatctcctcgcggatgatggcctcgatcttgttcagcacgcgcagaccgagcggcagccaggtccagataccgggtgcggccttgcggatatagccggcgcgctgcagcagcttggctgaatcgacatcggcatcagcggggtcctcgcgcagggtgcgcaggaacatggttgacatacgaagggtattggaagtcatgtgttccacgatattcgcgtgaaccgacaagcccgcctgctattcgcactattccgaccttcatcttggcattcggactcactcgtgcaacaatgacggctagaagggtagaagggcacgatgacgcaaccgaccgagcaacaggggaatcagccggaatcctcggagcagccggtgtatcaaccggccccagcatgggccccgcaattttctgctgcagcccccgcaattcccaacggcagttccacaacaagcggtatcgcaacagccaatggccatgccaccgtttgcgcaatcgcctatgtcggtcccggaacaagcggcctgcccgtatcaaccgtaacagccgggccgggcctatgcttctccctgcccctacccgaatccggcaatggcccagccgaaccaaccatcagtcgcgcaagagcgattcgggcgttcgtcgggacggctgaccgcatcacaggttattgagacatgcgccaccattcttgccggcgtaatactcctcggtcttgcatggaccaacccgcaaccgtatgccccggtggatcttatcgccggcctgtccggagcggccgcgctgattgtgggtgtgcgtttgccgcaagtacgcccgatgctgcgtagctggccggcattgtggcttgctttgggcggcatcattctgattgtggcagccgcgcgctatgaggcgagcctcaaatcgatgaggacgattgccgcgcgtattggcgatctgcggtgaatcgcgcgggcgacctgaggcagattaccaacgtccggcgatagcagtcctgcatacggggcagtgcccattgccaccgtatccggcagataaacgattggcaatgattcgataccaatcgcgttccacgagcttggcccggcattcagggtttgggcaatacgtggtatcgccttcacgatcatgcacgttgcctgtgtacacataattgagtccctcttcgagggcgatgtctcgggcgcgggtcagagtctcgtgcggggtgggcggtacgtccatcatgcggtaactggggtggaatgcggagaagtgcagcggcacgtccggacccaagtgctcgcgtatccatgtacattcagcatgcagctgggcgtcgtcatcgttgaatccagggatgagtagcgtggtgagctccacccacacgtgttcgccttctggtgtgcgtgcctcgttgaccgcatagtcgatggtctcgagcacatcggccagatgagtgccggtcactttccaatagaactcttcggtgaagcctttgaggtcgatgttggcggcgtccatggccgcgtagaagtcgggccgggcttcggcgctcatgtatccggcagtcacggcgatgggatggatgccgagcgctcggcaggcttcggccgtgtcgatggcatattcggcgaacacgatcggatcgttataggtgaacgccaccgaatcgatgccccggtcggccgcgacctgcgcgattttctccggactggcttccatgccgagccggtcgaagctgcgggctttggcaatatcccagttttggcagaatcggcaaccggaattgcagccagccgtgccgaaactcagcacactggaaccggggtggaagtggttgagcggcttcttttccactgggtccacggcgaagccggagctgcggccgtaggtgtcggagacgatgagtccgtcgtggtttgagcggacgaagcaaaagccgcgttggccgggcttgaggacgcagcggcgcgggcatagttcgcagcgagcgcggttggtaccgtcgtggaattgcgtttgccagcgggctatggcggggttacgaacatctgtgactgacgccgtatgaccgcacgattcccgatgaccaccctccggcgcttcgcgccacctcttgccagcgggaggagatatggttgctgcgttaatgctcggcataggcggtcacctcgtagcgttgacagtcgatttcgctatcggtccagtcgtaggaagggcggataccggctttggcgagcaggtgagcgacgaaatcgtgcggatcgggcagctcatcccacacttgtggcaggaatgtggcgctgcggccacgacggtcggcgagaatcagaccgtctttgccggggcgtaatacttcctcaagttcagtgcgcgaacgtaccgggcgttcgacgttgctgccgtcccgtttgacggcgtcggtctgaggtccggattgcagcgatgccagagtcgcggtcttcgagccggtaccgcgcgaatcggcgtcacaggagttcactgtaatcggctcgggctcacccaagacggatacctccacgttgagcagcgggtattccgcggcggtgaccggggtgaaacgtgggtcgcgggtggcggcatccactgcgtgctcggccacgtccttgccgagcgagcggtgggcgaccagcgaaccaatgcacccgcgtagccggccaccctcggtcagggtgacgaaacaggcaccgggctcgttcagccatgggtttgcggcaagaatggacgcggtcgaatcagcggcggtcggatgctcgatatgcagccgttcccggatagcggcacgggcaagtttcagcagcacctcaccgtgggatggcgtacccgatgtgcctaagtcatctgcaccggctagagcatctgcttccggcttggattcccacgcggcaaacgagacatatcccactaccggctcgtcggcgtctcgcattgcggggcgaggttggccggcgagcgccaccacgccgtcgtcgccggaagtggaacagccgagctcgaagagcctcatgtccttgcggccttttaacacatccagaaggccgttgatcgggtatgcgccacaggcccggcgagggtgaatcggcagatgcaaagccgcaatgtccgcaatggtctggtcatccaacgcgcgggcgacttcgtgcggatgatagtgcgagagatccgaactaatcacgatgacggtttccgggccaccccacaaagcacgcaacacatcacccacctcttgtggcgtggcatcgcccgcgttcaacggcacgatagtgaggtctgggccgagcacggtctgcaggaacggaatctgcacttctaccgcatgttcttgtgcgtgggttggggcattgacgatcattgcgggagccggcgcgcccggacgggcatgtgtaccggagcgcaatggctcattgacagacaggcccagagccttacgctcggctgcaatgtctaccggcacagtgcccagcggcgtttcaaacgccgctgccgtggaacaggcgacgcctcgcacggccacgcggtgagtcggccctacgattaccgcgcgagtcacgctcccccgcccacgctccaagagcgcgtaagcgagcgcagctgccgtgccggaatatatgtatccggcgtgcggcactattaccgccctcggcacccacgctggaagtgtgggctccaactgttgcagaagctttcggccgtaatcgagctgctggttgattagctgtttgagcgcggtgcggtcagccggataaaacgaaccggccaccgctgacggacgtattgcgccagtgattttgccgctgccgtctgccgcgcttgctgcatctgacgcactagccacactgaccgtatcgatttgcacaccggctcgggcggcctcgcgaacctcattgtttccacgaaatatctcggatagcaccataactaccacctcttattccatggtagctgctacggagcgcttctaaagatcagaacaacgcgtcctgggcgaagtcatcgtcgggattggcaccgaattcgtccggctcggcgggtttgaacgcgtttgcaccttcatcggccaactggtcggaggccgcggccgaggcttcgcgcaggtcgccgtcgagcaccacggcatcgggcgagacgaggaacatgcgttcgttgacgccggccaaatagaggccgcccagcgattcgactcgggacagcgccacatatcccatgcctggcgcgaaggtgcgcttcaggtccatgaccgcacggtcaagcgtcatgccttgcgacttgtggatggtgatgccccacgcgcagcgcaacggcacctggaagacggaggcgagcacggtgtcgccgtccatcatctcccatgtggcctgtttcatggtgacgatgttgccgttctcgaattccacgatcggccagccgcccttgttctcctgtgcgaagccacgcacggtgccgagcgagccgttgacgtactggcgatcggtgtcgttgcgcagggccatgacagccgcgccttccttgagtatcaatcgctcggggccaacatgttctttttgagtcggtcgaccaggttggcagggcctgctgtctcggcgtggaactcgtgtggatcaagcatgatctggttcaggcgcatgtcgttgagattgtcggcctgccggttcaccgggaacaggtggacggcgacctggccgggctcgggcagtttgcccagacgagtgacgagcacgtcacggtcggactgggtcacgtcgccttcgcgaatgtcggtgagcacggtcagcagttcgccggtatcctgacggtgctgttcggtcagatagcagatcaccgggttgagttcgggccataccagcgattcggtgatgaagccttcggggttcaagccggcacgggcataccgttcgcgactggcgatgaattcgggcgtgggggcgatgaggtcgcggttgcgcccggacaccgaaaccggcggcagctggaagaagtcgccggacaagacaacctggatgccaccgaacgggcgtggatcacggcgtacttcgcggcagacttggtcgaccatgtcgaacagccaagcgtgcagcatggaaacctcgtcaatgacgaggatgtccgtggcctgaatcttgcgtttgcgccgggatttgatgagtttgagcaggctggcgctcagggcggtggccacgccgacgccgctccacgaatgaatggtttggccgttgatatgcgtggaggcgatgcctgtggacgcggtgactgctacactggcgccgtcggcccgagcctggcggatgaactcgttcaagacataggtcttaccggcaccgggcgcaccggtcaggaacacgttcgcgccggcgttcagaatggccagggcttcggtttggcgcatatcaacctctctagactcccctcagggaggggagccaagtacggcggactacttattgaggatgctggtggctacgatgtcggcggcgatggccttggatgcggcatcgtccgggccgggggcgggagccataaacgccttacggtagtagcgcagctcgtccaaggactcgatgatgtctgcgagagcacgatggccaccgttctttggcgggcggttctcgtacacggccgggtaccagcggcgggcgagctccttgaatgtgctcacatccacgctgcggtaatgcaggtggctcatgaggttcggcatgtaatggtcgaggaacttcttatcggagccgatggtgttgccggccagcagcgggcgcacgccttccgacgtgaagcgcagcacgtattcggtgaccttctgctcggcctcggccaggctcaggccattctcccactcgttgatcaggccggaacgggtgtgcatctggcgcacgaaatcgttcatatggttcacggccttctcggacggcttgatgacgtaatccacgccctcgtccagcacattcaggtcaaagtcagtgggcactacggacacctcgacgagttcgtcgccgccgaagatatccaagcccgtcatttcgcagtcaatccaaatcaggcgcgaatcctttgcgctgtaagtttctgcatcatggctgtcgaccatggtaagcctcttttcgtcatgtcacccgttattacaagaacagttcagactataccccagcgcatacaagctatctcgagccacatacgcgaaaagggcctgcataagcagacccttttcacaaggaatcaacccctaactagcgcaagctagcgggcatcaaccgatcagttgttgtggaagccggagtagttcggggcttcggtggtcatcacgatatcgtgcgggtgcgattcgcgcagaccggcgtcggtgatgcggatgaacttgccacgctccggcatctcggcgatgttgtgggcgccgatgtagaacatggactggtgcaggccaccgagcatctggtagagcacggcgttcagcggtccgcggtacggcacttcgccttccacgccttccggcacgaccttgtcgctggaggtcacgtcggcctggaagtagcggtccttggagtaggacttcttgccgcgcggggccatggcaccgagggagcccatgccacggtacagcttgtactgcttgccgtgcaggagcaccttctcgcccggggcttcctcacagccagcgagcgtgccgccgagcatcacggaggaagcgccagccacgagggccttggcgatgtcaccggagtagtggatgccaccgtcggcgatgcagggcacgccagcggcacggcaggcctgggcagcctcgtacacggcggtgagctgcgggacaccgacaccggcaacgatacgggtggtgcagatagagccggggccaataccgaccttgacggcgtccgcgccagcctcaatcatggcctgagcaccggagcgggtgccgacgttgccgccgatgatctgcacgccgtcgaaggcggagtcgtgcttcaggcgggaaatcatgtcgagtgccagacgggcctcaccgttggcggtgtcgaccacgagcacgtccacgccagcctccatcagagcggaggcacgctgccaggcgtcgccgaggaagccgacgccggcggccacgcgcagacgaccctgctcatccttggtggcgtccgggtactgctcggtcttgacgaagtccttgacggtgatcaggccggtcaggtggccttcctcgtcaacgagcggcagcttctcaaccttgtgctgggcgagcagacggtgagcgtcgtccttggaaatgttggacgggccagtgaccaggttctccttggtcatgacatccttaaccttcagggtgtcgtaatcctcggaggcgatgaagcgcatatcacggttggtgatgatgccgacgagcttgttttccttgtccacaaccggcagaccggagatgtggaacttgccgcacagcttgtcgaggtcggccagagtgacctcggggttgacggtcagcgggtcggtgatcataccggactcggaacgcttgaccacatcgacctgagcggcctggtcgtcgatggacagattgcggtgcagcacaccgataccaccgttacgagccatggcgatggccatctcggactcggtcacggtatccatggcagcggagaggaccggggccttcatcacgatcttgcgagtcagatgagtgctggtgtccacttcggagggaatgacatccgtctcgttcggcagcagcaacacatcatcataagcaaggccgagcttggcgaaaatcggaggaaggggagcatacgccgattgggcgttcaattcatcgaggtttgtagccatacaaacactatatgaacacgcgctgaccttcacgacacacgcttgtgagcgctcacttatccgctgccgggtcctgcacctcacccgcctgcgagtcccgcgaatccgcaggcgaatcagtcatcgaatccgctgcctgagagccaatcgaatcccggctctcccctactgcagactgcgacttaaccgtagcatgctgcgcgttcttgcgtgcggattcgagcgtcaggttctcggcttggatctcgggaatacgatgccgcagataggggtacatcgtggctatggtcagcaccaccacggcgatgggcatgcccacggccacatgctgcgctttgaagaacagaatcgtcagcgaaccgaatgcgatcagcgcggcccatccccacaggatcagcacggcgccacgcaccgaatgcccgatcttcagcatgcgatggtgcaggtgcatacggtccggatgcatgggcgactggcctttggccaaacgccgcacaatcgccagacacatgtcgagcacaggcaggaacaacaccagaatcggcagcagaattggcatgaacaccggcagatagatgctggcatgaatcgaggccgggtcaagacgtccggtcatcacaatcgaagcgcaggtgatgagatagccaagcagcatcgaaccggaatcacccataaacagtttggcgggatgccaattatgcagcaggaagcccacgcagatacccaccatcatcacgtcgatcagcgtggccaacgaagcataactcggggaagaccgggcgatgatatacgaataggcggcgaacgctatgccaccaatcgccacgataccggccgccaggccatcgaggccatcaacgaaattgaccgcgttaatcgaggcgacaatcaggaatgcggtgatcgccatggacagactcggcgaggcggtaatcagcgaaccgcccaaaggcagtgagatgatctgcaatccgccccaagccacgaatacggaaatcagcagctgaccggcaagtttcagcatccaatcgagatcccacaggtcatcggccatgcccagcagactgatcatgatgccgccggcaagaatcacccacatctggtaattgccgttgaacaatcccgagagaaaaggcagccgactggcgaatacggtagccacggcaaaaccgatcagcatgccaaggccacccatgcgcggcgtgggaatggtgtgcacgtctcgggcacgcacctcgccaaccgcaccgatttcgatggcgacgtggcgaatcagcggagtcaccagccaggtgacgccaccggcgatggcggcaatcagtaggtagattctcatgcgccgagtccaccgccgttgaggtggagggccttgcgaatcacgttttgggcgatgacgccttcacgcaggatctcgatgccgtcgcgcgcgtacggatcggctttgacgacggtgctggagacatggccttgggtgggaccgccgtccagatacaggtcgacttcgctgccgaacgcgtcaaccgcctcctggacggtctgcgcgctttcgtcgccggaacggttggcgctggacgcggccagcgggccagtcgccttgagaatcgcgaggcacagcgccgaattggggatgcggatgccttgcgtgccggggcgaccatcggcggtgtcggccaaagtctccaacgtgcagtcgggccgggctacggcaatcggcgagaacgcgccaggcagaaacgccgccgacaaacgattcagcggggacggcaggtcgagaccgagctcatcaagctggtcggtggatgcgagcagtacctgcaacgccttatagcgcgggcgacgcttgagccggtagatacggtcgatagcggccttattacgcggatcgcacgccactccatataccgtatccgttggaatgacgaccaatccaccatcccggatgacacgcgccgcctgtgccagcgattcatccgtgactttcagcgttgttccgccttccacgctcacgccacctccgttcgcttgtgtattcacaatctaccattgcaccattgcgccccgacttgcatagttcatcatcgctcgtttgccgtactgccgttttccgattcgccccacacgcacagaccgtagatacaatgagtccatccatgctctttcgcgaaattacaggagtgttcaatgagcgaaatcaatgctgaatccaccaccatgcctcccgtcgaactgcgtatgccgcgcgccagcgagcgcgaggagatgctcgccggcaaactgtacaattcggtagaccctgaattgaatgccctgcgcgagaaggccggcgacctgtgcgcgcgcttcaacgccgcgtcgcgtaccgatcatgccgcccgtgccgcgattctcgatgagctgctgcccggccacggtgccggccttgacgtgatggggccgattttcttcgactatggctgcaacatcaccatcggagagcgcgtgttcgccaacttcaacttcactgtgctggattgttgcccggtgacgattggcgacgacgtgctgttcggcccgaacgtttcgctgctgccaccgatgcatccgttgcgttggcaggatcgtaacgtgaggcaggcacctgatggttccgcatacgactgcgagtatggcaagccgattgtcatcggctcgaactgctggtttggcggcaatgtgacggtaatcggcggcgtgacgatcggcgagggttgcgtgatcggtgccggctcggtggtgacgcgcgatattccgccgcacaccgtggccgtgggtaatccggcccgtccgattcgcgagattacggataaggatgcttccgcgctacagtattacgcgcagtgatatatgaatgctcccgctggcgagctgtcagcggagctgactgagggtggttgccggaaatctccgataaccaccctcagcctcacttcgtgaggtagctcccgccagcgggagcatagtaatgtgagacgtcacgcgccgaggtacgccttgcgcaccttctcgtcgtgcagcaggtcggaggccttgccctccatggtgatcttgccggtctcgagcacgtaggcgcgatccgcgatggacagggccatcttcgcgttctgctccacgagcagcacggtgatgccacgcttgcgcagcgtgacgatgatgtcgaagatctccttgaccagcagcggggacagacccatcgacggctcatccatgaggatggtcttcggatggctcatcagggcgcggcccatggccaccatctgctgctcaccgccggaaagcgtgccggccagctggcggcgacgttccttcaaacgcgggaagtagtcgaacaccatctcaagatccttacccagactggactggtctttgagactgaacgcgcccatctctaggttctcctgcacgctcatgcgggtgaacacgtggcggccttccggcacatgggccatgcccagcgtgacgatcttgttcgcatgcgttttgagcagatcgtggccatcataggtaatgctgccggatttggcaggcaccagaccggtgatggtgtgcagggtggtggtcttgccggcgccgttggctccgatcagggagacgatctcgccgtcgttcaccttgaggctaatgcccttgaccgcgtcgatcgcgccataggaaacgcatagatccttgatttccagcatcagcgcgctccttccgtcagtgtcttggcaatgcttggctccggttccgccttggtggtggaatcgccgtccgcgtcatcgttgttgtcgctgcccaagtaggcggagatgacctgcgggttgttggcgatctcctccggcgtgccggatgcgatggtgcggccatagtccagcacctggatgcgctggcatacgctcatcaccaggctcatgtcatgttcgatgagcaggatggcgataccgaaacggtcgcggatcgtgttgatacagtgcagcagatcctcggtttcggtggggttcatgccggcggccggctcgtcgagcagcagcagtttcatgccggtggccagggcgcgtgcgatctcgagcttgcgctgctggccgtacggcaggttggccgcctgggtggtggccagtccctcgaggttgaagatgcgcagcaagtcgatggccttctcgtgcatctcgttctcctgcttccagaagcccggggtgcggaagatggcgctgcccatgtggtaggtgaacgactcatcgaaggcgacgagcacgttctcctcgacggtgagctgcttgaacaggcggatgttctggaaggttcgggcgatgccggcacgcacgacctgataggtcttcttgccgttcatccgggttccgtccagccagaactcgccttcggtgggcttgtacacgccggtcagcaggttgaacaccgtggtcttgccggcgccgttggggccgatcaggccaatgagttcgcccttgttgatggtcatgttgaagttggacacggctttcagaccaccgaaggtgatgccgagatgttcggctttgaggatgggctgggttgcgtcgctcatcgtgaggcctccttcacggtcttgtcgtcggactggtcatgctgcttggcgctggccgcgggtttcgcgcccttgccggcggcgccgcggaacagcatgcggttgaccagacgcggcagtgagaactcccaggatccgaagatgccctgcgggcggaagatcatgacgagcaccagcaccaccgagtaggcgagcatacggtagtcggcgaaggcgcgcagcagctcgggcaggatggtcaggccgatggcggagacgatcgagccggtgagcgaacccatgccgccgaacaccaccatgatcacgtagttgatggagttgagccaaccggccatggtggggttgagcgagccgatgtactgggcgaagataccgccggcgatgcccgcgaagaacgcggagatcgcgaagacgagcaccttgaggtacgtggtgttgagtccggaggcgccggcggcgatctcgtcgtcgcggatggccttgaccgcacggccgtaacgggagcggccgaacatgaagagcacgaccacggtgaccaccatgatccagaacacgacgtacaggttggcggtgcgttcgatgccgatcagcgcctgtccggcggcgcccttgtcgaggcccatgccgccggctaccttgaggttctggatgatcacgcggatgatctcaccgaagcccagcgtgatgatggccaggtagtcgccgtgcagtcgcagggcaggaatgccgatcaggatgccgaacacgcaggccaccacgccgccgatcagcgtggtgagcaggaagcgggcggtggggtcgatggcaatgccggcggcgaccatgtatttggaggtcagtgcggccacgtaggcgccgatggcctcgaaaccgcagcatcccagcgtcagctggccgagcacgccgatggtgaggttcagggaggtggtcatgatgatggcgatgcacgcggtcatcatgatgcccttgatgtaggagtcggccaagccggattcgcacagcgccatcacgatgccgaacgcggcgaggatgccgatgaagcacacaagataggactgtttggtggaaagcattgtcttcttcatctgatcagaccttctccccttcgttcttgcccataatgccggacggtttgacgagcagcacgatgatcaggatggcgaacacgatggcgtcggagaacgccgaggtgatgatgcccgccgtgatggtgccgatatacgccttggtcaggctttcgatcagaccgatggccagaccaccgatcatggcgcccgggatggaaccaatgccgccgagcacggcggcgacgaacgccttcaggcccagcatggcgcccatcataggcgagacctgcgggtaggcggcgcagtacatcagcgaggcgaccgcggccagaccggagccgatggcgaatgtcagggcgatggtggagttcacgttgatacccatgagcacggcggcctccttgtcttcggagacggcgcgcatggccttgccctgcctggtgaatttgacgaacagctgcaggcccaccatgatgaccaggccgatgacgatggtcagcagggtgtctcccggcagcttgagcttgccgaacgcgatggacggcaggtggaagatggtcgggacggtctggaagtcggcgccgaagatggcctgtgagccgttctccagcagcaacgacatggcgatggcggtgatcagggcggtcatggagttgcccttttcacgcaccggcttataggcggccttttcgacgatcacgccgacggccacgcataccaggatggcgggaatgaccgccacccaggcgggcagtcccatggccacgatggccggaatggtgagcatgagcacgtaggctccgaccatgatgaaatcgccgtgggcaaagttgatcagtcggatgatgccgtagaccatggtgtagcccaatgccaccagcgcgtacacgctgccgattttcagaccgttgaacagctggctgatgaacatgatgatctgatcggtcatagctccccctttctatcaatgttgtggttctctaccgctgcgcgcgtagagatattcgtatgtcttgcgattgatggcgcgatacgcccgcgcctggcgatatccgcatatcgacggctgtccttatgcatccgagcccgtgaaaacacgaaagggagaggaccggcaaaaccggtcgctctcctgttcatgcggaagtcatgctaggacatcgtgattatgcggtgggaattcatggaattcacttgggctgcacggtggtgttgtacaccggcttgccgtccttcatttccagcacggtcacggacttggtcggcgagccggacttgtccatggtgaacttgccggtcacaccgtcgaaggtcatgccggccacggcgttgcgcacatcctcacgggtggcgttctcgccagccttctcgatggcctgcttgatcatgtagatggtgtcgtagcccagagcggcgaacgtgttcggctcggcgttgttcttggacttgtaggacttgatgaagtcctgcaccttggtgttggtgttgtcgtcggcggagtagtgggtggtgtagtaggtcttgttgtactgggacttgtcaccggtgagcttgaggccatcgtatccgtcgggtcccatcacgtagccctcgaaacccacggagcgggcctgcgggatgatgtacgggccagccacggagtagtagtacggagcgtagagcagctcggcgccggaagcctggatcttctgcagctgggcggagtactcggtgtcgtcggcggaggaggagctttccttgtccaccacttcgaggccgagcttttcggcggccttggcgaaggcctctcccacgccggaggagtacggatcgccggtgccgtagagcacggccaccttcttgaccttcaggttctcggcggcgaagcgtgcagccacctcaccctggtaggagtccttgaagcaggtgcggaacaggtaattgccggtttcgatggagtcggaggtggcggccggggcgatggtgaccagcttggactggtcggccagcggggccacggctgcggtggtggcggaaatggtcgggccggccacggcgagcacgttgttgtcgccggcgagcttgttgtaggcgttggaggcttcggtggcgtcgcccttgtcgtccatggactcgagcttgaccttcttgccgttgatgccgcccttggcgttgatctcggagaccgccagctcgaagcccttgacctcggcctcgccgtaagcggcggcggtaccggagttggtggtcacggtgccgatggtgatggagtcgccggaggccttggcactggagctggaggaatcatccatgctgccgccggagcagcccgcgagggacaacgccataacagcggccgcgctggccgcaacgaacttagtggagaacttcacgttcatcctcttccttcttccttgggatatttcaacatcgttcatctgtcaaccaacgcgcgggatgtgcgcgtgagacgttccactcacataattcgcataccacagaactacatcacacggcttgtgaccgtcattcacgtctctctcatccgatgtttgtcgcggactgttataaccagaccggctttgaacccgcaataaattgttcttattatgagacagcgcaattacggaaacgagaatacaatcccaaggaaatgtgggattcgtggggcttaggacactgcaaacaggtagcggtcgcgacccgtccagtcctggccggtcgatgcggcagcgaatccggtggcactggcaaaggccacgagacgatccccctgggtcacgtcatgttccatgacaagcacgcccccaggcttgagaagacggcaggcccgctcgataatgcgctcgggaatcaacgtaccgtccatcgagccgccatacaaagccaattccggatcccaatcacgcacttccggctgctcgggaatatcggtctgcggcacgtagggggattggtgatgacgatatcgacggtgccgtccaattgggccaatgtggcgaaggacgtggcatccgcgatttccagatggtaattcgaggcaatggatgggtactttttcgcggtttccgacagattccttcgcgtccattcggcggtgttcggcgacagctccaccgcccacacctggctgccgggcacctcgctgacaacggacagcccaatcgcgccggagccggcgcacaaatcgaccacacaaggatggatcatgccgttttttgtcagccagtcaaggccggcctgcaccacggtttcggtttccggacgaggaatgaacactccgggaccgaccttcaggtcaaggtagcggaaaggagcatgcccggtgatgtattgcagcggctcgcgcttggcacggcggtcgagcatggcacggaagacggcaagctgtccggttgtgccaagttcctcccccataagcagagccctgtcgacgtcgcgcagttcaacgcctgccgcctcggcaaggagcaacttggcatcatgctcaggcgtctcaatacccgcttcgcgcaattgcgaagaggcttggttgatgatgtcggtaataagcactggcggtctccgttgatcggacattaggctcccctcagtcagcttcgctgacagctcccctcacagaggggagccatccggcaaagtcatttctgattggccagacggtcggcctcgtcggcttggatgtcggaatcgatgacggcctgcaggtcgccgtcgagcacggcgtcaaggttgtaagccttgtaattcgtgcgatggtcgacgatacggttttccgggaagttgtatgtgcggattcgctcggagcgatcaagcgaacgtacctgcgagtgacgcatgtcggcggcctcggcggcctcctgctcatgcttcatggccagcaggcgggacttcagtacgcgcaacgcggcggcacggttctgaatctgcgacttctcatcctgcatgttcaccgtgattccggttggcaggtgggtcatgcgcacggcggaatacgtggtgttcacggactggccgccggggccggagctcatgaagatgtcgattttcaggtctttcggatcgatctcgatctcgtcgtcatcctcgtcggcctcggggaacacgatgacgccggcagcggaagtctggatacggccctgcgattcggtgacggggatgcgctgcacacggtgtacgccgccctcgtacttcatcgaagcccacacgccgtcttcgggagcgggcgtgcccttggcgcggatggcgatctgcacgtccttgacgccgccgagctcggtggtgttctcggactgcacgttcacgctccagccacgcttctcggcgtaacgggtgtacatgcgcagcaggtcgccggcgaacagtgcggcttcctcgccgccggtgccggccttgatctccatgatggtgtcgcgcgcatcatccgggtcacgcgggatcagcgcggtgcgcagcttctcctcgacaccgggcagttcgtcttcaagacgcttggcttcctcggcgaagtcggcgtcctcgccggccatctcctgagcggctgccagatcgtccttcacctgcaaccaggctttgtaggcacccacgatggcacccagttcggcgtgacgacgacccagcttgcgcagcttgtccgggttggacacgacttcggggcttgccatctgttcttcgatggactggtactcctcaagcgcggttgccgccgccgggaactgttcgtctgccataacacactttcttctgtatggtgctgttctgttcgattattcgattgcgcaggtcaatgctgcaacaaaacttgtcaaagaatacaaaaaacgccagtcctcgatcgggtatgccggagcatgccaaatcgaatcggactggcgtgaagtatgctacttgctcttcttgccgtagcgcttctcgaagcgagcaacgcggccaccggtgtcaagaatcttctgcttgccggtgtagaacgggtggcactgagagcacacgtcaacgaacatgtgatcttccttgccagcggtgcgggtcacgaaggtgttgccgcacgagcacgtcacctcaacggggtgataatcaggatggataccctgctgcattttacgtctcctatggattcgggggacccgggtcgtcatgcccctatggcaagacgtgaaccggaacctaagggattgtacgcgcctatctggacgtgaagacgcgctgcgccgccgcaggagacgacgcaaaagagtggggccgcaggggcttgaaccctggaccgggcgattatgagtcgcatgctctaaccgactgagctacggccccacgttcgctgcgtaaaacagccaacttgccaaagtgtagcacgagcccgctaatgccggcacgcgcgccatgcacccataccatgcacccgccagcaacaagcagcatctcccggcgctacttctcccccatgtaccccaacgggttctcgatgaaccgtcgcaagcccatttcggccgcgccatatagcgagggatgcagcgccaccggcggcacaaacacgcgaatcttcacattcgggtatcccagaatttccgaacgcagccggccttcaagcacggtggccagctcgtcgccgaagtgcgtccacagtccacccaacagcaccgtatcgacatccaccagattcacggcggaagcgatggcggaaaccagcgcatcggcggcctgatcgaccactttggccacatccgaatccccggctcgccaacgctggaggaacatatcgatggcctcgctgctggtggcatccccatcctcggcaatgccggcagcctcgaccaaagcgcgacggcccgcaaacgcctcaagacacccgtgacgcccgcagctgcacaacggcccatccatcgccacggacagatggccgatctcgccggcgaatccgtgcgagcccatcaccacttcgccgtcgcgcaccaccgcgccgccgatgccgatatcggtagacaggtaaataaaggagtccgtgcggtccaccacattcaggaagggcgcacgttcggtggcataccccggaatctgagcgatggcggccatcttcgcctcattgccggccaccacatccagccggcgcaccacgttgaaccgggtgaggttgacgttttcccaacccagattgcgggccaccaacagccacatgtcgtcggtgacgatgcccggcagcgcaaacccggctcccaccaccttgcagccgcgtcgtttgagccggctttccaacgggaaagtcatcgcatcgagcttggcgaagatctcgtacgggtcagtgccggtcatatcctcactcacccactcccggccgagagtgtcgccgttcagatcgagtgccaggcaaccgtaaccatcggtgttgatctgcaggccgatgccggcgatggatccgccgcgaatctccagcggcgtgctgggccgcccatatgtggtggaaacgaccggctcgccttcctgcaccacgccgctttcaatgagcatcgaggccaacagcgagagcgtggccttggtcaggcccgtctccttggccagatcggcacgactcatcggtttctgcgcacgcaataaggtgtcgagcgtcaccgacaggttatggttgcgcagatcctcctgattgatcctgcgtagatttgccattggcccctacctcctcgcacccctagtctcgagcgccgcacaggcgctcacatccgtctatcacaccatgatattgtgcgtcaaacgattgaatcggaccgcaccttcgcgtgtttccgtttgcaatcgaacgttgagatacagtatagtttaatcgtctaacttattggctatggcgcgccgaaacttttgagcgcgaccctcatcgaggaggaatgcatgacgagagtactggttgccggcgtagatacgtcaacccaatcaacgaaggtccgcatcacggacgccgccaccggcgaacaggttcggttcgggcaggccaagcacccggatggcacctcggtcaacccggaattctggtgggaggccttcaccaaggccgccgagcaggccggcggccttgacgatgtcgcggccctcgcggttggcggccagcagcatggcatggtcattctcgacaagcagggcaacgtgattcgcgatgcgatgctctggaatgacaccagttccgccccgcaggccgccgccttgatcgacaagctcggtgcagctccggccgagggcgacgaaccggacgacgtgaccgcccgcggcaagcaacgctgggtcaaggccgtcggatcctcccccgtcgcctcctacacgctgaccaaggtggcgtgggtggccgagaacgagcctgagaacgccaagaagattgccgccgtctgtctgccgcacgattggctgagctggcgtatcgccggctatggcccggtggccgagggcgaggacgctcatctcgaagccctgttcaccgaccgttccgacgcttccggcaccatttactacgatgccgcgcatgacgagtaccgccgcgatctcatcgccatggtgctggcccctgccgagggcgaggaagccgccaaggcccacgccgacgccattgtgctgcccaccgtgctgggcccgcgtgaggcagccgccgtcaaggccgaccccgccattgccggcaaggacgttgaaggcggctgcatcatcggccccggcggcggagacaatgccatggcctcgctgggcctcggcatggccgtgggcgatgtgtccgtatcgctcggcacctccggcgtggccgcggccatcgctgaaaacccggtgtacgacctgaccggagcgatttctggctttgccgactgcaccggtcattatctgccgcttgcctgcaccatcaacggttcgcgcattctggacgccggtcgcgccgcccttggcgtggactacgacgagctggccgaactggcctttaaggccgagccgggtgccggcggcatcaccctggtgccgtacttcgacggcgagcgtacgccgaaccgtccggacgccaccgcctcgctgactggcctgaccctgcacaacaccaccaaggagaatctggctcgtgcgttcgtcgaaggcctgctgtgttcccagcgcgactgcctcgagctgattcgttcgctgggtgccgagatcaaccgcatcctgctcattggcggtggcgcgaagtccgtggccatccgcacgctggccccctcaatcctcggcatggacgtgacccgtccggccaccgacgaatatgtggccatcggcgccgcccgtcaggccgcctgggtgctgtccggcgaggccgaaccgctgacctggcaactcaccatcgagggcgtggagaccggcgagcccaccgaagccgtgtacgaggcatacgccaaggcgcgcggctgatacgctgccagcacaatccatgagataacaactgaataacgattcctgatgaatgccgccatggcaagcatcgcgaagagccgctgttataccgcgctcctcgctgaagcacacatggcggcatttttcgtttcccacgcaatccacaaatgcggctataatcaagtcgtttgaacaagtctggagatgatcctatgaacgaccgctcccgtatgatgctgtacgccctgaccgccgtcgcctgcgtgatgtggatatggcaatccgccaaagaagcaatggccgatggcacgatgatcagcacctcaaacatcatctttttggtatgcatcggcattgccgccgtctactgcgccgccaacgcattgatattgtggtggcgtcaacccagcaaggaggatgcggagaacgatgacgccgcggatacgcctgacggcaccgataccgacaccgcagatgccgagggatccgaggacgacaccgatgacgatgtcgaaaccgacgtcgcaaccacggatgccgatgcatcaccaaccactaatcgccagtaaccatcgttatcgttcgcccgaatcaagcgaatcatcccacttcagcaaaggaacattatggaagtaacaaccgtgtcaaccgtgatcagcgtggtgctgggcgtcatatgcgcgccttgcggcctgtttctggggctcgttcccatgaaggccggcctggtgaccgccaagcagtcaaaggcctcgcagatggtgagcttcatcgttgccatagtgttcatcggcttgctggtcgcaggacatgatctggagacctgggccatggtaatcggtctggtcatcggcttcgccgttgccaagattcccgcgctgcatgcctgggctttgcacaagtggccgttcttcgagcccaagaaagcggctcccgctcccaagcgcgtcaagaaagccaagaagaagtaagctctggccttacctattcgctgaaagcgggatatcgacatcggtatcccgtttttcattggccgtacatatccgctgaggcacatcgccgaatcatattgtcgaaatacaccccaagtcagggctgatttcgcgaagaacgtacaccgggatccatccatcgcgacaaacggaaaagggacgctgcgtgcaacagcgtccctttcggaggaggaatggaactcaggtccatccccgtggccaccgggcgggcccggaggccaggtttagctcagcctttctttttcttggagagcaggtcgtaggcgacggcggcgatgacgacgaggcccttgatggtcttgacccaggcggcgtccacgcccatgatggacaggccctggttgagcacgcccatgatcagggcgccgaccatggcgccggggatggtgccgatgccgccggtgacggccgtgccgccgatgaagcaggccgcgatggcgtccatctcgaactcatgccgggcctgtctcgttaagtgtgtaactggcgttttcattgttgtgttccctcgcttggccagcggtcggcgaaggtgatggcaaaggcgttgagcacgggcttccagcgcgcgctccatcgtatccgtcccttgccggtggggtccagcgagcggacggtcaggtacatgcacttgagcgcggcctgctcgtcggggaagtggccgcgggcgcggatggagcgcttgaatctcgcgttgagcgattcgatggcgttggtcgtgcagatcacgcgccggatctccacgtcatagtccaggaacggtatgaaccgttcccacgcgtccatccacagcctgcggatcgcgggatatctcgcctcccacttgtccagcatcgcgtcgcgggccgccgccgcggcggcggcgctcggcgcggtgtagatgggtttgacatcgcgtttgatggcgtcccagtccttcttcgacgcgtagcggaacgtgttgcgcagcagatgcaccacgcaggtctgcacgatggccagaggccataccgcgcccaccgcgtcgggcaggcctttgagcccgtcgcagatcaggaagaacacatcgtccacgccccggttcttcagctcggtgagcaccgacagccaatagcgtgcgccctccgcggcgggcgacgcccagatgcccagcacgtcgcggccgccctccagatccacgccaacggccacgtagaacgcgcggttggcgacctgcccgtcgcgcaccttgacgacggtcgcgtcgatgaacacggccgcgtacacacgatccaggggacgcgagcaccattcgtccttctcggccacgacccgctcggtgatgcgactgacggtctccctggacacgtccgccccgtagatctcctggaagtgggcgctgatctcgccggtggtcaggcccctggcatacagggacagcaccacctcgtccaccccgggcagccgccgctgccgtttcctgacgacgaccggctcgaacgagccatcgcggtctcgcggcacctcgatcccgaccggacctaccgaatcggtgaccacggtcttggcggtggtgccgttgcgcgtgttcgcggccctgccgtccttggatttcttgtgcttggcgcggcccaggtgctcggtcatctcctcgtccagggccgtctccagcacgcttttggtgaactgtttgagcagtccgtcgggccctgtcaggtccagtcctttttccttggccatgcgcacgaatgtgagcgccgcctcccgctcggcgttgcgtttttccgcgtccggcttcttcgtcggtgtcatgtttccccttgtcccagcagacatcgtccaccagcctttccgaccggccacacgaccggccagttaaggccagttacacacttcgagagacagtcccgttttcagcggaaggagagaaaggagaaagaaggaatggaaaggtgccatgcgggcataacacaacaccgcacatggcgaaactatcgaatcagcccatcgggcgcactggcatcataattgatgtgtacacgcccgatggagcgaattcaatcggtcagaccgatggtcactcgacctcagccagggcatcaatgatgtagttgttgatggtggccttgacggactcgaggtgatcggacttggtggcggcgatgagctcggactgcggcttgtcgaggctgtaggcttcgaggtcggccaaggtgacgttgccctcgtcgatgtccttgccgatgccggagtcgtaggagctgtagcgctcggcctgaagattctggatgaagccgtcctggttcatcttgtcggcaaccagcaggccggcggcgtaggcatccatgccggcgatgtgggagcggaacaggtcctcctcgtagaaggaggtacggcgcggcttggcgtcgaagttcagaccaccgtgaggtccgatggagccggcctgcaggacttcccacatgacggcgacggtctcgtacagatcggtcgggaactcgtccatatcccagccgatgagcttgtcgccctggttggcgtcgagggaaccgaggaagccggactcgcgggccacgcggatctcgtgctggtaggtgtggccggccaggttggcgtggttgccttccaagttcagcttgaagacgtcggtcaggtcgtggttgcgcaggaactcgatggcggtggcggcatcgaagtcgtactggtgcagcgtcggctccttcggcttcggctcgatcaggaactgggcctcaaagccgatttccttggcgtaatctgcgcacatgtggaagaacttggcgatgtggtcggtctcgcgcttcatctcggtgttccacaggttctcgtagccttcgcggccaccccagaacacgtagttctcggcgcccaggcgcttgccgatctccaagctcttcttgagctggccaccggcgtaggcgtagatgtcggcgaacggagaagtggcggcgccggacacgaagcgcgggttggtgaacagggaggaggtgttccacagcagcttgacaccggtggacttcatattctcgtcgatcttgtcaacgaccttgtcgaggttggcgttggtctcgcgcagggtgtcgccttcgggggcgatgtcacgatcgtggaagcagaagtactcgacgcccagcttctggaacagctcgaaggcgtagtcgaccttggccagagcctggtccatcggatcggtgtacttgtagtacgggcggtgcgcggtgccggtgccgaacggatcaaccagttcctggttgaaggtgtgccaccaagcaacgccgaagcgcagccaatccttcatcttcttgccggcaacgaccttgtcggcatcgtagtaatggaaggcgaagtcttccttcggtcctttggcgcggccgacgtactcgatcttgtcaacatcccacagacccatttgggcgctcctttgcagtaggcgatattacggattgcaggaccaataataaaacgaacgaactaagtttgtcaaatgattgaattaatacgccgcgtctcagcgtgttgctagtcattgcaatggttttcgaatgcagtcaaggcacagatagtatgggcaagccaagaaagacaactcagccaaggaaacgagacttgataattgacgtcacgcaattcctcgccggccaccgctgaggccggctccaccaccccgccaaccccaacagcaccacccccgccaacaccaccgccatggtcatcaccctgatgatcggctcgtttgtggccatcctcaaccaaacgctgatgatctccgccctgcccacgttgatgcacgagttcgacgtgcccagcagcaccgtgcaatggctgaccaccggattcatgcttaccaacggcatcatgatcccgatcaccgcgttcctcatcgagaccttcaccacccgccagctgttcctgtacgcgatgggcatatttgcagaatgatcttggcgttaatgcactggtgtccggtctggtgatgatgccgagcggcatcgccatgggcatcctgaacccggtggcaggcaagatgtatgaccgtatcggtggccggccgctcgccttactgggcttcgcgatcatgacgtctgcggctgtgctgctggtcaccatcatgaacacgcacaccgcggcggccatgcgcaccggagtgccggaagcggcggcatcggccattggcgtgcgggcttcgttccgcacggtcgccattgtgtgcgcggtctgtttggttgcgtcactcttcattcgtgatcgcggccgccgacttggacagcagcgttaggcgaatccttcaccgattgctggccttcttgatcagcgcgtccaaagtaccggcttggcgcgcggcttccacatcttcccagtcgagaccggtgtctttggccctcccgtagaaaaaccgcaccagaccggcaaagtccggtttatatccggtttcccggaatgaacgggccagcgaatcaccgatttgcgggtcatcaggccttcgtgcctcatagatcgggatggaacaggatcgccacacgcctctcacatgtgcgatgcgattgacgatcatgccgccgtgcgcaccatcgtattgcgaggcggcatgtacgtccgccacctcgtagacaccaccatgaatgatgtcctcaactgtcagacgacctttgaccgcgctggcatcgcgaatccagaacatcgaagcgaaattggtgtcatcaagttcgcgaaaatcacgtatctcgcgtgtgccgatacgttcgtccttgtcatacatgaattcggccaaggctaggaatggcgagatacctgcgcccggaccgtactgcaattcgatacgtaaatcttcggattcattgccggtcagtccaataccgctgacggcgcagtcataggcaaaccaatcccagaaccaccattcgatcctttgcagcacctgcttcggatactttttgcatgggttcagattcacttcgcgataatatatgcgtctcgcttcggcatagacggcgagattgcagcgtttgaacatctcggctacgtctttggtgtccagcattgctggcaaaccggcattttcggcagtagtagtggttgcggtgctcatggtgtttccccttcatgtgatgtggacggcgggctacgttgcccgccgtgaggcacactgtatggcgctcatgcggtggctcgcaagcccacatggcgaaatggtggataagtggaaaacccaatgattccaaggggtatggaatgtgcataacagtggataccgtcggtggataaccgcactttcttgcaggttatccactgatcgcgcagctgttatccaccgtctctgggttatccacatcgtctctggcgtgtcgtccactgtcagcagtcgatttctgcttcgttttggcgtgtataagtgcacggtgaagtgtataactccgcgcattaggcatatttgctactgagaaaggtcccgaaatcgccttcgaacgcatagctacactcagcagatgtattcagcatggcaatagacccacttaggcaccagcgaatgatttcccccccgcttatagagtcggcaaaggcccaacacctgtcccaacgccgacgctactgcactggcagcgtcggcagaggcccacgacttggcacagcaacgacgctaaaaccgcccagcatcgttacacgtccaagttttggccgctaacgacgcttaatgaacgcttagcgtcggcagcaggtcacgcactggttctccaccgacggtagcgctccttagcgaagccagcccgccactctttggcacatcaccgacgctgagagaacctccagcgaagccaaccagccaaccgctggcgacatgacaccacccacacccctcagcgaagccaacctgccagcgcatggcaccccaacaccgatgagaacacccaccccaccagtgcacaaaaggctggtcatagcggttgcgatgtaatcgcatcgtaatcgcgatgaccagcctcgggagttgggctgcaatgagcaccgatatgaatcagataatgatgccgttgcagtgatcgacttcatgctggataatctgcgcagtccaaccggcgaaggtggcgtggcgggcgcggaaccgacggttctcgtagttgacctcaatacgtcgataacgcagcgtgcggcgttcgccggtcagggacaggcatccttcctgggtatcgaaggcaccgtccgaagcggtaatcacggggttgagcatcaccgttatgcgcccgccaaggtcttcatccacaaagacgatgatgcgtttgcctacgccaatcatgttggcggccatgcccacgcaccgtgaacggttggcctccagcgtgtctacgaggtcttcgatcacctgctcgtcgccgggcccggccgcttcggacggcgtgcgcaaaaacgaccgcgaagtcataataggacgttgcatgctggaatcacgcttcttcgtgccaatgggggttctggccgaaggtgtgaccttcggggttgtccatcgcggcgatatcggccatgtcctgatcatcgagctcaaaagcggtcaggtcaaggttctggcgctggcgttccgggttcagggacttcgggatggccacgtcgccgtattggaggtgccagcgcaaaatggcctggaccacggaaataccgtgcttggcggcgatgcgcttcagatccggatcgcgcagcatctggttggcccggcccagcgggctccatgcctcggtgatgatgccgtgcgcattgtcgtaggacagctgttcgcgctgctggaagtacgggtgcagctcgacctggttgacggccggcgtcacacctgtatcgcgaatgagcaggtcgatgtggccgggcaggaagttgctgacgccaatgtgcttgaccaagccgcgttcgcgagcttcgaccagcgcttcccatgcctcgacgaactggccttggcttgggttcggccagtgaatcagatagagatcgatgtagtcgaggcccatacggcacacgctctcctcaatggtgagcagagcctcgtcgtgagcatggtggcggccgggcagcttggacgtgacgatgatgtcttcgcgcggcacgccggattcgcggatggcgcgacccaccacaccttcgttctcatagttgaacgcggagtcgatgaggcggtaaccctgatggatggcggacttgatggcgtccacaccggctaggccgttgaccttgtacgtaccgaagccggtggcgggcagttcgaggccgtcactggccttgcggatcggagtgactggtggttcatcaagcatgatagttcccctgcttctcctgtgatggaatatcggttccatcataaagccaaccaatccgctgcgggcgtactatttgacttctctcaattccggcggtcggcgagtggagaatcggaacatgagcgcggcgagaatcacgccaagcacggccatgccggtgaacaccatcatgctgcgcgggaacgcggccgtatacgaaccggccgcgtccgccccatcgttcgcggcgatggccaccacccacacattgccggacagcgcaacgaacaccacatccataatcatggtgccggcgaagccgctaaggatgaacttgggcgggaagtggttcttcagcatgccgccgaataccgggccgatggccggtgcggcacaggtggccaggccgactatgccgagcatcgcaccacgctgttcaagtggcgccttctccagaatgatgttggtgataagcggcagggagatgccggtaccgagcgacatgaccagtcgggcggcgagcagcatcgggaagttgaccgcgagcgcgcccagtaatgtgccggcggtgaaaatcacgatggccatgatgaacagtgttttggtggcgaatttgcgcaccatgaacggcgagctcggaatcgacaccgacagcaagagcagataaccggtgacaagccactgcaccaccgaggcgccgatggagaactcctccatcggcgtggagtaggcgatgttcagtgacgtttccgataggatgccgaggaaggtcaggatcgcgagcgagacgaccgcgatgacgagtttgttggagaccggttgcttgccgccgttaggcagctgtgttgcggaatgagtcacgatcttgttctctcctccattcattcagatattctgactacgacgttggaagtcttcctgcatgagtcgcagagcctcggtcaaggtgcgtaccgtggtttcgcactggtccgaggtcaatccgcccagcagttggctcaaatgcgcgtgatattcctccacatagatacggcggatatccaagccgcgttcggtgagcgtgagcgtcaccgcacgccgatcggcggcatcggcgtgtttgacgacgagtccgaggtcggccatttcgccgacgagcttggtgatgctcggcgtagtgacgccgaggaatgcgctgacgtcgcccacgcgcgcggtgccggtatcttgcccattcggttcgttgatatgccagacggcgtcgatcacgtggacatagcgcggtttcatacctttcggcaatgccggcatcagttcggtgatggtcttggccttccagcagacatccaggaggctccgcacctcattcaccggaagcaagccggtcttggtatcggttcgggaatcgcacatcgctggcccaacctccaattagttaccaatagtcattaccataagtaactatatgcaggctctagacaaacccaacggcctgcgcgcccgtgtcgagttccgtttcgacataaaaaagccagggaatccctggcttgcaatgcacatatcgctgcagatttgccgggacctatatgtccccggcaacaacagccgtatatacgctaccgatcagtgctgccctcatcatccttggcacctgccgtggcggcctcagtctccttggcgttccacccggcgacggcattccaaccactccatccgatgaccactagcaagcacagcgagaagacaatagtggcccaattgaacagcgagccatcgttattggcctcgaccagtgactgccagagccagataacgcaggccaagcaggtcaatgcatacatacgggaggtggagcgcgcggtgagtttcatggcggaaaaagtcctttgattacaagaatgacggcagataacagtgtgggatccgcaccagcggcaccggcacgaatcccacatcgaggaggagaaaggggaaggtcagctcttcttgcgcttggacatgatgtccacggcgacggccagcaggagcacgaggcccttgatggtcttcaccacggcggtgtcaacacccatgatcgacagaccctggttgataacacccatcacgaatgcaccgatcacagcgcccgggatggtaccaataccaccggtaacggccgtgccaccgatgaagcaggcggcgatggcgtccatctcgaactccataccggcctgagcagttgcggaagccagacgggagagcatgcagacagcggccactgcggacaggaagcccatgtggacgaacagcaggaagtccacgcggcgggtgttgataccggagaggatggcggccttgcggttgccaccaacggcgtacacgtggcgaccgaacacggtcttggtcaggatgaagttgtagatgaagaccagcacaccgacgatcaccagcatgatcggggtaccaccctgatcagcgttaccggaggaagccagcaggtaggtgacgaaggcgatgacgaccgcggcaagcacaattttgaggacggtcaggctcatcggctcgggcaccaggccgaccttggccacacgggcgcgcttgcgcagctggctccaggcaaagccgacgatgcacaggatgccgagcacaatggtcagaccatcgaacggaccccaccagccaaggatgttgggcaggtagttacgggcaatgccacggaattcgagggaggtaatcggcacggattcgccgacgatcacggtggcgagaccacggaagatcaacatgccggccagagtggtaatgaagcccgggatgccgatgacggcgacccagaagccctgccagacgccgacgatcaggccgacgaccagagcgatgacgatggcgagcatccagttgactccggcgcgttccatcagcagtgcacacacaccaccgatgaaggctaccaaggaaccaaccgaaaggtcgatgtgggtggcgatgatgaccatcaccataccaatggccaggatgatcacgtaagcgttctgctgaatcagggacacgaaggagttcggcttcagcagtgcgccgacaataccgtattgacgggcattgttggcaaccgtggccagcaggccggtcttttcttctttctttgcaggtgttgcagttgcggcgctcatcaggctgccacctccctttccttggtcatacccttcatcaggtattcctgggtaaatccattcttctcaacattgtcggtgacgacaccgtaggacaccgtgtaaatgcggtcacagataccgatgagctcgggcagctcggaggaaatcacgatgacggccttgcctgcatcggcaagcttatcgatgatttcgtagatctcatacttggcgccgacgtcgatgcctcgggtcggctcatcgaggatgaggatgtccggctgcgagataacccacttggcgagcagcactttctgctggttaccaccggagagggtggagacattcacatcgatgtcatggcacttgatgttgaagtccttgcggtactgttcaacttccttgcgctcaaggttgtcgtccacaaccccgcccttgctgatcttggtcagggaggccagggacgcgttctctcggatgttctgcagcaggttcagaccgttgcccttacgatcctcggtggcgtaggcgagacctgcgtcaatcgcggactgcacgttgggcatcttgacttccttgcccttgacgaacaccttgccggagatgttggaaccgtaagagtggccgaagatggacatggccatctcggtacgacccgcacccatcagacccgccagaccgacgatctcgccggcatgcacgttgatgttcgcatggtctacgatcacgcgctccgcgtcgagcggatgatgcacggtccaatcctcgacacgcaggtattcctcgcccggggtattggaggggtggttcgggtacaggttgtgcagcggacgacccaccatcttgcggatgagttcttcctggtcgagcggcgtctccggcgtcacgtacatcacaccgacggtcgaaccgtctcgaatgatggtgacattgtcggcgatggcggcgacctcgttgagtttatgagtgatgatgatgctggtcacgccctgctcgtcacgtagctgacgaaccaggtcaagcaggtgggcggaatcctcatcgttcagtgcagcggtcggctcatcgaggatgagcagcttcacgtccttggacaatgccttggcgatttcgacgagctgctgcttgccgacgccgatgtccataaccttggtatccgggtcttcgggaagtcccacacgatcgagcagcttcttcgcctcggcacgggtcttgtcccagtcgattacgccacccttggcctgctcgttgccgatgaagatgttctccgcaatggacaggaacgggctcaacgccagttcctgatgaatgattacgatgccgtcggcctcggaatcattaatagtatggtatttgcattccttgccatcaaaggtgattttgccggaatagctaccgtatgggtacacacccgaaagcacgttcatcagggtcgatttacctgcaccgttctcgccgcagatggcgtggatctcgccgcgatcgacggaaagattcacatcggtgagggctttgaccggaccgaacgtcttcgtgatgttttccatcgtcaagatggtgtcatttgatgacatgtcaccactcctcgtcacagttctgtgttcatggacatgcggcgcatatcggctatgcgccgcatgtcattgtgtttgtttacggattgcctgatgaggactacttagtcagctcgtcgaagcgatcctgggtgatgtagttggccgtgaccagatcctggaggttgtccttggtgatgttctgggggtcaagcagcttggacgggacgtcgatgttgttgttgttgaacttgccgttcaggccggagacttccttgccctcggcgatctcgacgaccatgtcgtacacggcgtcagccagcttgttcacgtccttgaacacggtctcgccctgcttatccttggcgatgttggcaactgcgatctccatggcgtcctgaccggtgatatacggccaggagtcggtgcccggcttcatgtcgggacgcttggattcgatggcgttgatcacaccctgggcgatgccgtcgtacggagtgaggaccgcgtcgagcttctcgccgtgggcgtaggtggagtcaaggatggattccatgtccttctgcgcctgctcggtcttccagctcatcacggagatcttctgccaatcctcaacggtgaagtctttggtcacgccaccctgaccgtgctgggacggggagacgagcacgcccttctcgaagtacggctgcagcagatcccaagcgcccttgaagaagtacttggcgttgttgtcatccggggaaccggtgaacagctcgatattgaacgggccggtggcgccatccttaagcttgagctggtcaatgagccacgtggcctcgagcacgccgacctgctccagctggaaggtggcgtagtagtcgacggcgtcggtgttcatgatcagtcgatcgtaggcgatgaccttggcgcctgcatcgcgggccttctcaacggcggggcccactgcggtgccatccttggaggcgaccacgacgatcttggcgtcgttgttgaccatgttctcgatgtcagcgttctgctgggccggcttatcgtcggcgaaagacaggatgaccttgtatccggccttctccagcttggccttcaggttgttgccgtccttgttccaacgctcttcggacttggtcggcatcgaaatgccgatagtggcacccttttcgatcttggcatcaccgccagttgcctggccgctacggctgccaccacaggccgcgaggcccgcgcacatggcaacgcctgccaccacggcgacgatcttcttagtgaacttcatttgctctccttcatcttcgaggggatggcgaaccctccttggtcgcccgaacctgagaataacctcaggttcatctcatagaataccgtattaagttaagttgtcaaactcaagaaagcgaatttcccgtcgtttgcgttcgaccaatgaacgcaatggcgatttttttcgcgcatcacaaggcgacacgccgaaaaatccacgctctgcgcctcgctgtgcctcatgccggtaacgactacactggattcttatggcaacaaggcttttcggttcgcagacctcgcttcgcgaggcaaaccgcgccaacttgctggccagcatccacaagttcggcgccatgacacaggtcgaactcgcagaggtgacaggactgtccactgcgaccgtgtccacgctcgtccatcagctcgtcgacgaagaccagctggagaccaaaagcaccgttcgcaacggtcgcagagccactctggtgacccttgcacggcatcagggcctcggcgtcgggctttggatcgcgcgacgtcatcttacgctttctatcgttgacttctcgaagtcaatcatcgctgagcacacgctccccctgccgttgggccacaaggcggacacaacgctggaacgcgccatgctgctcatcaatgagaccctgagcagcatcgacgccgaagccagcgagctggtcggcatcggcgtggccgtggccgcaccggtggccaccagcgaccacaccatagcgattcccggcattctgcccggatgggacggcgtcgatatcacgtccccgttgcgcacggcgttcaacgttcccgtatacgtcgataatgacgcgaatttcgcggcatacggcgaatcccgtatgggcgtggcggcaggcaaacgcaatttcgtatatatctcagccagcgacggggttggcgcaggcatcgtcatcaacggcgaaatcatgcatggcgtgaccggcctggccggtgaaatcggccatatccaggtcgacccgctgggtgccatctgttcgtgcggcaaccgcggctgccttgacaccgtcgtggcggaaaacaggctggtgcagttgctcagcgtcacacacggcaatatgacgctggacgatctggtgtcctttgccaacgaaggcgaccccggttgccgtcgcatcatcgccgacgcggccgtgcgtatcggtcaggtggcggctgatctgtgcatcagcgtggatccggaggtcattgtgctcggcggcaagctggccatgaccggcgacgtattcatccaaccgttcaatgaagcgttgcagcgcatgctgttccctgatgccgtggcacccatcgatgtactcgtgtcatcccacccggacgacaattgcgcgctaggcggcgcattatgcgccatcgagttctcggttcgcaatgacgtcagccagtgaccggtaccaggagaagagtgataagaaggaacacaccatgaggaattcgagcacacctcctctgctgcggctggaggacatctgtgtgaagttcggcttcgtcgaggcgttgaaatcggtgaatctgtccatccagcgccaggaggtcatcgccatcgtgggcgataacggcgcaggaaagtccactctgatcaaggtcatcgcgggatttctgcagccgggattcggccatatttatctcaacggcgaacaggtgaccattccctcgatcagggaggcggaccgcatgggcatcgcatcggtgttccaggggcaggagttctgcgacaacctggacgtggcctcgaacctgttcctcggcaaggagatcaatcagattggcatacgcgatgacgattcgatgaactcgcgtgcccgttccgtgctgaagaccctgagctcggcgattcgggtcggctcccctatcgcatccttatccgtcggccagcgccagaccgtggccatagcgcgcacgctgctcaatgacccgcagcttattctgctggacgaaccgaccgccgcactgtcggtgatgcagtcggcggaagtgctcgcatatatcaagcgactgcgctccgaaggccggtccgtggtgatggtctgccacgatctgccggatgtgttcgcggtatccgaccgcattgtcgtgatacgtcaggggcacgtcaccggcgtgcatcgaaccgtcgaaacgtcctatgaggagattatcgccgaaatcgccggcgtgaccaccgaacacgagtatgaggaaatcgccgagaacccgaaattcgattccatggtcaggcagcggaaactcatcgaccgcactatcagcgcggcagtgagccatggcaccggccatgactcaccattagactaacgccccgttgccggagcggcatcgtcagcgcagagccaggttggcggcaccgatgaggccggcgtcttggccggcggtggcggcgacgatcttggcatggccgcggtaggcgctgccttccaggaaacgctggtagttgtagcgggccggctccagcagaatgtcgccgacggccaccacaccgccgccgatcacaaacaggtccggatcgagcacggcggagactgcggccatcgtgcggccaagccattcgccgatcttgccgaatgcgtacaggccgagcacgtcgccttcctgggcggcctgggagaccatcgggccttccagcttggagatgtcgccgccacacagctccatgagacgcttggcatcctgcggacgacggcgcacggcggacttggcgaagttctccagcgaagtgcccgaggtgtagcgctcggcgcagccgcgcaggccgcagccgcagtggtcgccgtccgggaccatcggcaggtggccgagttcggcggccatgccgaaggagccgcggtacagctgaccgttgatcacgatggcgccgccgaggccggtgcccacggtcagggcgaccatgttggagctgccctggccggcaccgtgcacgtattcgccccagccggcgcagttggcgtcgttctcgacaacgaccggcacggcatggtcgatcagcgcgccgacgtgctcggacaggtcgtagttgatccaggccgggatgttggcggagaaggtgagcgtcttgcggtcggcgctcacgttgccggcggcggagatgccgatggcctcgatatcggtgtgtccggcggccacagcctcgcggtacacctcggcgatgtgctggttgatggcgtcggcatccatcggcgtggggacgcgccagcgctggatgatgctatcgttttcatcgcagacggcggcggcgatcttagttcctccgatatcaatggcgagcgtggtcatggcttactccttgaaggcttgtgtggcgtacgagacagcgaaaatagtaacgagttgccatgacctcccatagcgtatttttcatgatttgtcatatctcgcgcacgttctgccaatgtgaccctgcacacgtttttcaccatttataagcactgttaacgctaacgttgtcattcaatagcaaacgttgtcattcagactatcggcgtgtcgagcagagccccaaggccagcacgaaaccttcggtatttccatgcgatacggcatcggcatcgactgaaacagcttccatgccagagtcgaatggccatcaaacgactaaacaccagacacacattttggcctataaccccatatttcgccctacaccacgaaatacggcaaaagaacaaaaaagctcctgacatttgtcaggagcttggtggcgaccccggccggacttgaaccggtgacctccgccgtgacagggcggcgctctaaccaactgagctacggggccatctgtacctcaatgaagcacaagaggatatactacagcatcactggaccacggcgcgccgcccggcgcgtcgcgccacggcaatgtcaggcccatccattacccctccaagccatagcgacgcccgccattccagcccttccgataccatggtgggcggtggtttggcgtggattcgatcgttatgcggacagggcggcacaggcctgacgcggcgcaccgcgatccgtgattcgggggcgtgctccgcgctgcacacagcgtatccatcacaaactaaagactaaagaaacagcggaattccaacccctttttaaggagtaactgcacaacatggcagaattcgtatttcagatgatcaaggcccgcaagtcttacggcgaccgcgtgattctcgatgacgtgaccctgagcttcctgcccggcgcaaagatcggcgtcgtgggcccgaacggcatgggtaagtccaccctgctcaagatcatggccggcctggagaccgtgagcaacggcgaggccagcctgaccccgggcttcacggtcggcatcctgcagcaggagccgccgctggacgacaccaagaccgtgggcgagaacatcaagatggcgttcggcccgattgccgagaaggtcgcccgattcaatgaaatcggtgaggagatggccaatccggacgccgacttcgacgccctgatggaagagatgggcaagctgcagaccgagatcgacgccgccgacggctgggacctcgactcccagctcgagcaggcaatggacgccctgcagtgcccggacccggacaccccggtcaacgtgtgctccggtggcgagcgccgccgtgtggccctgtgcaagctgctgcttgaggccccggacctgctgctgctcgacgagcccaccaaccacctggacgccgagtccatcctgtggctggaacagttcctgcaccagtacaagggcgcagtcatcgccgtcacccacgatcgttacttcatggacaatgtggccgaatggatttgcgaggtcgaccgcggccacctgtacccgtacaagggcaactactccacctacttggagaccaaggccaagcgtctggagatccagggagccaaggacgccaagctcgccaagcgactgaagaacgagctcgactgggtgcgctcctccccaaggcccgtcaggccaagaacaaggcccgtctggagcgttacgaccagatggaaaacgaggcacgcaacaacaagaagctcgacttctccgagattcagattccggccggcccgcgcctgggttccaccgtgctggaagccaaccacatccacaaggccttcggcgagcgtgtgctcatcgacgacctgtccttcacgctgccgcgcaacggcatcgtcggcgtaatcggcccgaacggcgtgggtaagtccacgctgttcaagaccatcgtgggcctggagccgctgaccagcggcgagctgaagatcggcgacaccgtcaaaatcagctacgtggaccagaaccgtgagggcctggatccgaacaagaacctgtgggaagccgtgtccggcggcctcgacttcatcgaggtggccggtgtggaggtgccgacccgcgcctatgtggccagcttcggcttcaagggcgccgatcagcagaagctgactggtgtgctgtccggtggtgagcgcaaccgtctgaacctggccctgaccctgaagcagggcggcaacctgctgctgctcgacgagcccaccaacgatctggacgtcgagaccttggaatccctcgaaaacgcgctgctcgaattccctggctgcgctgtggtgatttcccacgaccgttggttcctcgaccgtgtcgccacgcatatcctcgcgtgggaaggcgacgacgacaacccggccaagtggtactggttcgaaggcaacttccaggcctaccaggagaacaaggtgacacgcctcggcgaggatgcggcccgcccgcaccgcctgcacaagaagcttgtgcgcggctgagatacgccggcattagtgccacaacgcgctttatacgtcgaaagccgtccctcaggggcggctttccccataattgccccatggctgcccgccccgcatcccataaaatcccacagtcgcctacggcaacacaccggcagcgcagcagcaacgtagcggcaatgcgccgcataacccaccgtttaccttccaaacagtctcgttacatttcgctcccggaactcttaacccccaccggatagactgccaaccataggttggaatacgataaccgaatactgaacacagcagaacaagaatcgaggaacgccatggctcaggcaaccaccgtaactccattggaccatctggtgaaggtgctgaagttgggcgagccttccgcttaccgcaatcacacatatatcaatggcgagagtatgtacttccccaccggccgcgtctacggtggccaggtcatcgcccagtcggtgatcgccgcgtccaaaacagtgggcccttcacgcctgccgcattcggtacatggctatttcattgccgccggcgatattcgtcaagacctgttgtttgacgtcgagaaccttcgcgacggccgctcgttctccgctcgtcgggtcaacgtcacccaagccgaggggtcgattctcacggccatcgcctctttccaggagaccggccaagagggtgtggaatttgccgatccgatgccggaaaacctgcccgatcccgaaacgttgacttccgccaaagaactcatgcagccgttcgccgagaagtcgccgttcgccaattactatgccgagaaatcgccgttcgatatccgccacgtgacgccgaccgtgatgctgcgcgcggacaaggattccgccgagcatgattccggcaagcagatggtgtggatgaaggccgatggccacgtcgatgtgccgcaggtcatgcatcgtgcgatgctggcgcttggctgcgatcaggtgatgatggagccggtgctgcgccgcgccggactgtcgatttccacaccgggcatttcctatgcgtccatcgaccattcgatgtggtggtatcaggatatcgatatcaacgaatggcatttgtatgtgcaggatacgcctatcgccgcgcacggacgcggactcggcattgccaaagtgtatgcgcagaatggcgacttggtggcggccatcgctcaggaagctatggtgcgcgtgccgtaggaatagtcacccctaccgcttgtaggcttgggctatgtcgctacggcgcttggcttccctgattttcgggttttcggggccttcgttcggcggtagctggcacaaccattcgccgataatgccgatgatcatgtcggcgatgcacaccacggccgcaattgcgcactcggtgacggcgtgtgcatagaaatccgcctcgatatggctcaagctcaccacaatctgaccgccataccagccggcgagcgttgcgcccgccaatcccagtgcctttgccaacaccagcgtatacaccgcgatagtgggattgatgaagctatgcggacgtttcttggggtcggtattcgcgtatttatgcacttgcagggccaagatcagcacaataacgcccagtacggccagcaatccgggcacaatccaaggcgcaccaatcagcgacagtcccgagctttcgccgtaggaggccagaccgatacccgccaacaggcccaacacggcaccgatcacatactgccaccatggtgttcgccgtgttttcatgtccggcctccttatcgttgcgttgctgtttgctgtttgcgaacggccttcgcgctttggccgttcatcttgatttgttttttcgtcattgccgtgcctggctgctcgaggccggagactggtccgtcaccgtctggtttctagcctaccgttcgtaactggttccgccatcagctcaactattcgacagtatccagttgtccgatagcaatccgacctgtccggcatccggtgccatggccaaaaggaaggccaccgggtcgccgcccagagaagcattcgggtccatatccagccaaggtgccaataccgacgcatggttacgggccgacggccaaggaatgctgcagttgggctcgtcggaagtcacgccttccatgtcaacaaggtcaaggtcgactgctaggtcatgaacgctttcgatgctgcccaatacggcaatcaggtcggcgggcggcaacttggtttcgatttggatgaccgcgctcatcgcgtccggactgtcgaaatggctgacatggtagagcggcgagatgccctgtacctgattgccaggaacactgtcgatggaaacgatggtttcgcggaacagccgttcggcatcctgcgaggtggaatccagcgaaataatcgccttgcgtgagacgggttccgactccgacgctgattcttgcttgactgcatgcccgccgagcatccagtcttcgctctcgagctgcacggcgttacggtccggcgcggcggccagcaaatcggctacaggcccctcatgggctccagcaagtttggcgttcggattcagcgccgcccaaggagccagcacaaatgcgcgctgccaagcacgcggatggggcaatgccagatccggatccgcgctggtgatgccatcaaagtcgataatgtccaagtccaacggcctggaatcccaatgattctcacgaattcgcccatggttcgcttcgatgttttgcaacgcggcgagcaattcgtggctgcccattgtggttccaagctccaccacggcgttcaggaaatccggcgtaccgtcagccatgccccacgcggccgtgcggtaaagcggcgaaataccggtcacctgtgtgccaagcagcgcgtcaatctcccgaacggcggctcgcaaggtggattccacctcgcccacattgcccccaaggccaccaccgcgttatggatggcatgcttttcagcagtgcgtccattatcggtggcacgcacgcgcgagatggagaccgatacatctgcaaaagccacgacgatgggcgcgtgaggcttgtgcacggtgacgtcgatggaggcgacggccggcgcatcggcaagaatcttatccgcgatacgttgggccagacgctcgatcaggtccacatgagggccttcgatgacagccacgatatccttggccacgcggccgtaatcgatggtgtcattgagatcgtcggattggccggcggcggccagatcaaggtgcagggtgacgtccacgacgaaggtttgtggccgttcgtgttcaaaggcgagcacaccgtgggtgccgttggcatgtacgccggtaagtgtgatggtgtccattggtaaggctttctgttcaaatgctcccctcagtcgccttcggcgccagctcccctcgcccgaggggagccaagacctagaagcaaccaaaaacagggagccaggggaatcatgcgtattcgcgccaggtgttgccggcgatgacggcggcgcggcttttggccacatcgtgtacgcgcacggcccatgcgccgtgctcggcggacagggcggacaaggctgcggtcacgtcatcgcgctgggccatggtcgggccatcagcaccggcagtacccgccccggtaagcatcgccgaaatgaagcgcttgcgggactggccaatcagcaccggatatccagtggcgcggaaggtctcgagcccggtcagcagcggtaggttatgctcgatgccgggcttggagaagcccagaccaggatcgatgataatgcgctcaggctttacgccggcggccagcacgccgtcgacttggcgcatgagttcgtcgtgcacgtcggtcaatacgccatgctcgtatacggaggtgtcttgatcggggttcgcgcccttggagccgacgagccagccgcgccaatgctgcacgacgtacaggcagtcgtggtcggcgaccacatgcggcagctcggcgtccagcgtgccgccggaaacatcgttgatgatctgtgcgccctcgctcagcgcggcggcggccacggatgcgcgcgtggtgtcgatggacagtacggcaccggccggaatcaacgtcttgacggcaccggtgatacgggccagttcgtcggcctcggacacgcgcttggcaccggggcgcgtggattcggcgccgatgtcgatgatatccgcgccggcggccatcatgtcgcgcccgtgctgggccgccttggccgggtccagccataggccgccgtccgagaacgagtcctcggtgatgttgagcacacccatcaccatggtgtgcgtggcgtcatgcaacgcctgcaaatcagtcataggtcatctccccttcattgtttccccttcgctcccctcagtcacctacggcgacagctcccctcagagaggggagcctaggttgcgtcacttgtcaagaatcagactcatggcttcggctcgggtggcggggttgcgtagcagaccgcgcaccgcagaggtcaccgtgcgggcggaagacttcttgatgccgcgcatcgacatgcacaggtgctcgcattcggtcaccacaatcacaccacgtgcgcccgcatactcgaccagcgcgtcggcgatctgctgggtcaaacgctcctgcacctgcggccggcgagcatacacctcaaccagtcgggcgagcttgctcagccccatcaccccatccttggcgggaatgtagcccacatgggccacgccatggaaaggcagcaggtgatgctcgcacaccgaatacagttcgatgtccttgaccagcaccagctcgtcggtatccacgtcgaagtgcttctccagcacatcggccggcgaggcctgcagaccggcgaacagctcgcggcacgcgcgggcgatacggtcaggcgtttccaccagtccctcgcgctcgggatcctcgccaatcgacttcaggaacagacgtacggcctcgcgcacgccttcctcgtcgtatgtgcgtttctcccgctggcaagactctatatattcgttcatctcatctctcccttgtcattgtccacaacgacgtcggcccggcctgcgtacgtgagaaaccacatgaacaggtcgggccgaatcgtcatcgtgtctactcttccggcttcatgccgaccgagcgcttgaggctttcgggaatctccaccggcggcttgtccgagtcggggcggcggtcgttggacagccacaccggacgaaccggagccttcttgatcggcgcgaagatcgccgcaagttccttctcgttcagggtctccttgaccagcagctggcggaccagctcgtcaagaatctcgcggttgtcgttgatgatggtccatgcctcggtgtgcgcggtctccaccagcttcaacacttcgtcatcgattacctcagcggtgcgatcggagtacttgcgcggctgcagaccatccatcacagtggtctgatcgtcgtcggaaccccacttgatggcgccgagcttatcagagaagccgtattcgatcaccatcgtacgggcgatgctcgtagccttctcgatatcgttcgaagcaccggtagtcgggtcgtggaagacgatttcctcggcggtgcggccacccatcgcgtaggccatctggtcgagcagctggttgcgcgactgcgagtagcggtcggaggtcggcatgacggcggtgtagccgagggcgcggcctcgcggcagaatcgtcaccttggtcaccggatcggtgttgttcaaggcggcggccaccagcgcatggccaccctcgtggtatgcggtgttgcgcagctcttccagagccatgcccttggacttgcgcttcgggccggcctgaacgcggtcgatggcctcgtcgatggcgcggttgtcgatcaactgggcaccggcacgggcgcacagcaacgcagcttcgttgagcacgttggccaaatcggcaccggtgaagcccggcgtgcgcacggcaaccatatgcaggtcgacgtccggtacgaacggcttgcccttggcgtgcaccctcagaattgcctcacggccttccagatcaggcgcggccacacctacctgacggtcgaatcgacccggacgcagcagagcggggtcaagcacgtcagggcggttggtggcggctatgatgatgaggttggtgtcgttgtcgaaaccgtccatctcgacgagcagctggttcagcgtctgctcgcgctcgtcgtggccaccgcccataccggagccacgcttgcgacccacggcatcgatctcatcgatgaagatgatggcgggagcgttcttcttggcctcatcgaacaggtcacgcacacgggaggcaccgagaccgacgaacatctcgacgaagtcggagccggccatcgagtagaacggcacgccggcctcacctgcgatggctcgggccagcaacgtcttaccggtgccgggagggccgtacagcagcacgccgcgcgggatgcgcgcacccagcgccttgtacttggacggatccttgaggaagtccttgatttcctcgacttcggccacggcctcgtcttcaccggccacatcggcgaacttggtggtgggggtctggccctcgagcagcttgccgctgtccttcttgccgcccatgccgagcatgccgccggcaccgcccatgcggctcatcagccaccagaacaaggcaaagaagatgatgaacggcaaaatcgaggtgatgaggtagctcatcacactggtctgctcgatattcgaggtccagcccttttcgagatcgccgttctccacggccttggccacctgcgcgccctgggcgaaggtgtagtagaactgcacgttcttgccgtagttggtcaccttgccggtgtcggcgttcttcttggtgtagtcattcttcagctcaaggcggacgacctgcttgttgtccgtgatctcggcgtatgtggccttgccctgattgatcagcgcgaaaccatctttagtatcgatggttttggtgccaccgccggcgaacatctggaacatcagcacaaccatgaccacgagcacggcaccccacagccagggggactgccatatcgggcggttctctttgttgcctttgccattgttcccgttattgccacggttgaacgggttggtgaacgggttgccgttgttacggttgttgttcgggttcgggttattgccgttacccggcccttgcgggaagctcatgcttgcactccttggtagacggacggcttgaggaccgcgatcgaatcgaggttgcggtagcgttcgtcaaagtcgaggccgaagccgacgacaaactcgtccggaatctcatagccggcgtacttcacatcaacgtccacctctcggcgggaaggcttgctcagcaaagcgaagacttccacggaagcggcaccacgacgtttcagttctgcgaccagccacgcgagcgtgcgtcctgaatcaacaatatcctccacaatcaaaatgtgccgtccgcgaacatcggcggacaaatcctgcctgactgtgacctcaccgctcgacactgtgcccgagccatagctcgacaggctcatgaaatcgatctgtacaggaatgctcatggcctgggtgaacgcgaccagcgtattcacggcccctttcagcaccgcaacgagcagcggattcttatcgcggtaatcctcgctcgcgagagcagccatctcgtggatcttggcatcaatctgttctttgctgaccagctcgtggtcaatatcttcctcaacgtcagcgattcgcatgcgctccatcttggcacacgcgaatgacgtgtttcttgcgattggctgaataacctctgggaagtgagacgccgccttgcccatgccaatcgacgaccagccggtcgatggcggcaatctgggcagcactggcgttcacaccggcttggctcagcgcgtgagcgatgacccgcaaccgaatcgcctctggctcacgtgcaatacgtttgacgctgatcatcaggccgatgccatggctcgaatcgttggtatcgcctgccacacaggctcgtggcgcatcggtcgataccgctgccgacgatgccggccaatcaactgccgcaaccgcctcccccatcacctcgtcggatcgctgatccagatactccttatccattctggccaaccgtgcgctttcggcgaaatggcgggtgacattgaatccagcgaatcgttcgatggccggcagcaggtcgtgacgcacccgcgagcgcaacggatagtcgttcggcaactcgccgtctaccgcatcgccattggtggggtcatcccaatattccacacctaagtcttcacagataccggtggtttcggctcgagtaagggtaagcagtggccgcgcaaaagtcgcgccactgcgtgtgaagacctgcggcatgccagccaacgcatccacgcctcgactgcgcagcaggccaatcaatacggtttccgcctgatcgtccatagtgtgggccaacagcacggcaatggcacccgattcatgcgccgcggcgcacagctcgtcataccgggcctgccgtgcggccgcttcgaggccctcgccgcgcgcctgtacggttgcgttgcgcatgatgaccgggcccagtcccaacgcgcggcaacgatccgcggcctcgctggcgacccgttcggagcctgcctgcaagccgtgatccacaatcacggcaccgcaacgcacgcccatggacgtgcatacgatatggctcaccgcagccagtgccatcgaatcgcgcccgcctgaacaggccacgagcacgagcggcgcatcggcggcaacggcatggtccccatgctgcgcgaattcgggagcctgcacatcgcatagttccacggcactcagcgttgcgcggaccgcgcctacggccttgcgcaatcgtgcggaatatgccatgtactcaccaccttttttctggttataggcactcgtgcgtttatggacgtttacggcctttgtagcccttgatggcccttgatgcctcttttacagccccgcgagcttggtgataaacgagtcgatggcgctacgcgcggcggcataatcctcaggattgttgaccaccacggcaaacgacaacgctcccccattggtgcgggacacattgccggccatcgacgtaaccgtgccgaggctgccggttttgacgcgcagcagaccagccacggcatcatccgtataccgatcctgcgccgtgcccaccaatcccgcgatggatagaccttccgcaccagcagcaccgctctcggtggtcagattacgttgttggacggccgccagcgtgcgtacggtgagccgggagccgggagacaggccggagcaatcggccatggtcagaccggatgtgtcgagaccgagatcgttcagagtggatttgaccgcttccgtgccgccttcaggactgtttgtcgctgatttcgccaaggcggtgagtctgccgaactcctcggccagcgtattgtccgaatgccgcaacgtgtatgccatgatttcggacagtgttgccgaactcaccgaagccaaaggcgtttcaccggatggagcggtgtttgccgtcacgtctccggtaacggccatgccgttcgattggagcagttcggcgaatttcgcggccacgtcgctggcggcgtgctgggacagttccgggtatccggccgaatcatcggggtcggccggcgcaggcgtatcggcggtgtattggcggcctccatcaatcgccattgatgagaccggcgtgaagtagacggtgtagtcgcttaagactgcgccgccttccgacagacctgccggaatgcgtgagtcgccgaatagggtgtcgtcgtactcgagattgacggaagtgatgcctcgctgggcgagcgcggccacggtggccttggccaaggtgttcagaccggcacgtccgttggtatggttggcgtcagaatcgcctgcagacagcagcatgtcgccattgcctttgagggtcaacgtattggtgccgtcatcggattgggtgaggaacacttgggtatccaaggtggatgccatattcagggtggatgaggcggcgagcgcggtcagcgttttcagtgtggatgcaggctcgcgtggagtgttcgactcatgttcggcagcgacggtgccttgggcgtcttcaatgatcaccgacgtatcgtttcccacgccttgcgcggacagcaattcgttgaccagcgcagaagcggccgtggaatcaatggccttgttcgcgttcaaggtgccggcgacggtgccgcctgatttggcggtggctggatcggcaaaaacaggtgcggcgacgggcttcaacgtcaataatccgggggccacgtcggtgatgtcggcggcgcagtaccccgcgaacagggcgatggtggtcagtgcggaaatgatgacggtcagtgttcggcgatgcgatcgttgggtccgccgttgcgcttcacgccgctgacggcgtgataccgctgtagataccatcgtgctccttatgccaaggcgatcatttctgcaatgaggcgaacgagtcgagtgcttccacaatcgaaagcattcgcgcatccatcagcttaccgcccagccatgtcccgagtgccaggatgccgatgccgttggccagtgcgaccggaataatcgccagccatatgccgccttcggctcccgtcagcagcatgaccagcgccacgatgccggtgggcagcatcagcagcaggctgccaagcacgtagacgaacgggaagaagccttgggccatggcgcggccttgaggcgcggagaacggcttgtccattgaggcgaccgggtacatcagcacacaggacgtgacttcggccacgcccaggccgctcaaggcgacgcccatgcccacggcgaggaagatcaggccggtgacgaggtcatcgggctgcgcccagcggccggtcagtgcgccgaccagcacgatgccggcgagatagagcagcaccatgtagacgaccatgatgccgacgtagacgcgcacgcggccgattctgtcggtccggccacgcacgccggcgatgacttccatggtgaagccgcggccgtcatatgcgagcccgttgctttccaccactgacatgaaccagccacaccagatcagcgactgccagacgaccgcgctgatgccgtgcgcctggaaggcgaagatgatcaggaacaggaccggcatggcgaaggtcatggcttggcgggggtctcgtttgagataggtgatcaggcgtgcggacaccgcgccggatgccgaatcgggcatccatgcgaatgcgccgatgcctttggcggtctcggacggactgtttgcgccgatggtgagccgttcatgcctcagacaccaagtgcatacggcgaagcagacgatccatgtgacggcaaggatggcgatgcgggcgatcagcaccgcccaagctccggtaagcgcgtcgaacggcagttggaaggccgcaccgaacggcgtccatgcggcgatggcggtcgccgcgccccaggtctcggtgttgaggctgaaggctatgccggagttgaccagaatgttcggcaactggcagatgatgacgaaagtcagcacgatgaagatgtagaacgcgcctttgccgcgtttgctggtcaccagcgtggtggatagggcgatgaccagtttggagatgctcatcatggtgatgacggccagcactgcggcgaggagggaactgatgattacggctggtcccatatgccgataggccagtgtccagagcatcagtgaggccacgccagtaagggaggggatgccggacaggccggaaagcagcaagccgaattgcaggttgcggtcggcgatgccgtagatcgcgaatttgcgtgggttcatggtggagccttcgccaagcatcatgagctggatgaagccgatgaagatggtcatggtcgcgccgaccagcacgacgactatgttgacgatgcctccgggaccaaggatgttcagcggaaagccatccgcgttcacggtgaagggcggcagtatgccgatgaaccatgcgagcacgccggtgccgatgatggtgccggccgcgagtacagcggaaaagacataggcgacggtctgccacgccgattttcgcagggtggcgagcgtgagcgtccagcgcaggcggaccagggtgatggcggtcttgatcattggcgggcctcatcggtgggtgtggcgggcgtaggcagaatcggctgaatcgtctgggccgaagttggtgcttgggcttgggcctgcccgccatcgagccacgcgagatgggcggcttcgtggcggccaccgactagttgcaggaagcggtcttcgagttcttcgccagcagcgacctcgtccaccgtgccggccgcgcataccagaccgtcgttgattacggccacatgcgtacacatcttttcgaccaatgccatcacgtgtgaggagatgatcaccgtgccgccagtcttcgcgtattcgatgagaatgtctttgaggttggcgctggacaccgggtccacggattcaaacggctcatccaagaccagaatgcgcgggctgtgaatcatcgcggaggccaggcagatcttcttggtcatgccggccgagtaatcggtgaccatcgtgttggcggccccggccaagtcgaaagcattgagcaggtcctgggcgcgacgcgtggtctcctcgcggctcatgccgcgcagcatgccggagtagacgagcaattgcaaaccggtcagtcggtcgaagatctggtcgggctggggcatgacgccgatcatgcgcttggccgtgttcacgtcgctccacacgtcatggcccagaatcatggcggtgccggcgtccggcaccaatagaccggtcaccatattgagcgtggtggttttgccggcgccgttagggcccaccagtccgtagaacgagccgattggaatgtcaagcgcgagcccgttgacggcgatcttccggtcgaagtgcttgaacaggccgcgaatggacaccgccgtattcgggttcggcggccatgcttgcggctgtggctgttgcgactgcgaagacgcgggagcggcggctggcatcatcggcggctgaaatccgacattcctttgagtattgtctaagctcatgcatctactctagcccaccagtcaaccctcagcgcagcaccccgggttgctgttggattgccccgctgagcagctccggactagcggactcggtcagcccttatgtgcgatgggcttccactgggctttggcgaagatggcctggaaggaaatcggcacgtagctgagcatgtaaatcgggaagctgagcacataggcgagcagctccttgttcgtggcaccgatctggtcgtgctcgacaatgatggtcaatgcagccaatgccatcagacccaacaccgatgtgatgatgccgctggaccaaccggccagcgattgcagctggctcgaccaactcacgaagccacacgcggcgaacagcaagcccatcaccgcgcgaatcacgcccaacacggtaaacggacacagcatcaaggtgaagtcgatgcaggagaaatcacgttcgcgaaccgcgcgtttcagcaatgccgagccataataacggaatacctgcaggaatcccttgctccaacgcaaacgctgacgccaactttgcgagaaggtaaccggctgctcgtcgtagaggatcgcagtaccgcaatagccgatgcggtcgccatgcagaatcgaatccatagtgaattcaagatcttcagtgagcaggtggaacttccatcccttgttccgcttcatcacctcgcgggagaacatgaatcccgtaccgcccacatggcaagaggaaccgagaatcatacgcgagttagacaggaatcgcgattcacggatgaaccacagcgcagaaccagaagacacccagttatccgccagattcaccgaattacggtagctggtcagaatcttgaatccggagcagaacgccttgttcatttcctcgaagtaatgcttgtccagcttgttatcggcatcgaacacgaagtaggcctcataatcatcggccacaccgatgtcgagcatatgccccaacagatacgtcagcgcatatcccttgccaaccagttcaagattgtggcgttccaccacatggcagcccaaagaccgcaccacgtcggcggtgttgtcggtgcagttgtcggccaccagccagatgtcgatgaggtcggacgggtaggtctgatcgcgaatcgacccaataaggttgccgatcacgttttcttcgttgcgcgcggagatcagtacggcataccggttggtcatcggggcgtcggggaagcgcacgggcttggcgaacagggacatcacgatgcacagtccctgatatatcatgccggcaccaccgacgattaccagaagaatatcgagtacggaaagcagggtcatcagcgccaccccgccctaggattgctggaggcagattgatcagactgcttggtttgcttgcgttgcttgggctgctcagactgctgcgtatccgcggcaccacgctgcggaatcgccacggtggcggaatcgtccaaatcggattctttcgtctcgtgtggcggaatcgcatagatctgttcctgcagcaaacgcagttcctcattcatcggcacacggctggtggaccccttggccgcacgcggcatgtgctcgccgatcggctgcagcacatgctcgccgaacgcttcggacgcctcgacgatcttggacttcttctccggagtcggatcgttcatcagtggtgagtcaatcagctcatagcgcttggtgtacgcacggaagatggcctgcagcgatgcggtgaccggcagcgccaggaacgcgccaaacgcgccgaacagcgagccgaacgccagcaccgcgaggaaggcgacggccgcgttgatatccatcgtgcgctgcgaaatcctcggcgagagaatcaggttctcgatctgctggtagacgatgatgaacaccagcaccgccacggcgtacgtccatccgcggttgccccaagcgaacagcaccggcagcgcgccgccgatataggtgccgaccgtggggatgaactgggataccacgccgcagaacagggccaacggcagccagtagggcacatgcagaatctctaagaagatggcagtgcaggtggcgttgatcaacgccagaatcgaacgggagaacaggaaggacgaaatctggccttgggccacggtccacaccagcaggaatcggcgctgcgtgttgggggccagccactggcagaaggagcggcgcagtttggggccggcggcggagatgtaatacgtggtcatgaccacggtcatgaggttcagcaggaaggagaacaggccgcccaccgtactcatggcggtaccggcaaaatcggtgacccacgaggtctggatattgttgaagatttccatgccgagattgctgatttccggcatcttgaacgtggcatactggtccacgaactcacgaatctgctcatacatggccggcaaaccgcggaccatggcaatcatctgctgtacgaacatgttgccaaatagcgtgagcagcacacccacgaccacggccacgcccaccaagctgacggcggaagccacgccacgcttccagccatgagccaccagcgccaccaccaacggttcgacggccagcgccaggaacagcgagatgatgatgtcgagcactagataggagatgtcgccccacgagcgccagcagaacatgaatacgatgacggcgagggccacatacagcagcgcgcggccgaaccattccggtggcctacgggaatctcccttggcggggaacaaagtaccaaagtcgatacgattctcgtcgtccgggtctgccccggcctctgcggcaccggttctcaacgtgtcggtgctgtttacgtttcgcacgcgttcgctcatggctccccattgtagcgaggggtttgaagctcggatacgccggcggcgtacacccgcttttctattgttgatgttatgctcaacgtttcgatcatcatcccagcgtggaacgaagccgaacgcatccgcgactgcctgctgaacgccacccgtcagaccatcatgccgcatgaggtgctggtggtggacaatcgttctacggacaacacctgtgcggttgtcgaacagttcattgccgaacatcctgaggccccggtcaaactgttgcaccagaacgatgaacaggggctgattcccacccgcaactttggcctgaacgccgcgaccggcgatgtgctgggccgttttgacgccgactgtatgatccggcctgactgggtggaggtggtctccggcatcttcaccgaagacccggccgcgatgggtgccactggtccggtgatgtattacgacatgccctcacgccatttcgggttgaaaggcgacaattccttacgcaagcgaatctaccgtgccgatggcggccagccgctgctgttcggctcgaatatggccttgcgcgcttcggcctggcatcagattgtgaatgaggtctgccgggataaggccgatgtgatgcatgaggatatcgatatttccctgcatctgatgggcaaggatctgaaaaccgtgtactcgccgcgcatgatcgccgcgatgagtgcgcgacggatggatacgtcgttgagttcgttcctgagctacatgcgacgttttaagaatacgtttgatgcgcatccgcaacatacgcgcacgcataagccggaggtgttgttcaccgccatgtatccggcgatgcacatgttctacccggtgtggcagaaagtgctgaattccgcggatatcaatccggctgaagccgcgtggatcaacgagcagatggaactggcggaggcgcaaggcaagcagctgtacgacgagacccccaccgacgaagtctacgacgaaaagcacgaaaagtagctagatatacgagccccctctgcttatgcaagctccctctgataagggagctgtcgaatgaagtgagactgaggaagagactgcgacgcagtcgctaaaacattgaatcggacgcaggccgatacctattattcagcggctacgccgcaacttctctccctcagtcagctacgctgacagctccctcatcagagggagctaatgtttactgtcattgactgatcacatcagcgacttgtaaatcgcgaggatgtcctcttcggttgcctgacgcgggttgccgggggtgcacacgtcgttgaaggcatcgtgagccagcggctcaaggtcggcctcggtggcgcccacttcggaaatcgtggtcgggttcttcagatccacggtcagcttgtggacggcctgcacggcctcttcgcgcaccttctccaggtcgccggtgtaggcgtcctcaacaccgaacgcatcggcgatgtcgcggtacttctcaccggtgaagtccttgttgtattccatgaccggggccagcagaataccgttggccacaccgtgggccacgcccagacggccgcccagcgggtgagccatgccgtgcaccagaccgaggcccacgttggagtaggccataccggtgatgtaggacgcgtaggccatctgctcgccggccggaatgtcgccgtcggcggacttggccaggttcttggcaatcatgcggatggtctgcatggacaggcagtcggacaggctccaggcacccggggtaatgtaaccctcgatggcgtgggtcagggcgtcaagtccggtggcgaccttcaggccgcgcggcatcgagtcggtcagatccgggtccacgaaagcgacgatcgggatgtcgtgcgggtcgacagccacgaacttgcgcttgttggccgtgtcggtgaccacgtagttgatggtcgtctccgaggcggtgccggcggtggtcggcacgccgaagatcgggacggacgggttcttggtatccgcgacgccttccagagaaagcacgtcggcgaactccgggttggcggtgatgatgccgatgcccttgcaggtgtcttgcggggagccaccgcccaggccgatcaggaagtccgcaccggactcggcgaacttggcgacgccgtccttgatgcactcgaccggcgggttcggcttgacgttggagaacacctcgtacggcaggccggcctcatccagaaccttggtgaccttctcggcggtgccggtctccagcagcaccgggtcggtgacgataaatgccttggtgaagccgtgctgcttggcgacggccggaatctccttgatcgcgccacgtccgaagtatgcagtctggttgaaaatcatgcggtacaccataggggctctccttttgagctagtgtcttaactggtggtccactctgtctttgagtggtccaacggttccccagtctactccgcgcatgagcattcacctgaaaacacgctgaaagaacaacactgaaaataatggcaagaaatggcggaattccgcacttgtcgaattattgtccattgaccaaaccagttccatcgcccgaaatctcaacgataagaccattttccggagtcatctgacgctctccgagaaactcgtctctcatccgcttacttcgcgcgtagcgcaatcaatatgcgagatgcctaattccattcgtgcttcatcagccgaacgcgaactggttcaccagatggtgtattcaacggtttcagtctcctgaagaggactaagatacctcgacagttggggtgatcatcataagagaatgaggtagataatggcaaatggcaaggctatgacggtcggcgagatggcgtccctgtttctcgaccccgccactcccgttcgtatcgacgctttcgacggctcgcatttcggcccggcagacgcggatttgaaggtcaaaatcgccacgccgaactgcatgtaccagctactcgcgcacccgaatgaaatcggcatcgtgcgctcatacattctgggcgatttcgacgtggacggcattgactacgccgacccgtatccggcgatgcgcaagctggtgtcgctgtccaaatacgttcgcccactcactcccacatcaattgcccgcgtatctgccggcatcctgagccatggcttcaagaagccgccggtgcccgccaccgagggcccgagcaagttcgcccgtatcaagcgtggcctgatgccgcacaccgaaaaggccgattcggaaaccgtcagcttccactacgacatgtccaacgagttctacgccgacttccttggatcctccatgacctacacttgcgcggtattcgacaacgaacacatgagccttgaagacgcacaggccaacaaactgcgcctgattctcgacaaactggacttgcagcccggccagcgcttactggacatcggctgcggctggggttcgatggtcatcaccgccgcccgtcgcggcatcaaggcgctcggcgtcaccctttccaaggaacaggccgcgtacgccaacgaatggatcgcccgtgaagggctgcaggatctggccgaagtgcgtgtgcaggactaccgcgaggtgcctgagcacgacttcgacggtatctgctcgatcggcatgatggagcacgtaggcgtcaagaactaccagagctacttcgaagagatgttccgccttctgaagccgatgggccgactgctgaaccaccagatcaccatcagccatgacaagcctcacggcaagcccggtaccgacgaattcctcgaccgttacatcttcccggacggtgatctcggcgcgcccggcttcatcgaatcgtgcatccatgacgccggcttcaacgtggtgcatcaggagaacctgcgccagcactacgcgctcaccctgcatcactggaaccagaacctctccgagcattgggacgacgcggtcaagcaggtcggctttgaacgcgccaaggtatggggtatgtacatggccgcctgcgctctgaacttcgagctcgacggcatccagattcaccagttcttggccgtcaagccggatcgcgtggcccacccggacggcaagtggtaccccctgcgccaatggtggcaggcctgattcctttttgtgggacggcacgcggtttttaccattgttcatctgccgtcccacacgattctcttcgcacgcgcatttcgcgggtgctttttctgcaatactgactctatgagcgccacagccccgaactacaaccacactgtcaccgcctgcttcgtgggatacatcactcaggcggtaatcaataacttcatgccgttgctgttcgtcacgttcgcggcgacactcggcatcgacatggcgcggctttccgccctcatcaccgtcaacttcgtcacccaactggtcgtggacgtgctggccggcaagttcgtggaccgcatcggatacaagccgtgcattatcgccgcccacctggccgcccttgccggactgctggcgttgggcttgctccccacccgcgtgccggacccgtatctcgcgattctggcggcgattttcctctacgcgctcggcggcggactcatcgaggtcatggtctcccccatcgtcgaggcctgcccgagcgaacacaaggccaaggcgatgagcctgctgcactccttctactgctggggccagctcggcaccgtggccatctccacgctgtttctgtttgcgttcggcaccggctcatggccggttctcgcttgcttgtgggcgattgtgcctgccatcggcatcgcgatgttcgctggcgctcccatgccgcgcattgtgccggaaggcacggcgaccatgcggttcgccgacttgtcgaagaagccggtgttctacctgatgttccttatgatgctgtgcgcgggcgcggccgaacagggcatgagccagtgggccagcgcgttcgccgagtccggtctgggcgtgaccaaggtgattggcgacttggcgggacctgccgcattcgccctgatgatgggcctgtcccgcacgatttacggagtgctggggcatcgactggatctcacggcattcattgccagcagttccgtactgtgcgtggccatgtatctgaccgcagccctaaccacggcaccggtactgggtctgcttgcctgtgcgctcaccggtttttcagtgggtattatgtggcccggaacgttctcgatggctgcagacgccatgcccggtggcggtacgctgatgttcgcgctactagccgtggccggcgacctcggatgcgccggcggccctgccgtagtgggactggtggcctctgccaatggcgacagtcttaagaccgggttgctgttcggatcgatgttcgcattggtgctgttggcgtgcgtagttgcggcgaggaagacagttgttggcgaacgcgagcctttgcattgaccggccagcccgccattttggcctataacccccgccggagtaggtacgcgacggatatgcaaaagccccgcacaaggcggggcttcattatggtggctccgaacggcgtcgatccgttgacctagcgattttcagtcgctcgctctaccaactgagctacagagccatgaacagtcaaaaacccggataatccgggcttcataaccattccagcgaccccggccggacttgaaccggtgacctccgccgtgacagggcggcgctctaaccaactgagctacggggccattgttctcacttgcgtgaggcaacagatgtatatattactgaaattcgccagtcatgcaaacttcggcgtgttccgcataatttcaaggtttttgctatcaccagcacgcgaacacgtctgtcacaaacatccacaaaacgacgaagggcgcgaccggaaccccggccacgcccttatggacggaaacgcttcgcggcatccaccgcaaagtgaccgtcaatctcagtcagcctgcttccaggtgtcgacgtcgatgtggtgttcggggttggcctgccaggcatcccacgcggacttgacgatgtcttccacgtcgtacttggcatgccagcccatctcctcgttgatgcgcttcggggagccgatcaggtgcggcgggtcgccggcgcggcgggccatgacagcctcggtgaacggcagaccggtgaccttcttgacttcgtcgacgatctggcgcacggaggtgccttcgccggtgccgacgttgaaggcgtcgtacttgcgctcgtcacggtcgaggtacttgagggcggcgatgtgggcgtcggccaagtcggagacgtggatgtagtcgcgcacgcaggtgccgtccggagtcgggtagtcgtcgccgaagatagcgggagccttgccctgcttgaggcgattgaacagcatcgggatgaggttcaggatggccggatcctcaagctccaccggaccgcagccggccacgttgaagtagcgcagcgcgcagaagcggatgccgaacggctgctcgcaggcgcgtgccatccactcgccgaacagcttggtctggccgtaggggttgatcggcagcatcgggacgacgtcctcaggcaccacatcgaccggcggcacaccataggtggcggcggaagaggagaagacgagcttcttggcgttcttggactgggtcatgccggtgagcacgttgagcatgccgttgatgttctgctggtagtaccacagcggcttctccacggattcgccgacctgcttgcgagcggcaaagtggatcacggagtcgacgccttcggcatcgaggatttcggccaaacgctcaccggcgcccggggcggcgatatccatgccgtacaggcgggagtcttcgatgcgagtgggcttgccgtagctcagatcgtcgacgacaacgaccttttcgccggcctgatggagtgcgtgaacgacatgagcgccgatgtagccgcagccgccggtgacgagaactgtcatagttgacctttccttgtgcgggttgcaaagcgtcggccgtggggagttcagcggctgttcacttttggtccgctttgttaccttttgaaacaatttgagtatatcacacgaacataatcgcacaaaacggtggtgtcgtccggcaatatctgcattcattaggtcgatttggcgttcattaggtaggtcggcccggagccggcccgcacggacaccgggtaaacggcttgatatggtggttggtatcgcacaccacctacctaatgaacgccaaatcgacctaatgaatgaacagcggtgcggcgcacaaggaaaatccgaggaatatatgaccgatcccgaatccacagcaatcgatcccgtcgccgcgatggccacagaccacaccgaggcaccggcgcaccccctgcacaaggtgctctccttcgtacgccgctccggacgtttggacgatcgcctgcagcgcgcctgggacaactatgccgacacatatctgttggatattgcggccggcaacctgctggacgtgcgcgagggcgtcacgctcgaccgcgcgttcgtggagtccgcatggggcaacgacaatccgctcattgtggaaatcggcaccgggcagggagaaaacgtggcggcagcagccgcagcccgcccggagacgaacttccttgccctagaggtctatgaccccggcgtggcccacacgttgctgctcgccggcaagcaggggctgaccaacattcgcgtggcccaggtcaatgcgcccgagctgttcaaggtgaccgcggccggcaccgtggccgaggtatggaccttcttccccgacccttggcccaagaagaagcaccacaagcgccgcatcgtgcaggaggccatggccggcgacatccatcgcgcgctggtcacagacggcgtctggcgtatcgccaccgacatcgaggactatgccctgcacgtgcacgaggtgatggacggcctcgatggctggaagaacctgggcagcgtaaccgtcagcctgccgctggagcacgtgggcaagggcaatgccgacatggccgccgatatgccgcacgccgacttcaccgaatccgagcgattcgagggccgcgtgctcaccaacttcgagaagaagggcctggccgccggccgcgtgattcatgacttcacctatcaggccgttaccctgaactgattgcgacacgccgaaatgccgtcgatttgcataaccgaacaacctcccgtaaagtaattcgagttgttcgcccccatcgtctaacggttaggacaccagactttcaatctgacaacgagagttcgactctctctggggtacttcactaaagaccccggtcatagcgaccgaggtcttttcgtattcgcgggaccaggtctgaaagcattcggcccgcttgatatgtgctcatggtttcatctcagcacgtgttcgcgcccgccacaaggactatcccaccgtagacgatgtgacatcctccacactgtgacttcgcgcacagggtcccgacgccaccctcaccccgtttatcgacaccatgcgtgtataaccgcatatggcatcatcggcgaacatcggccggcagaccagttgtacaaggagaacatcatccacatggcagacaccgccaacaccaacaccaacgcctggctgccggcgctcaaagcggcgtttccgctgaccataccgatttgcctggggttcctgtttctcggcgcctcgtatggcattctcatgggcaccaaaggcttctccttcgtatggccgatgtgtatgagcgcgttcatcttcgccggttcaatggaattcgtcacggtgaatctgctgctctccgcgttcaacccgctcgccggctttctgctggccctgatggtcaacgcccgtcacctgttttatggactatccatgctcggcaaattcaaagggctcggctggaagcgcccatacctgattttcggtatgtgcgacgagacttttgccatcaactccaccgcgaaaatccccgccggcatcgaccgtggctggttctacttctgggttacgctgtgcaatcagctgtattgggtgaccggcgccacactgggcgggctgatcggcgcgcatctgccgttcaataccgacggtcttgatttcgtactgaccgcgctgtttctggtgatcttcctcgatcagtggctcgacggcaagcatcgcgagcgactgtccgccgtcatcggtgtgctgacatcactggcctgcctgctgatattcggggccaatgatttcatgattccctcaatgatcgccatgctgatactgttcgtcgcgctacgcccgcatctggacgtgttgcggccggccgccgacgccccggaagccacggcagaccatgccatgagccacgcagcggaccagcagaaggaaggacagacgcgatgacgatgaccatctggcaaggcgcaatcactatcgtgacggtggtgctgggcacgatgtgcacccgttttctgccgtttctggtgtttcccgagtccaagcagccgccgcgcatcatcgagtatttcggccaggtcctgccctatgcgatgaccggtctactggtggtatacgcactgcgcaacaccccgattctgaccggttcacacggccttccggaactcatcgcctgcaccgtcatcgtgctgctgcacgtatggaaacgcaatatgctgctttcaatcgccggcggcacaattgtatatatgttgctggtgcaactggtgttctgaggcacccgactcgttagtctctccctccgcttcgctatgctcagcacctcccttacagagggaggtaatcttctgtaccttcctctgacgagggaggcggcaccgcgaagcggtgacggaggtagagacccgcagtcgtaagactgcgaaacacacagcatcggccacaggccgattcctacagctgcttcgccacccaatcgacgatgtacggggcgacttcctcaatctggtcgatggcgacctcgaactcgtgcttgccgccgtaccacgggtccaccagatcgatctgatcttcgcggccgggcttcggcttgggcagattcgggtcgaagctgcggtacatgtgcacttcggcgcgcttgccggccggcagcatgcgcagcagggcgcgcatgtgggaggcggtcatcggcaggaacaggtcggtacggtcgatttcctcacgcgagatgcggtgtgcgaagtggtcacgcggaatctcatcaccatagccacgttcgcgtagcacgcgcacggcacgcgggtcgatcgggtggctccactcctcgtcggacacaccgctggattccacgttcacctggtcgccaagaccgcgctcattaaagaagtgacgcagaatgatctcacccataggcgaacggcagatattgccggtgcagacggtcattacggtgtagggctgggtattgctcatagctttgaatcaatcctcaatcgggcttcaccgggccgcacacggcccgactgtattgttggggtcgaatgaatatgaatccggctcatgccgctataaagggcataagccggattcgcatgcttacttggttttggccaagatacggaaacgataggaatcgatgccggactcctccttggcgggcgtatgccactcgcccacttcggcttcccgccacatcccggcctcgaccagcgacgccatatcgggcgcgtagctgtcggcatccacggtggcggccagatcagtcacataggctttgtccgcgaacggcaaagccttggcgaacaactgggcgccgccgatgatccaaatctccgaacggtccagaccgtcgtccggaatcgcctcctgacgggccatatcgagcgcgtcgtcaagactggtgaccacagtggcccccggcgcacggtacatcggatcgtgggaaacgacgatgttgtcgcggttgggcagcggccggtacttgccccccagcgattcccaggtcttacgacccataatcaccggatgggagacggtcagctccttgaaatgcttcatatcctcggcacagtgccaaggcatgccaccattgaggccgatggcaccggcgcgaccttccttgtcacgggcttcggcccagataagattcaccgagaaggtcttgggataatcgtcaccccagtcttcttcagtggcagacagcccggcagatccgggctcgggttcgtgatagccgctacggctactgtcatgctccatttcgcttactcctcctggattgcggaactgggccttagtgtagtggacagcgaagactcgggggccgtcaccttcacagtattcgctgtccacgaaacggtaatcagcatcagaccgcaacaggtgccttaatagtggggtgatgctggtagccgacgaccttgaagtcctcatactggtagtcgaacagggaatcggccttacggatctcgatggtcgggtacgggtagggcttgcggcccagctgctcaaggaactggtcgacgtggttgtcgtaaacatggcagtcgccgccggtccagacgaattcgcccggcttgagcccggcctgctgcgccatcatcatggtgagcagcgagtaggaggcgatattgaacggcacgccgaggaacatgtcgcaggaacgctggtacagctggcagcttagcttgtcgtcggccacgtagaactggaagagcgcgtggcagggcggcaacgccatcttctccacctcggccggattccacgcggagacgatcatgcggcgcgaatccggatgatgcttgatgaggtcgagcacattggagatctggtcgatggtgcgattcgggtcctcgggggtcggcgcgggccaggaacgccactgcacgccatagaccgggcccagatcgccgttctcgtccgcccactcatcccaaatatgcacgttgtgctccagcagccagttgatgttggaggaacccttcaaaaaccacagcagctcataggccaggcctttgaagaacacggtcttggtggtcagcaacgggaagtacttcgacaggtcaaagcgcatctgctggccgaacagggaaatcgtgccggtgccggtgcgatcggacttcagcgtgccttcggtcaggatcttgcgcaccaggtcctcatagggcatcggaatgtccgtttcgggacgtgcggggatacgggagcgaatatctgcgagttgttcttcggtcaaagccatgtgcaccagtgtagcttaggggcataatagagaagtccgatgatgcgggagagcggccaggtgccgcgctcccccgctggcatggcgatgggccagatcgccggcggctgaaaataaaggagcagctatgggtaagcgactgtgggttgagcgtaacaaggacggttcgtgggatgcgttcagcgacgatggcgcacacattaagttcggcaaggatcgtggccagttcacgccgggcgatctgatgaaggtcgcgctggccggttgcgccgcgctgtccagccagttcgccatcgaacatacgctgggtgagggcaagggtgccaagattgtggtggatggcacgtacgacccggaaaatgacgcctacaccggtttcgaggagcaggtggtgattgatgcttccgacgccggtctgtccgaggaggatgccgacaagctcaaggagcgcgtcacccgccatatcgacaagggttgcacggtcaagcacacctacgtgcaggagaccccggtgcgcatgaacgtcaccgtcaagcactgagacgggatataaattgaagaggctccctggcgggagcctctttccgtatattcggactttactggcgatcgggatcgatggtcttttcgatctgctgggcgacttcaggctcggctgcggacaccggaatctcctcgacgccggcaatctcctccagcgacttggtaggcacttcggcgggcgagctcggcacggtgtcgagacgcgattccgcggcctcaacatacttgcgtggcaccacgtacaccgggccgaccgcatgctgcagcaggccctggctggtggagcccagcagcaagccagtgaagccgccgcgaccacgggagccgacaacaaccacatcgtgatcgtagctggccttggtcagggcgctcacggccgggccggaaacgatctgcttgttgatcttcagatcaggatgcgattcctgcaacggcttgatgcgcacctcaagatcgtccttgtaggactccatgacggcgtcctcgccgtccacacccttcaggttcggcacagcggaaatcacgtccagttccgcaccccagcacgtggcgaagtcggcggcaatgtccagcgccttcagaccccacttggattcgtcggagccgacggccaccttggtgatcgtgttgttcaggtgcatcaggttaccgtcatcatcggtgtacggcaccaccacaatcgggcagtaagcatatgccggcagcgatgaggacgtagtgcccagcaggcgctcggccagaccgcccttgccacggttgccaatgacgatcagattgtagttacgagacaattcgacgaacaccgatgccggatctccggtaacaatcagtgtggcggcttcgacgccctgctcgtctgcgatggccttggccttggacagaatctcctgagcatcggaatgcgcggcgttatcgtcccccatcgccgtgtaagtggcatcgaacgaaacggcggcatagctcggcagggaatatgcgcagacaatctgcagcgtcagccccgcgtgctttgcataattcgcggcccaccatgttgccttgtaactggcatgcgacccgtcaacgccgacgagaatagccttgtcgttaatcatgacgacctccttgaagttattgcggcacgaataccgcgtatctcaacaataccccgcgacactcggtttggccggtatcctccgctcaaaaagaaatccgcgtatacgaaaaaggcacaccccaaaggacgtgccttaatacgaattcgcttaccgcataattcttgtcacatcacgcggcgaatggaatatccagctccaccgaatacggaaacgtcgcttactgccgttccctgcaccgggttcatagcattcatcacctgtccgttaccgatgtaaatggccgcatgagtaccattcgcaagaatgtcacccggcttggcatccgccaagcttgcgaccggagtacccacggtggcttgagcaccagaggtacgaggcagggagatgccaaactgggagaagacgtactgcacaaaaccggagcaatcccatcctgccggagtgttgccgccggcaacatacggatagccttggaacttcagtgagaagctagcaagctcagcgccagtgccagtgccagtcattttacccaagtcaacctgtggaatcgacgcacgctgttcagagcggctggctgccgcagcagcagcggactgggctgcagcagcttcatcagcggctttctgagccgccgccgctgcagcagcttccttctcgccctgagactcggtctgtggcacatcaagagtctcgatgccaccccatttagagttctcatcaaccgaggtggaggtggattcggcgaacaaattcttcttcaccgaactcgccttcgggaaagaacgtgaggacaccacagcactcgtctgcgcggaatcggcagaggcaaacggggctacgcacgcaaacatggcacccgtggcgataatcgccactgatgtggaaataatagtcttaacgctcatcatcaacgccatacactagcacacatgggtcgatttcataacaggaatagcatttcgaagatgatgtcgcgggtgcatcattcggcaggagaacgcaacaggcctcggataccgatcggcatccgaggcctgcaataaatcaatcaataagactgcatcacgggatacgcaccacgatggtgagcttttcggtcatggcactagcgagagccacgctatagccattccatccaccatggaccgcctgaccgttgccgacatacaacgccacatgatcgtagtgtgcaccaccgttccatccaccggtgttggcataaatcagaatatcgcccggctgcagggatccgtctgtgactacgtggccaccaggaacattgacgtactcttcaggccaaccgtggaagttaatgccacgggccgccaacgcttgactgaccaatgcggtgcagtccatgctctgtccgatcaaagaatacgcacggtcgatagaggcaccggcaccagcggaaaccgaaccactggcatcggaataagtaacagaagagcgagactcattacggctcgcggcgttggcctgctcctgggtcgcctgagcctcgacctccgcctgcttctcggcctcctcttcggcagccttcttggccgctgcggcatccttttccgcctgagattccgtctgcggcacatcgaggttctcaatgccgccccaatcagcattgtcctcaacgctcgtggcagtggcttcagtcgtcagatctttgcgcacctgggtgtacgaggggaaggacttggtggaagtcacagtaacaccctcagctgcagttgctgtaggaacaaacataaacaagcaggcacaggagacaatcgcggcaacaatggaagaagctacagttttggtcttcatagaactatcaccctacacggtgcgcattaactcgtacaggatggaagaaataaaacaccccggagctattgggatatatcggcgtgtcggcacaggtcagttcggactaatacgcggccgcaacacttgaaatgtcatttcgcgcgaacgattgccgatagggcgacgtcacatccgaacagtaatcaccgaatgtaagccaatgaaatgaatcagtagtgaacgtactggaacttaccggcttcggcggcgctgaacgtacgggtcgaaatcacacccaatcccttggcattggattcggagatctcaatggagccgtcggcattgatcttttccagaacggcaacatggccgtacgcgccatcggcatcggcctggccaggagcgaacaccacagcatcaccgacatggcgaggagtgttgtccacccaatagcccagagcggaagctgacgccgcccacgcgccaccattgccgaagttgccgctggaaggcaggcccagttcggcacgacgctggtacgcgtaccacgtgcactgaccccacggatagttgttggagttggtgccaacggcatggttcgggttgaagccagccggcacagcatcgccatcggcatccacgagagccgacaccacaggattgttcgcattattgcgattcatcagcttggcgtccaaggtgctgtctgaattgctcagcccccagccgccttcattggtggactgtgcggtaacggaggatgaactcaaatcagtacgcgcttcggaacgagaagccgcagtcacatcgctgatgcgcttaatctgcgtggtcgtcgtggccggatcagccacgaacgagttcgtggcgtcttcattgttggaaaacgcgagagcacctgcggccgtgccgaccagagcggccagtgaggccgaggcaagaatatggctacggcgttcagcggcacgagcggcctcacgaatggaacggcgggtctggggagcgatttcgttgatcttctcggcgatggccggatcaagccccaaaacaacggcgtcgctaccagcggattgcaccgcacgcacagcacgaacggaatgagaacccttgccggaggcaaacaatgccttcgctaagctgaacttctggcgcgagaccgtggtcgctttatgcgaagcatgcttcatactacgttaactccttggatgggttcggcggggtcatttcgatgacctcgtatgaccgtcacaattgagtactgtacaacgaacagaggtcaatcctcaatgtgatcccccaccatccgggtgtgtcaaacgatttacgtaaccgtgcggccgggtgaaaaaactgccttgtttccgcccgttcacgaacctcactatccggttatcggaagaatcactaactcatgtcattccgacacaccgtaaccatgatgtgctgcgtacattctgcactgcattccgcattgccaccactgccgcccggcaccccggaattccgcagtaaccccgcagtaatcccgcacaccgagcattatccgcgatattccccaacactggtctacccttgaaaccatgactatcacactgagtattcccgagtcgctgaagcccgaagatggtcgcttcggctccggccccagcaaaatccgccccgaacagatcgccgcgctcgacgccggcgccaccaccctgcttggcacatcacatcgccaggcaccagtcaagcaactggtcgcttcgattcgtgaaggtctgcgcgagttcttccacctgcctgaagggtatgaggtggcgcttggcaacggtggcgccagcgcgttctgggagattgcctgcgcttcgctgatcacccgtcgcgccgcattcggcacgtatggctcgttcagtgccaagttcgccgcgtccgccgcgaacgcacccttccttgaagacccggtgctgttccccggcgagccgggcacttaccgtctacctgagctcaccgagggcgtggacacatattgctgggctcacaacgagacctccactggtgtggccgccccgattcgccgcgtggccggaagtcgtgaagctggtgccttgaccgtcatcgacggcaccagcgcagccggcgctttgcctgtggacatcagccagaccgacgtctactacttctcaccgcagaaggccttcggtgccgatggcggtctgtgggtcgccatcctctcccccgaagctatcgatcgtgcggcaggcgtcgaatcaagcgctcatctggaaggcgcacatcgctgggtgccgccgttcctctcgctgaccacggcactgaacaactcccgcaaggatcagaccctgaatacgcccgccgtggccaccctgatcatgatggaaaaccagattcgctggctcaacaacaacggcggcctcgcctgggccaccacacgttgcgccaagtccgcatccatcctgtactcgtgggccgagcgctccgaatacgccgctccgttcgtcgtcgatgcggacgcacgctcgaacgccgtggtcaccattgatctggacgagcgagtccaggcctctcaggtactgtccatcctgcgcgagaacggcattgtggacgccgccggctaccgcaagctgggccgcaaccagctgcgcgttggcgtgttcccctcggtggaaccggctgatgtcatggccttcaccaagtgcgtcgactacgtggtcgagcacctgtgatggcatatatgccccgcattgccgaccatatatgccatgcacattgatcggtctcaactgatgccgattgaataaatcgtagggagggatgtttgacgcccctccctactcttactacagtgcatgagtatgaagttcgcgcctctcattgaccctgccgtccgcaaacccgcacccaagcccgtacgggtggatctgcgtaaggtgtttgccatcggtaccggtctatggattgtggcgttgattgtcgtgctgattctgctggccgtgggctacagcgtaatgccgttggtgattatgtgcgtggccggcgtcattattggcttgctactgctggtctgggaatacttcgaccgctgggactaccgccgcctcggacagtaacgcaacacaagctccctctgatgacgggagctgtcagcgtagctgattgagggagagaccgcggccgcaggtcgctcatcaaacagcattggtggcatgcaaggcatgccaccaattccttacctcactgcgccaatggcaacgtaaggctgaacgtactgccttgcccgggcgcgctccatacggtcacatcgccatgatgggtcagcgccacatgcttgacgatggccaagcctaggcccacgccatccgccgtgcgattgctctgttccacgccccggtagaaccgctcgaagatgcgcgcctggtccttcttagcgatgcccgtgccttggtcaatcacgcgaatcaccgcgcggtcgccatccttgtctttggatgcggacacgctgaccacgccattttccttggaatagccgatggcgttttcgatgagcttggtcacggcgctgtcgatctggtccgcctcaccattgatgactagatcatcgtcgcccttgatgttcagctgcacgccagcctcggctgcctgcggctccagtcgcgccgccgtggccctgagctgttccataacgttcagtcggttggcggaagacggcgtaatcggctcctgcgcgcgtatgagcagcagcaaatcagacaccatgtggttgagcttgctgcagctggaacgcacctggcgagcgtcggcagccacctgctgttcgtccagattgccggactccagcgaatcggcgagtttggccagagcctcagtggggcccaacaattgctcggacacattggtaataaacgagtcacgcacttgagcgaaacgaatcacatcactgacatcggtaatcaacacgatgacgaactgctcgttgatacgccctacagtcaccttcagccagttggggcggtggacggactgcgtggcgacgtgatcgcccttgttctggtctgcgacgtaccgctccggagtatcggtggtcaagtcgaactggcgcttgccaccggacttgcgcgcctcgtgaatggcatccagcacatgctgctgggcaatggcgtcatctgacaccacacccaggcggtaggcggcgggattgcagcggaccacctcgtcgtgctcgtcgaccaccacggacgcacctggcagcatggacagcagcgtggcggtgtcgtcggacagatcgtcattgtcgtcatcatcggccagcggcgattccatggacactcgatgtgtcgcaaatcccacgatgagcgtgatgattcctaccacaaataaaacagccgtgacaataagagcaatcgcggcgacgagcggcatctgtgtcatgcccccattctttcacaccacacgccgggattgcggtttgccggcacgccggtaacatgaatttcaggtgaacaacccaatgaacagtagaacaacttgaggttgccattacctacgttgaagtggggaacaagtactggaataatacactggtacaggttgcaataagcaagcatgaaaggctagagaaatgcgcgttattttcaacgaggagctgaagcaggttgctgacgacctcgaccgtatggcgcagaacgtacgcaaggcgatcaaaggagctggggaagccctgctgaatcaggacgttgaagccgcacagactgtgattgacggcgacatcgaaatcgatgccctggagtcctctgtgattgaccagtgcgtcaagttgctcgccaagcagaatccggtggccaccgatctgcgtgtggtcgtttccaccatgcgtctggcttccacgttcgagcgtatgggcgatcttgcccgccacgtggccgaggccgctcgccgcacctatccggccgccgcgattcctgaatccgctcaaccggtgttcgccgagatgatcgacttcctggacaacaccgctgaccagctggtggccatgctcttcgatcgcgatgccaagaccgccgaggccatcatcctggctgacgacaagctggacaatctgcaccaccagaccttcgatctagcgctgtccgatgacatcacccgtcagcagaccgtggatatcgtgctgctgggccgcttcctggagcgtctcggcgatcacgccgtgtccgccgcccgccgtgtggtgtacatcgtctccggcttcgaccccactaaggagccgacccgcgacgagggcaccgacatcgactgattgggacttgttctcacattgggcgaataactgaacacttgttctcctgtggtttgaggaggatgcccgaaagcggcgatccggctacggctggacgccgttttttgttgcttttgggcggtacaccggcgtatccatggggcggcaaaacacccatagggcggtaacttgcccatggggcggtttgaaggatatgtgaaaccgcggaattaagccattctggcataccgccccatgagggttttaccgccccatggggtaatcaccgccccatggggatttggcaggcatagcaaaggggagccgcacgttatgtgcgactccccttacagcttgtaccgtgttagcggcttaggctcacttctggccctgagcggcgacagcggcggcaccggcagcagcagcctccgggtccaggtactcgccacgcggcttgatcggcttgaagttctcgtccagctcgtagagcagcgggatggcggtcgggatgttgaccttggcgatctcttcctcagacaggttgtccagcatcttgacgatggcgcggagggagttgccgtgggcagcaatcagcacggtcttgccggccttgagctccggctcgatagcggactcgaagtacggcttcacacgctcaacaacgttggccaggcactcggcttccggaaccggatcgccggcgtagcgcgggtcgttgttctgggcgtactggtcgttcgggtcgatctcgggcggcggggtggcgtaagaacggcgccacagcatgaacttctcgtcgccgtactcttcgcggatctcggtcttgttcttgccctgcagagcgccgtagtgacgctcgttgagacgccagtcacgctgaaccggaatccacagacgatctgcggcatccagagcgatgttggcggtgttgatggcgcgacgcagcagggaggtgaacacgatgtccggaaggacgttcttctccttgagcagctcgccgccacgcttggcttcggcttcaccctgctcggtcagcggtacgtcgacccagccggtgaactggttagttttattccatgcgctctgtccatgacggagcagtactagtttataagtcatacggttcagtctacagccgcgtgcgcccaaacacgagtattcgtcttattatttcgctctcagagcgtcacggaaaccgccagcaccaccgcaaacagcaaggtctggaagctggcggcgggcagagccgggcggaattgacgtttattcacgctggagaccatgcgcacaggtattccgacgcccgagatcaacagcactgcgccccacggccaccatagggtcgcgcacatgagcagggctatggcccacgcggccacgcagcacacaatcagcagcgtacgcgcgccggattcacccagccgtacggccagcgtgcacttaccatgctcacgatcctcgtcgatgtcacggatattgttcaccatcatgatcaggcaggagaacaggccagccgccacagcacccaatagtccgccgacgtccaccgtgccgcacagcgcgtattcggtgcccaataccgcagccaagccgaagaacaggaacacgccgacttctcccagcccgacgtatccatacggatgcttgccaccggtgtagaaccagccggccagcaaggaggccacacccacggcaaacagccaccaagcttgggaaatcacgatagcggcaatgccgcatatgcaggcgatggcggcgcaaatcatcgccgcgaacagtacatgcttggccggtaccagtccggatgcggtcagtcgctggggtttgcctgatttcgattcgtccgtgtcacgcccggcgtcagtgccgcggatgccatcggaatagtcgttcgcatagttgacggcgatttgcaggaacagcgcgactagcaggcacaggatggtcaccggccagaatcggtccatcagcagggtctgctgttcacgggccgtggcgcaggaggccggttcgggatatattgcgatgcaggtgcccgactgctcgatatgcgcgtatgccatcgtcgccccaaccatcaccgacgcgatggaagtggccaaggtcttgggacgcgcgccccgaacccacaagccgatggacataagcaatccctttcatatataactcggctcccctctctgaggggagccagagtatgcctaatcagccaacgagcggcttgaccagcgggaaggtgatggtctcgcgaatcgtggcaccggtcaaggcgataagcagtcgatcaatacccatacccataccgccggccggaggcatgcccacgccgagagcctcgaggaagtcctcatcgatgtcgcaagcctcttcgtcgccagcgagcgcgtccttggcctgagccacgaaacgttcacgctgcacgatcgggtcgttgagctcggagtagccggtagccagctcgaagccgcgcacgtagagatcccacttctccaccacgccgggcttggtgcggtggcccttgaccagcggggaggtttcgaccgggaagtcacgcacgaaggtgggctcgtaaagcttgtcctcgtagaagtgctcccacaggtgttcgacgagcttgccgtggttctccacgtcgtcgcgctctacgccgagcttgtcggcgatggcgcccaggtgctcaacggaggtgccgggggcgtccgggccgccgttcggcacaatctcctcgcccaacgattcggacagggagtcgtacatgctgatggtcttccattcgccgccgaagtcgtattcggtgccgtcgagcagggtgaccttgtgcgagccgtagacgtccatggcggtcttctgcacgagctccttgaccagctggccgatggaatcataggtgccataggcctggtaggcctcgaccatggtgaattcgggggcgtgcgtggcgtcgacgccctcattgcggaagtcacggttgatttcgaacacgcgatcgatgccgccgaccaggcagcgcttgaggaacagttccggggcgatgcgaaggtacaggtcaaggtcgaaggcgttcatgtgcgtggtgaacgggcgggcggccgcgccaccgtgcagggtctgcagcatcggggtttcgacctcgaggaagtcgtggtcgtcaaaggtgcggcgcagggaggccacggccttggagcggttgcgcaccatgttgcggatgttctcgtccgcaatcatgccgatgtacggcttgcgggtgcgggtgtcttcgttcaggtccttgtgcagggccggcagcggctgcagggccttagaggcgatagcccactcagtggcgaatacggacagctcgccggtcttggaggcgatgacgcggcccttgaggtacaggtgatcgccaaggtcgacgagctgcttgaactgcttgagcgagtcggcgccaatctccttcttggagatcatgccctgaatcttggtgccgtcaccggcggacagctgcacgaagcacaggccgcccgcgttgcgcaggaacagcacgcggccagcaatgccgaccatgtcttcggtctcttcgccagcctcgagcttgccgtcatacttggcgcgaaccgcctcgatggtgtcggtgacgtccaagtgcaccgggtagggggcgatgccggcctcaagcatcatcgcgcgcttggccacgcgcatctgcacctgctcggggtgggccagcgggccgaactccttgttggaggggtccacggcttcgtccagcgtggcaccggacttgatcttctcgcggatggtggcgtcctgcttgagcagcatttccgcacgttcgacggtgctcatctgcgggacggccggggtttcattctcagtgttttcggtattttcgacaacttcagccatgattcatcagtgtacgcaaggccggcgattatgagcccggcagaccgcacggccatctgaacacccgctcacatgacgcaaaaccggccctgcacaaggcttgagagacctgtacacatggcgaatccaccatcacgcaacactcgcgacatgccgatttgcattgtccaccaccacaatgtaatatctacatctgttgccaaacgggctgtagcgcagcttggtagcgcgcttcgttcgggacgaagaggccgcgggttcaaatcccgccagcccgacaactggaccggattgttgagaaatcagcaatccggtttttcgtttcctgtcccaacaatcaaaccaagcgattgaacagcggtaaacaacccgccgcacacagcgacaaaccacatcacggcaagcccccgtatttgttggcggaccaccgtaatatatcgctcgaatcaatcgattgccgcactgtttttgtaagtaatactgaagtaattagaggaaccatgaagaagagtctgcttgcactggcttcgggcgcgttcattctcggtgccgccgagttcgtgatgatgggcattctgccgcaggccgcggccgccaccggcgtggacatccccaccgcaggccattacatttccgcgtatgcgatcggcgtgtgcttcggcacactgattctggtattcggccgcaaggtgccgccgaaggacctcatcatattgtttatggtgattgccttggtgggcaatctggcttccgcattctccgtcaatgccgccatgctggtcgtcgcacgattcgtcgccggcctgccgcacggcgcattcttcggcacagccacactcatcgccaagactctggcggaggaaggcaaggaggcgcaggccgtatccgtgatggtcaccggacagaccgtggccaatatgctcggcgtaccggcgggcaccttgatggccgagttcctttcctggcgtcttgccttcggcattttggccgcttgggcggcaatgacgattgtgctggcgtcggcgtggattccgtacgttgcaccgatcaaggacgcaggcatcgccggtcacccgccgtggcccgtgggtgattttggccgccgtgttcaccggcaatgccggtgtgttctgctggtggagctacgtctccccttggctgcagaaaaccggcggatggtcgtcttccctggtgccgatgctgatgatgcttgccggctttggtatggtcatcggcggtctgcttggaggtcgtctgaccgaccattggaggcatgccggcgcggccgcaataggtcagtccatctcctgcctcggcttgttgctggtgcttatcactccgggtaatcagccgatgaccgctgtactgacgttctggatcgccatcggattgttctttacttccgctccacagcaattgctgatgaccgaagccggccagggcggcggcgagctgatcgccggcgcggctgtacaggtggcgtttaacttcggcaatgccatcggctcgattgtcggcggcgcgatgctcaccaccttctcgatgaactatcgctataccggcctgggcggtatgccgctggctctgcttgccgtagggctgctggccttctactcgtggcgctgcgaaaccgataccgacgccattcaccgcttgcgcgaaaccaaggtggactgagaccaagctcacagcaaactccctgacgtgtttgttcacagtattaatagactgaaatcagacacgattcagggaggtctggcggtatggatgaggaagcactgctcaaacaattcgccgcgcaattcgcgcatggtccagacgatgccgacgacaccgatgcggcggccgcagcacaaggtgccgattccacggcgaaccaggttgcggacgatgccgatcaatcgcccgcaacctttgatacccaacaattcctgaacggactggacgcgattttcgatcgccacacggccgccaccgaagccggcccgtacttggaacaggcgatggtggacgcggaaaacgccggcgacgaggccggactgctcaccgtgctcaacgaaacgatgggcttctatcgctcgcaaggtcggcacaaggagaatcagtggattgtgcagcgagcgctggaactggccgctcgtatgggcttgaccaccggcacatccgaggcgtgggccaccacgctaatcaattgcgccacctcgatgcgcgcggccaaacaatacgatcaggccgaggatttgtatcatcaggcgcagagtgtctgccggcattcgctggtgcccaccgaccgtaggctcgcagcactgcacaacaatctgtcgatgctctacagcgagacgaatcggcccgacaaggcggaactggagttgcgtgaagcgctgcgcattatcgaagcctcgagcgtgaacccggacgcggatatcgacgtgtccagctcgcacacgaatctggcgttgaccctgctgaccgaacacaagttggaggacgcgcattggcatgcagccaaggcgctggaaatctatcgcaccggccatctggaacattccgcgcattatgcctccgcactggcgggcttcgcgcaggtgtgctttgccgagagacggtatgcggatgcggttactggataccggcatgcgctggccgtgatcgaggaatgttacggcaaggacaccgattactggcgtatcaccgccgacaatctgcggcaggccgaggaagcggcggcgcaggccggggtgacggttgacaatgcaggtgttgccggcgatgcaggcgcgctgccccagtccggctcgcggctgccgaacagcccggcacagggcaagaccggtgcgaacgcggcatcttccccatccaccgtttcggtgtcgaccggttctgcgggcgcggccgaggccgtttccgcatgcccggtgtccggactgaagctggcccgcgcgttctggacgcagatgggcaagccgatgattgcggcgaagtatccgcagtatgccgggcgtatcgccgccggtctggtgggtcatggctcggaatgctacggattcgatgatgcgtattcgcaggaccacgatttcggcccgcgcttctgcctgtggcttacggatgaggattacgcggcgatcggcgagcaacttgaggtcgattacgaggcactgccgcgcaagttcagcgtggatgcgcaaggccgcgtgacgttcgaggcgcatgccaggtccgatgcttccggagcattcccctccgcaggtgcaggctccaccgtcatacccgatgcggcaaacgcacccacccccggcaccgctacgcacgataccgccactgccgagtcaggcgcggcgtcctctgatgtggcggaagcgatgacgactccgattgatgcaccgctctcccccgtcacgccgcgcgcacagggcacgaatcgccgtgacggcgtgttccgcatcggtgacttctttgagtcgatcaccgggtatcacactgcgccggcgcagaccgcgccgcatgagtggctaatgcttcaggaatcgaccttggccgccgccaccaatggcgaggtgttcgccgatcccaccggtctgttttccaagacgcgccaagggttcaagaacatgcccgacgatgtgcggctcgcgctgatctccaagcgactcggcatgatcgcccaggccggtcaatataatctgccgcgttcgttgaagcgcggcgacggcgcggccgcatggctgtccatccacgagttcgtgcaggccaccgcctcgttggtgttcctggttaacgtgccgatggtggtgggctatatgccgtattacaagtggcagttcgcagcattgcgcaagctgtctggctcgatgttcgcgctgttgccgaacgtgggcgaacagttggaaaccgtgatgcgattgagttcggcagcctgctatggcggggccggatttggcgaaggcggcaagggcgcggctccagcaatcgagaaaatcaacgatattgtggagcagattgcggtggatatcgtcaaggaactcaaacgcgaacacctgaccacgtccggcgagaccttcctcgaatggcagcgcccgtatgtcgaggaccacatcgcctctgatgatccggtgcttaaaagtttgtagattcaagctccctctgccacggcttcgccgtgccacctccctcatcagagggaggtatcagtgaaaggaacgtcgatgaccaacgaactgactgatgatgaactgcgcgaggctattgtgcgtcatgaatgggatcagttccagcgcaccaacaatgagggtggacgcgcggcatgccaaggcaactggccggtgttccaccagatgcggttggcccagttcctcacatgggagcggccattactcaccagctatgccgctgatcttgacgcggccgaccacgtgggccgcaacctcgtgaccgaaaaatacggccgcatgatggcctccaccgcaccggaaaatttcacgaagaacatagagccgtatattccgcgtctctctgaagagcgcgcggcccgtcaggaacaggtcatcgcccagcaggtcgcctgggccaaggatttccgcgagcgctaccccaagctcggcgaggcgatgcgcgcactcaccaccaccgaagacacaccatctgccacctcattcgaaacctatctgcgcggcgagcttggtacgtattccgaccagaccttcgaacgttacgaagcgatgattggcgagcgcgccgcagccagcccgcaacgcaatatcactgaggaaaccttgttgcacacagtccagctcggcggtttcgacaccttagaggaggccgaagcctcccaagcgtaatactcagccattcactgtgtatcggacaccccgactgatgtacgtcggccggccatacccaggccaacgcaatctgccgatcgccccacacccagaccaccaacgcagcctgcccgccaggccccatttaccagcgcacatcggcagaattacagcgagaataggccccaaaatgccagtgtcatcagtgtggcgagagtgccgagcgctaccatcacgcatatgacgcgccgcacaccgacgatatcggcgcggcaataccagacacgttccatttcccaagcaaacagcaccaccaacagcatggtcgctattcgcagcaccacccatccgacggcaaacagccgcggttgaggcataaccaatacagccgatacgcctacggcgctcatatagccgtacaacagcccagtaatcaccatcaccgctgtgccgataccggcagataagccggcaatgccgtgcaacatgcgccgctgggcggcccccagctcactcggcgtcgcatgcacggcccgcacagtcgccacactacgtcgcccggccagcaacgtctgtagccaagaaaacacagtcaagccaatacctaatatcgccgccatcacgatcagcacgggccctgccaccatcagaccggccagcacgccaagcgagccgacgataccggatctggtacgttgcgacgcggcgaagcgctggtgaggtgttgcaccggcgacttgaggcgttgcccatccatcggctttggttccggcagtcacaccgttcacccaattttccagcgcttgcgtatagccttcggccaatggcaggttcggggtgaataagccctcaccagcccgcatctgatggttgccggcaaaatagcgtacggtgacgttctcgttgccggacttgttggccgtagcgatgatccgctgcgccccctgttcgatgggcatggccgtatcgtaggtgccgtagttcaccagcaccggcatggtgagggatttcagataccggtcggcatcaaagtcggcataggctagatcaaatggcgcgtagtccagcgacatcaatttggccatgtctttgaccacgggcttgggcgcgccggcctcatgcgtataggcgctgacagccatggccatttgctcacgtccattgaacaccggtgcggatgtaagtacggcaaaggcaatgtcttgccgtttcgaggttagaatcgtggcgatccaggtgccttcggattcggcgtagatgccggttttggcggggtccacgccgattctgccacgcaacacgtcgagcgaacgcccgtattcgcgagcaaaacgcgggtagtcgcgatgcagcacggtgtagttgtcgttgcgcttggccggcaccaaggtcacgataccggcagaggccatggcgttggcgatatcgccgaaatcctcggcaccactggtaccggacccgtgaatgaacagacaagccgggcgtggcccgggagcgccgaccggttcacgtagtacggcgggtagcgtgacgccgtcgccggtcttgatggatagtcgggtttcacgcgtacgatatcgcccctcgtggggaatgttcgcatgggcaggggtgatggtggtgtcggcagaagcgataacgatgtgcttggtgtagggccgtgtgttccattgcggcatcatcgcccagccaagtgtggcgaataccagcgtcatcgccatcgcggtgacgatgacgctcgctacccgccgcaccgaaatccgcttcatagttactatgcctccccccatcagcatagaacggtcggctcttatcggtcggctcccgtcataatgtgcttctactgggaccgtaatgcaatggtttgtaacgctattttctcttcttgacggcaccgactatggcccatacaacggccactattaccagaatcagtcccactacggcgcaaataacagccgtcagcaattgcggattcggcgagaacaacgaaatcatccgatccggagatatgtacccgaaaaccagcgcgatcacgccgataatcacgcctaatagtccgaataccacagtaggcgcgctggtgctctgtttctggatgttcttggcactcttgacatccttagcattctggacgttcttggcgctctggacgttcttggcgcttcccccaggctggcatggtttgccggcggtctgagactgcccatagggaggtcgtgctgaagatgctgcgtacatcggcacatcatcggcagatggaatcggcccaccatctccctccacggcatcggcaactgtttccagggcaatccgatctgtggttggttcgatgggcgatggagaggcagctgttgcctgcgtatccacatccgagaccgacgcatccgcatgattgtcggggacgggcagcacagccgtttcgtcatcatccgctgcggatggcagcaccgtggtatcggttcggtcatcgacggtcaccatggttgtggtcgcggtggtcgcgtcggtttcggaaggtatggccgtggtcggtgtcgcatcctcaatggaggcgaattccttggtttcatcagtcatgattccatctcctagttgcaacggcttgatcattccgattgttcggttgtgttcttgcttgtactgttgccgtcgtatatatcggcaagcggctggaacgtagagccttcccaatcggaggcgtacaccacgttgacacgtgcttccaccacatagggaatattgatttttaattctgggccgttgtccggcatggcggattccttatacaaccattcgtgatcaggcccattggtggcactttcagcttcgaagaaaacaaagcttggacccatgtagttgttgtataccatctcgtatttgccgccaacgtcactcgaagtggagtagtaggagtcggcggtgccgaaggcgtaagtgcaggaatccggcagaacgatatgcacttgcgcctgtgttgcggctatggtgatggtaccgaccgggcaattactgatggaagttttgccatccagcatcttcaccgtgtgcggtccatgtgtcttgtcccaatcggaccaatcaatgattgcctgatcggtgttgtagttttcaccgctgaacgccacaccttgctgcaatgtttcaaacgtggcatcgctggcatcggcaacgaagatgccatccttttgcacatcgttcatgccgtcgctgtttctcgcactgacagattggctcagtgaaacaacagtattgatgccgctggcaccaagatcacggtagtacacgccatacgtgcctgaaacgatggtcatgcagagcgcgcatccaccggcaaccagtccgagaggaatcagaccaccggtacgccgtcctctgaatccgagaatgatgaccaccagccccatcactatgcatactgcggcaatccagatggtgcccagacgcataatgccgataatgcccatgtcgtttacccaaatcagtcccatcagaccggcaaaggagaggaaggtaaggcccagtatgctcaagaccacgattgggcccgccggcttgcggcgcttggactcggtggggcataggccgtcgcattcatacggtcgggggcaaacggcccgttgggtactgtgccgggcatcgcgccgggcacagtacccggcatcacgctgggcatcgactgatagacaggctgtgaaacaggctgtgaaacactaggcgcggtttgtgaaacaggctgtgaaacaggttgtggaaaaggttgcggagctgaatacaaaggagattgaggtactggttgcgcggctggatatgagacaggctgtggagctggatatgacacaggctgtgaaaccggtcgcggcgcagatgccccgaatccgtacccttcctgctggcgaatgccgcttttggccaacagccatagcgctaaggcggcgagcgcaatacaaccccaccccgcacctggaatcacgattgccacggcgaggaacaggaagcatcccagacaattccagtcccattggccggcaatgaggtcctcggccaagatgtgcccatcgcgtacatccggcatcagaaaccagccgagtgcgtacagagctgcgccaaaaccgaagaacaatgtacatacaatcaccaacgcacgtactaatgtggggctccagccaagccgtaaagcgatgccgctgcatacgccgccgatccaccggtcgtcgccgcgaaccagtccactggatcgcacccaagtgaagaagcgtcgcgatgtcttgtttttttgcggaccaggctgcggctgtggctgatatggattcgcgtttggattgctcatgattccattacaccgcccgaccactgccacaacgctcggggaacaccctgattgttccctgaacaccgggtaaaaccccggccgcaacgccctgagcgcggcacaataggagtatgacgtcatctcccgaaccattgctgcccgcgcgcatgccgttgatgcgcccccggcagggccgttggctcaccggcgtgtgcaagggcatcgccctgcacttgggcatcggcgtggcatgggttcggattgcgttcatcgcactgaccgtcctctacggcgcaggcatcatcgcttatgtattcctgtgggtgttcatgcctgccggagacccggtggcggctgcggctcgcacagtgcccgttaatcaggcgccgcttgcgcgaggcaatcagccacttgccgctcatgacgacgaatcggctgccgcaccggaatcattgtccgaggccatccaacgtgctccgaaaccggccgtcgtggcattggccggtttcgcgttgatggccactggactgttgctcaccagcaccggtgcggatgtccagattgtgtttccgctgctggtagggttgggcggcatcgcactggcatggatgaatcttagtccgcgaggcacgcagctgttgtctatgttgggcggcatcgcactgattttcatgggatgggcattgtatgtgcataatgtcagcattcctgggtggggcacctctcctcgacgcattgttgccagcggattcgtgatgatcgtcggtatcgtggtggcggtgatgccgtgggcgaacgcgatgctgcaacgactcacccacgagcaggcattgaaggagcgcgaagaggagcgcgcggacatgaccgcccatctgcatgatggcgtgctgcaaacgttggcgctgattcagctgaactccgaggaaccgaccaccgtattcgccctggcgcgtagccaagagcgcgagctgcgcgaatggctgtatcaggaacgttccacatcggatcgttcggtgggagccggattgaagcagatcgccgccgaggtggaggacgagcacggcaagccgattgaggtggtcaccgtgggcgacgcgcggccgagcgcccagaccgatgcgctgctggacgccacccgtcaggcgttggtcaatgcggtcacgcatggcggcgagccggtgtctttgtattgcgaggccagcgacacgatggttgaagtgttcgtgcgcgaccatggcgaaggcttcgatatggacgccattccgcccgaccggctgggcatccgcgaatcgattatcggccgcatcaaacggcgcggcggtacagtggagatagtgtccagggccggctggggcaccgaggtcagaatgcatatgccgatcgcgctgaaagcggcgcagggagaacatcgatgagcgagaacgagacagccaagattcgtgtggccatggtcgatgaccatgagatgttccgtgcgggcgtaatcgccacgttgcgcgattccttcgatatcgtcggccaagcggcggacgtgcccggttcggtggcgatgatcgcacagaccaagccgcaggtggtgttgctggatgtgcatgtgcccggcggcgagggtggcggcggtgccgagatcctcgccaaatcgcggccctactcccccactaccgtgtttctggcattgtcggtttcggatgcgccgcaggatgtggggtcggtgattcgcgccggcgcccagggctatgtaaccaagacgattaccggcgctgatttgatttcatccatcaagcaggtgcatgagggctatgccgtgttctcgccaaaactggccggttttgtactttcgaccttccagggtgtgccggcggcggggtctgatggcggcgctgatggtgcggcacgggctcatgatgaggagctggaccggctgtccgcccgcgagcaggaggtcatgcggctgatcgcgcgtggttacacgtataaagaggtggcggccgaactgttcatttcgatcaagacggtcgaaacgcacgtgagctcggtgttgcgaaagcttcagctttcgaatcgcaccgagctcacccgctgggccgccgataggcgcattgtgtgataaacgacagatgagctccctcatcagagggagctcatctgctcatatcactccgcgtcgcggaaaccgttggggttcttggtctgccagttgagggaggaggcggccatgtcgtcgatggtcagctcggccttccagccaagctccttctccgccttggaagcgtcggcgtagcaggcggcgatgtcaccggggcgacgcggcttgatcgcgtacggaatcggatgaccggcggccttctcgtaagccttgataacctcaagcacggagtagccgtggccagtacccaggttgtagacgaacacgccttccttgtcgatgtggtcaatgacggccacgtggcccttggccaggtcgaccacgtggatgtagtcacgcacaccagtgccgtcgggcgtgtcgtagtcgtcgccgtagacctggacttccttgagctcgccgaccgcgaccttggccacgtacggggtgaggttcgccggaatacccttcgggtcttcgcccagcaggccggactcgtgcgcgccgaccgggttgaagtagcgcagcagcacgatggtccaggacggatcggccacatgcacgtcgcgcagaatctgctcctggaacagcttggaggtgccgtacgggttggtggtgccgccggtcggcgtctcctcggtgatcggcagttccttcggcgtgccgtacacggtggcggaggatgagaagatgatcttcttgacgttgtgcttcttcatcaccttgagcagcacaagcgtggagtacaggttgttgtcgtagtattcgatcggcttggccacggactcgcccacggccttgagaccggcgaagtggatgacccagtcgatgttgttttcagcgaagacgcgttccatgagcgcctcatcgcgcacgtcgccgtcataacgcttgaccggcttgccggtgatttgctcgacgcgctcaagcgccacgggcgacgagttgccgtagttatctacggaaataacgtcgtagcccttgttgagcagttcgatgtcggtgtgagtggcgatgaatccagcaccgcccgtaaccagaacagtagtcatattccctcctttggaaggacttgccttcggtttttccttcagtattgagcttacttcacttgacctgtttcacctagcggcaaaaccaaggctttcgaggaatgtttgcgtggtggctttctgcttgaagacggccgtgttgccgaggatgcggtagcagacgctgccgagctcgtcgtgtacggcttggcggatggcctcgcggtcgtggtttccggccaacgtttcagcgagttcgccccattcgagactgaattcgctgacttcatcgggcaaatcgcggccttcggcgagcgcctcttcgacaatgccgagctggtcgacgagccgtccgggcagaatgaacaagccttgggcctcgatcagtccgatcggctcctgcttgaccggccagtattcggggtgtgcatggaaaataccttccgggtactcgtcgctgatcgcattgttgcggaagatgagactcatctcatagccgcgttcggtgatgatcgcgctgggcgagagggcggattggcggttgccatccgcgtcatggctggcgatgccgttcgccgcgtcgtcataaccgacccatgcctcgcggatgatgtcggatacgtcgatgatgctctggcgactcttcgacaccacgcgcacggcggtgccgggccagtcaaggatttcaaccacggcgtccggatagtcggcaagtgtgaaggcggcccaagtggcggccttgtgcatcggcagcagttcgccgccgccctggtaatggtcatgggcgagcaccgagccgccgatgcgaggcagcgcggcgttgcatccgaggaagtatccggggaaacggtccacgaagtcgagcagatggccgaaggtgtcgcggtccacatgcatcggcgtgtggtcggtgttcacgcagatgccgtgctggtcgaagtagccgtagggcgagaactgccagaaccatgactcgccgccgagcgtgaccggcaaggtgcgcagcgtgcgcttgtcacgtccggcgaagccctcgttctcatggcagatcgtgcacttcgggtagccgccggccacggcgttgccggccgccgccttcttcatgttcttgaattcgggtttggcgaggttgatggtcaccgtcagcccgtgcgagtcgaagcgcgggttccggtcgagctgggcacgcttgacataattgttggccacacagtagtcgtagaaccattgcatggcggccatgccgccatcccggtgctcgacgagcaggaatcggtcgtcgagatcagcggggttggcggagaggatgcccatgatggtgtcggcgtaggccgggccttcctccggcttgaaaaggccggcggttgtggcggcggcgcggaaggcggcgagcaggggtcgggggtcttttcgccatagggggcctggcttcggctgccaacaatgtcttggactacgtctgacactgacgccgccgacgttgtggttttgggtccggggtaggaatctaggcggaagagggcgaagatttggttgcgggtccagtctgcgttgcgtgggtcaaggtcaagatgggccaaggcataatcgatcagggcgtcgatgctggcgtatacctcggtcagctgatcgttcattgctctgcctccatcatgctggttcgggtatggttcggctgacggctcacctggcagcctccatgatgtcggctacgatggcgcgggtttcgctggccttctgctccatctcctgcacgagtttgatctgggtgcgggtgcgcaccagattatgctcggggtacttggtggcaaagtagatatcgccttccaagtagtcggcgagaaagcgcatgccgcattccatggtgagcaggttgccgctgaacggcagcagttcggcctcgcgcgcggtgatgctgccgcgtagttcgcccacgaagccttccgtgtaggcgcggaacagctcggtgctgaaatgcaccttgctgaggtccttttcgtcttccagagcagtggacgcaccaaagcgtatggaatcgccgaagtcgaacagcatggagccgggcatgatggtgtcgagatcgatgatcgcacgcgccttgccggtggtggcgtccatgaggatgttgttgagcttggtgtcattgtgggtcacgcgcagcggaatcgaaccgtccctgagcccatccatcacgacggcatactggtcggcgtgactcagatagaagtcgatttccggctggcatgcggcggcgcggccgagcttgtccgcggcgagggcggccttgaagtcctcgaaacgatgcggggtgtcgtggaagtgggcgatggtttcggtcagctggctggcgtcgaattcggacaggaagttctggaagtcgccgaatgcgctgccggcttcgcggaacacgtccgggttcggcacgaggttgtaggacacggtgtgttcgatgaacttgtagacgcgccatgcgccgccatcgatctcggcccaggtggcgcctgaggtggtgggcacaatgtccagcgtctctttgccctgagccttgagagtggaggtgaccagttcgacattgcgcatcagattcaccgtatcggggaagatgctggtgttcatctgctggaggatgtagcgggggccgtccgtggtcaccagataggtggtgttgatgtggccgtctccgtaaggttcgataccggtcacggcaccttccagcgcaaaatgcgaggcgatgccgaataaatcttcattgctttcagtcatgatgggtccgttctccaaaacgtgggatcaggcttcacgccaggcgataccgctgtcaggcaggtcgaagtcctcggtggtgccgtcggccaaagtcaccgtggtcttctgcggctgatcggtgttgttgattacgcaatacagcccttgctcggggaagtgtgccacttcgcattccggattggacgagctccaggccgcatacttgtcttcgttgtgggaagcgtagaacagcacgcgttccagcagtcgggcgttggccgccgaatagggcaggccggagatgtacacgccgcggcccttgccataatcgttggtcgcgagctgtacctggccgccgtccgcgcgcagcagggtcacgttttcattgaccggatacgtgttgagcacgggttcgccgaaatcgatgccgcccaacggcttgatggactggccgccgccgcagccgctcagcgggatgcggtagccggcctgctcccaagcctcgcgggccgccgggtcgaccggcacatcggcggtgatgaagtggtccggcaccaccggcgggaaatacttgtccaccgaaagggtctgatagcgctcctcgtccacgccaatcacgtcggccagctggaagaaccggcccgtttggaagcgcggtgccgagctcggctcgcccacgcccacgaacgcgccgccgccacgcacccaggcgcgcacggtttccacgagcttcgggttggtccacacatcgccgccggtgaatgcggtgtcgaccgggccgccgttgatgattacgtcgatatcgctatcgatgccatgcgcgagtacgtcgtcgaagctgatgaaccgcacgttcacgcgcatgccggacagggattccagaatgccgtagtaggagtaggtctgcttgttgggcagggcgtgtgccacggtgaacgccatccaggagcgcatcttgccccaggaattcagaatcgccacgttgagctcaccttcggcggccaccccaccggtgcggtcgtggatgtcgcggaattcgttggcgatatgggtcaccgtgtccacgaacttcgggaacttggcggccagggagagatagccgccgtagcccatgcggctgatcggcgagcgcaggatcgcgcggcgggccttgcgccagttgtcgaggccttcgatgctcggatcgttgccctcgtagaacgtgtcggggaagaagtacggcaggaagcggccttcggtgtacttgacgcccggaatatcggcgatcatgcgggtggtggtgccgtcgccgatggaaccgaccacggcgtccaggccgagttcgtcgaatccgtccttgtacggttcggtgccgatccactggtcgccgaggaacatcatcgcctctttgccggcggcgtgggacatgtcggcgagctgcttgacgttttcgcgcacgaagccggagaggaagtcgatccagtcgcgctgggcttttctgggcacgcgccatgcggagttgtaggcaccgccgtccacgaagtcctccgggcgcaggcggtagccatacttggcttcgaaatcatccagcgcacgcgggcttacggtgcaggcgcaaccaaaccagtcgacgaccttttcgcggcgcttttcatcgaacaggagcgtgaactggtagaagaacgtggtgaatcgcaccacatcggtctgcgggctgtccttaagccactgctcgaacgtgtcgaacacgaacttgcgggtggccggatggtagatgtcgaacgggatctcgtgttccttgtcgccccagtcgttggtcagatggttgtacatctcgaccgggtcccagatgatgtaggccaggaaactcaccgtgtactcatgccatgcggcaacgccgctcacatgcacggtgtcctcgtccgcgtcaagcgtccagttcgccgaatcaacgacctcgccggtggtgcggtctacaacctcccaatacttgtgagggtcggcatcacgattcggcttcagctgctcagcgaagaagctttccatcagcggaatatcaaccgtatccgattcggcgagaatgcgatcggtcagcagatacacctgtggcgtctcatccatatgcagcgtaatccactcgttatgcgcgcgagtcgggaaatacgcattgtaaatcttcttgcccaaggcaagcacagcctcatccagatgcgtgccatcggagttacgaatggcgtctgctccccacagttcggcaagctccttggtcttctccgcaaaattctcctcgctaggcaaggtgaagcggccggtgctagtcatagtctctcctttgaggacattgattatttttttggataattaaattgtaaacaatatatgcatataaaacaagaatccgacacaaccgtcgggcgtccaggatcctgactgtataaatccttgagagtagccccacggcaacgccggaagagcgaattgaacatcaccggagcttcccggtcagtttcaccgacaatctcatgacaagaatcaggaaggctctggatcggtatggttgcgtgctacttattgttgagaagccgtccggcgccggaaggagtagcacgaggcaccggacggcgggaattattggtcttaggctgtccgcttaacgcgtcgccttcggcccctgcaattaaggactcgcctacggcgagactcaatgctgccttcgctcggctaccgcctcgctcgggccgacgctacagacagcccaccgggctgtccgcttaacgcgtcagcccttgaccgcaccagcggcgaggccggcctgccagtagcgctggagaccgaggaagagcacgatcacaggcagcacaccgagcagagcacccatcatcagagcgccacgatcagtgaaggtagccagagagaccatgccgtacagacccaaggtcaccggcttcaaggtgtcggaagagaccatcatcaacggcagcaggaagttgttccaagtggccacgaacaggaacaggaagatcgtgaccattgccggagccagaatcctcaacacaatggtgaagaagatgcgagcttcgcttgcaccatcgatacgcgccgcctcaagcagctcgttcggcactgaggtctgcgcgtatacgcggcccaggaagaagccgaacggagagacgcagcacgggatgatgatggagagcatcgtgttggtcaggtgcatggcatggaagatggagtactgcggaatggtcagcagagcggccggcatcagcatgcagcccataatcacgccaatggcaaggttcttacccttgaagttgaactttgcggtagcgtatcccgccatcacagccacgagcgtacccaccagagcggaaacacccgagtagatcagggagttcagcacccagcgccagaactggccacgggtccaaccaatcagcgtgccatagttcttggcgatggcggcaggcaaatcgctcagacccacggcgaaccacagaccgttgctgccggtcatctggctcggcgtcttggtcgaggcgatgatggcccagtaaatcgggaacagaaagtagatcagcgcgaagaccagaacaacgatggtgatggtcttgaccagcgcggaaggctgcatggaacgaggcaggtcgttggcatgcttgtcgcgaatcctgtcagccttcttacgagcgcgtgcgaccgcgcgggattccttatcagtagcttctacggtgctcattctgcgttcaccttcctttcaacgagcgtgtagaccacggcgagtacgccagcgatcagtgccataacgatggccacagcggatgcaggtccgtcaccacccggggtcagcgtgccctgcgaggtattgagggccatcatcattggcgtgtacgacttggaaatgctcggatcggaaatcgacatcacctgcggctcgttgaacagctggatggtgccgacgatggagagcagcatggcaagcagggcggctgcacgcacgttcggcagcttgatcttcatggcgatctggaagccactggcgccatcgatgcgtgcggcctcgtacagatcgtgcggaatggcctgcagtgcggcgaggaagatcagcatgttgtagccggtgaaggtccaggtcgtgatgttggccatagagccgaggaccacattgtcgccgaagaagttcaccttgatgccgatggcggcaagtcccttaacgataggggaaatctggccgttgtagaggtacacccagatgatggatgcgaccacgcccggaatggcgtacggcaggaagtagctcagacggaatgcggtgatgtgcttgacgatataggaatcgatgagcattgccagagcaagtgccgcgatgatcatgaccggcacctgaatcacggtgtagagcactaccctgcccacgccagcccagaagttgccggaagtaataacgtattggaagttctgaagtccgacgaacttatcgaccagttccccgccgccgtatgcgccaccgcccgtggtgacctggcggaagaagctggaataaatagcccaaatgatgggaagaataaataccagagcgaacaggatgccaaacggtgccatgaaggcccagccggtacgattctcacgcttcacagcatcagaagcctttggcttatcggcacgcctggcgacccccgtcttcgccgtttttgttgttgcagtcatagggaaacctgtctttcaaaagaacagtgagaaatagaaagcacgtaatgcagttcgaatcgatgcagtcagatcaaacacaattaatgatgaaccgaactcgagtaaaaggaaaggccggagtgttgagctccggcctttcgatgtgtggttgaggatatcagcggctggaaggaaccctaaccgttaatgtcactcggaaacagacaggccgaagttcttcagcgtatccacagaggtggtctgtgcgtcggagaagatgtctgcaaccttgccggagccatcggtggccttggcggcggtttcgttcatcttggcggcgactgcggagaagccaggcatgtaggtgaagtcacccatgttgttgttagcggtcttgaattccttcatgatgtcctgaccaccgaagaaggtggaccactcggaaggagtctcagcgtcttcagtggtagcagccggcacgaggccctgggaaaccagatcaggaacctgggtgttgaaccaatccaggaactccattgcttccttcgggtgcttggagttcttcagcacggccacggcggaaccaccgtcagggccggtcttgccagcgttgccgaaccagtcaccgagctgagcgacctgccattcgccggagccggtgccaccggaggaggtcatgaacagcggggcttcccaagcggcggccacagtaccgatcaacgagccatccttgatggatgcatcgaaggacggatcccaacgcgggttggtggtggctgccttggcgtcgagcagctgctggtagaagtcagcggttgccttggagccatcggtctcggtgttgacgacccaggagtcgcccttcaccttgtaccaaccaccggaggcgccagccagaccggagatcatgttgccggcctcatcaggctggtaggacatgatgtacttgccagcggcggcagcggtcttggcagcggcgataaactcatcggcggtctgcggaatctcggtgatgccgagcttctcgaactcagccttgttgtagaagtaaaccagcgggccggtgtcctgcggcaggccgtaagccttgccgccaacctgaaccaggctgtacgggccggatgcgaagtcgttcttgtactgctcggcatactgggtcacatcctgcagcagacccttggtgaagacctcaggcagctcggcgtaaccgacctgagccagatccggagcctcgccggacttgacgtcggtctcaagcttcttgatcatgtcagaggccttaccatcgaacttggtggccttgacctgaatatccggatgctgcttattccacttggcaacgatgtcgttgaccagagtcatgccctcggaatccggcagacggtgcatgtaggtgatgttgaccacgccaccatcatcggtggtcttcgtgtcgccggcagtgtcgctgccgcaaccggccaagcccattcccattgctgctaccgcggcaaaagcagccacgatgcgcttattgcgagataccatatctctactccttcgtagtgaaatcatcatctcagtgtgatgactgattactaatgtatgccctcattcttttattgtcaacttagctaacaattaccgcgcgtcccgttgaggcgagtagcattaaaccggttcgatgctcgattgtgcgagtttgttcatttcattaactccccttacaaagcaacgtacttttggtccaccggtaggcctaatgagatattggatagcggcaacaatccaagacgttagcttgcaatcgtccaccgcaaattgcaagcacttgccaacattatcggttttcaggtcgccggcgcgatacccgaccagggggcaccgcaccttaatgagacgctacacgagcagtctcagcaactggtagagctgccacaggctacgcacgttgaagtgcgtgccgtcaaccgtggcgttcgcctcgccatcgcccatatggacgatcacggtgcgcccgttcacggtcagactaccgtgcatcgtgatatgattcatcttgcaaccttgttgattaaaggcgcaagccggtaatcaacgcaaaggcccgatgctgcaaacgtcgggccttttcttatcggctcacgccgatcggcccgtcatatcaacggggacaccgcatgttacggcatcacaaaccaatatatcagcaccccggcggcaatcaagaagacaggttccagaaaaagaaaaaaagggcctgggcatgttgcccaggcctcggttcgcggacagggcgagattcgaactcgcggagggttgcccctcaacggttttcaagaccgtctctttaggccgctcagacacctgtcctgatgcgcgttcacacgcgcaagtattcattatacagaagggagggatgttgatattcggcagtgcggtcggtcttggattcgcctgctggctatcagcgatctctccctcagtaatctctccctcagtcagctacgctgacagctccctcatcagagggagctaaagcacgatgagactcaggcctcccacttcgtgggctcgataacttccttgccgcccatgtaggcgcgcatggccttcgggatctcgatggagccgtccttctgctggtggttctccatgatagcgaccagccaacgggtggtggccaacgtgccgttcagggtggagaccgggcgggtgccgccgtcttccatacgctcgcggatgttcaggcggcgagcctggtactcggtgcagttcgaggtggaggtgagctcgcggtaacggccctgggtcggcacccaagcctcgcagtcgaacttacgggcggcggaggaaccgaggtcgccggcggcggtatcgatgatgcggtagggcacctcgaccttggcgagcatctcctgttccatggccagcaggtgctcgtgctccttgtaggagtcctcctgcttggcgtaaacgaacatctccaccttgtcgaactggtggacgcggatgatgccggaagtatccttgcctgcggcaccggcctcgcggcggtagcaggaggaccaaccgcagtagcgcagcgggccgttgccgaggtcgaggatctcgttctcgtgcatgccggcgagcgccacttcggaagtgccgaccaggtactggtcatcgggctcgcgcagacggtagatctcgtcggcgtgggagttcaggaagccggtgccgcgcatgacctcggggcgcacgagcgtcggggtgatggccagcgtgaagccgtgctcttcggcctggtccacggccatggtgagcatggcaatctgcatgcgggccacctggccacgcaggaaatagaagcgggagccgccgaccttgacgccgcggcgcatatcgatgccggccacgccggtgccgagggtcaggtggtccttgggctcgaagccttcggccgcgaagtcgcgaatctggccaaccttcttgacgaccacgtagtcatcctcgccgccttcgggagcttcgggctccacgatgttggagagcttccacatggcggtggtgtattcctcggctgcggaatcggccttggacttgtattcggagaccttctgggacagttccttggtttcggcgatgagcttggccttctcgtccgccggggcggaggcgaccttcttgccgatttccttctgctgggcgcgagcctcttcgaaggccttcagcgcctcacgacgtgcggtgtcggaggagagcacttcgtcgacgagctccacggactcgccgcgcttgcgctgggattccttgacgatatcggtgtgttcacggatgaattgaatatcaagcatgggcaccagactagccgcgtaagcagacaccgacaatggccgaatgcgcgggagtcacgcggaaatcacagggaagcccgggaaagtccgcggacgggtccacccggccaatttcgtcagatgagacgcgattgaaccataatcacgccccacggggctgttgcgtgcaggaaatgttcacgtacggcgcaccatggccgcaaacgacctccccaccgataacaataggagccatgcctcagcctgccctcaccgtgtttctgatcatcgccgcaatcgccattgtggtggtgctcatcgccgtcatcgtcatcgctctgcgcgcgcagcgccgccgcaagctggctcagacgctggagaagcgccgggacgacgaggtgcagtacgccttcatcgtgaatccgtccaaaccgcaggccgaagcccgcaggctgcatatccagaggttctgcgaggccaaggggctcaatcgcatccgcttctacgacacccagcttgacaaggacggcagggtctgcgcgcttgaggcgctggaggacggcgccgacgtggtgatcgcggtcggcggcgacggcacagtgcgcacggtggcgagcgccgtctccggcaccggccatgcgctgggcatcatccccatcggcaccggcaacctgtttgcccgcaatatgggcgttcccgtggacgatatcgacgccgcgctgaccgtggccacctcccacggctcccgcctggtggacatgggccgtctcaccctgctcgaccacccggaggacgaccacggccacgccttcctcatcatcgccggcatcggcttcgatgcggccatgatcgacgacaccaaccccgagctcaaggcgaacatcagctggctcgcctacttcgtgggcggcgtgaagaacctgttcgcgccgaagttccgcggcacgctgacagtcaccagcgccgacggctcgacccacaccatcaagaatctcgatttccgcacggtgatggccggcaactgcggccagattcccatgttctcgctgatgccggcggcatcctatgacgatggtctgctggacttcgaaatcatcgacaccaccggcggcatcctcggctgggccaacctgttcggcgacgtggtgcaccagacgatcatcggcaagcccgaacagaacccgctgtccacgaactcgaccatcgaacaggttcagggcgtcagtgccgaaatcacattggaaaagccggccaaagcgcaggtggacggcgacatgctaccggagaccaaacatattcgtttctcagtggatcatcgcgcgctgatcgtgcgcgtacccgacgcctccgcgctggaaaagaccgcacaggccgctgcctcaaacgccacctcggatttcgccgaaatgaccggcacgctcgagccgattcgctgatccgctacgatgcgtggccggtgactcgggcgacgtgcattgccagataggcggtttcgtcgtcgctgatatccgtgtcgaggcgcagttcgagcagggaggcgatggttcgcgcgcatcgtagcgcggcgggataggactcacgaatcaccttcatcaccggtgccggctcatccgtcagttgctggtgctggtggatgcgtacgaacaggtaacgcagatgggtgatgaacctgcccacattcacggaactgcggtccaacgtgatgccgtagctgtggtcgataatgtcaagcagttgctggatcacgcccgtcatcgtatacgtataggacaggtcgccggtggcgaagccggcgttgaccagatgcatggcaagcgcggtggcctcgccgtccggcagcgtgacgtcgagccgcgcattgagcgatgcgagcatcgcacgcccctgcgcgtattcctgcgggtacaggttgctcacctcgccgagcagcgggtaggtaatgtcgatgccgcgccgcacccgctccaccgcattcgccacgtgatccgacaaggccatgaccagcgtggtgctgccggtctcacgctcccccagtccggcttcctgcatggattcgacgaccacgcggatgatttcgggcggaatgtccgccagcatctgcgccagatggtccgggtcacgcccgtccgacggcacgaaggtgcgcacgactttcgactcgtcgaccgtctgccccggcttggcctggaaccccagtccacggccggtgagaatcacctcaccgccgtcgccgcctttggcgagcacgacgttgttgttgaacactcgcagtatttccatggcatcctttcgcaacgtcattgttccacatcgatgatcgggctgccggctgatacggttttgcagtcaccgccgttgttgtcgccgctaccgtcgccgatcaacggcgtgaccacggtcagttcagcggcgttgaccaccgtcaccaccaccacaacgctgtgcccggccgccgcgactttgccgaaatccacggtggccagtggctctcccgccgcgatccgctcgcctttagccacgaccacagcgaatccctcgccatccatatcgacggtgtcaatgccgatatgaaccagcacctcgatgccgccatcggttttaatgccgaaggcatggccggttcgggccacggttttcagcatgccactgaccggtgcgagcacggctgtctcaccggtcgtctccggcacgacgcctacaccctcccccagcgcgcgggaggcgaacaccggatcgccagtcgcttccagattcatcaaccggccggcgaccggcgacaggatggcgttggagtcaggagtccgatcggaggcaggccgcgatggggaatcttccgcagactccgcatccgacgatgtcgcgccaatccctctcaccgcatcctgcgagcgtacgttctcgcccgccgagaccatctgcgcctccgtggcgcgcggcggcgtacggtacccgaacagcaccgtcagcaccatcgccattacaaacgcaacggcgatggacagcgcgtacacccacattctgtcaaacaccggaatcgtcagcaacgaggagaaggcgaacgccgtagtcgtgacgccccggaccatctgaccggatggcagcacggacgggaacagccagccaagcaccgcgctggtcacgccgccggccgcgcagccggcgagcagccagcggtagacgcggcggtgatgcagatggatgccgtacaggctcagttccgaaacgccacccagcaatcccgcgagcaacgcccccaccgcggtctgccgcatggccgaatccttgccgcgtacggccagcacgagcacgccagcggtggcaccgaagcaggcaaagttccatacacccatcggaccttggacgaaatcgtagccgagcgcctgaatgttcatcagcatcagggcattcaacggccagtgcagaccgagcggcacgagaaacgggtagagcatcgggatgatgagcgcgaataggaacggcacgtgcgcgttaagccatgctgtggccgctcccagcccaccgccgagccatattcccagaggcccgataaccagtatggtgagcgcaaaaacgacgaccagtgagaggaatggcacgaacaccagctgtacgctgtcgggaatgacgcgcttcaacccgtggtagaccacggcgagcacggcagccatgagcaacggcacgaagacgttgccgccgtagtcgttgagttgaatcggtatgccgaacgccgacacggtgcaggtttcggtgccgaatacggcgttggccgagcattgaatcgccccggagagggcgctggatacggacgtcccggacattccggacatcacgccagtaaactgcggggtcatcagcgcggccataatcgcgccgccgagccaggggtcgacgtccagtttcttggccgcattgtaggcgatcataatcggcagaacggtgaacacaccctcccaaatcgccttgagtagtatccaaccggtggacgtctcgccatcaggcacaatgccgagtgcaacgatcacgttgacgatggcgatgaccagcgaggcaccgagtagcacgcccagaatcgggcggaacgagtcggacaggtagtcgaaaaacgcggcagcccgggcacgggcggcactgccccactcgcggatggtacgaggcatgaagtgacgggatgtattggctgggccgtgactctgctcggtgtcggtatcgcgcaatggtgcgacgtcgtcggaaaggttcggcgcggactgcgtaggctgcgtaggctgagtggattgcgttgactgagtggattgcgttgactgagtggattgcgttgactgagtggattgcgttgactgagtggattgcgttgactgagtggattgcgttgactgagtggattgcgcggactgcgttggccgcgacgccgccgatggtaattgcgttgccggagtcaatcgcgctgcctgcatccgaacgatctgctcgtacaccgaggcgaccgctccgccgatgatgacctgataacgattgccggttcgcgggaatgcgccgaggactccggggatggattcgagaccgtgctggctgacctggccggcgtcgtccagttcgaagtgcagtcgcgtggcgcaatgggtcaggttggtgatgttcgcggagccgccgacggcatcaacgatgcacgccgcaatcactgcaggcgttgcgttcgatgcgttcgccacggttcctccttgctgccgtatgccactgtgttccattatcggcgctgggtgccccaaaagcacggcaatgccggcaaagcatcgcgaaacggcaactatgcgctacggtgctccgcgatagcgttccgctatggtgttccgccgcacccgttctccgtatttgccgcagcgcccattccgacttcattccaccatgcagaatcctgcaatcgttgtcaaaaatcatcgttttttgccgcctattcggagtgtcgcgaccgagaaagtcgtatcctatctttcacacacgttgcgtagcagggttgttactcaaaatgaggcaagacctggagtgacgtggaatttgcgtatcgtaatatgcgaattccacgttgttccaggtctttttttgttttcgggcgacttcaggcaatcgaagcctgaccttgcatgcggcagaggggccacgcggcaggcgcggcccgtcaacggcgaaaggacaaggcaatgacgacgacaacggcatcacccgtatcgaagcagacggcatccgcggcacaggagaccggcgcaaccggtgcagcggccaccgcaatcgaaaccatcgaaaccggcgtggccggggtggcggacgcggccacaaacgcggcagcaaacgcaatcgaggacctcgaagccgccgaatcacgcggcttctccacgcgcttcccgctcaacagcgcattcatcttcaccttcggcgcgctcggcggcatgctgttcggtttcgacaccggcatcatctccggcgcctccccgcttatcgaatcagacttcggcctgagcgtctcccagaccggcttcatcacctcctcggtgctgatcggctcgtgcgcaggtgcgttgtcgatcggcgcactgtctgaccggttcggccgcaagaagctgctcatcgtctccgcgctgctgttcctgctcggctcaggcctgtgcgcctcctccaccggattcgcgatgatggtgtgcgcccgcatcatcctgggcctcgccgtcggcgcggcctccgccctgaccccggcgtacttggccgaactggcgccgaaggagcgtcgcggctcactgtccacgctcttccagctcatggtcaccttcggcattctgctggcctacgcctccaacctcggattcctgaaccacaacctcttcggcatccgcgactggcgctggatgctcggttcggcgctggtgccggccgccttgttgctgctcggcggcctgctgctgcccgaatccccgcgttatctggtgaacaagggcgacacccgcaacgccttcaaagtgcttacgctgattcgcaaggacgtggatcagacccaggtgcagattgagctggacgaaatcaaggccgtggccgcacaggacaccaagggtggcgtgcgcgaactgttccgtatcgctcgtccagcgctggtggccgccattggcatcatgctgttccagcagctcgtgggcatcaactcggtgatctacttcctgccgcaggtgttcatcaaaggcttcggcttccctgaaggcgacgcaatctgggtgtcggtgggcatcggcgtggtgaacttcgtgagcaccatcgtggccacgcttatcatggatcgtttcccgcgcaagggcgtgctgatcttcggttccatcgtgatgaccgtttcgctcgcagtgctcgccgtgatgaacttcgtgggcgacgtggccgtgctggccgtgccgacgatgattctcatcgctttctatatcctcggctttgcggtctcgtggggcccgatcgcctgggtgcttatcggcgagatcttcccgctgagcgtgcgcggcatcggctcctccttcggctcggcggcgaactggctgggcaacttcatcgtctcccagttcttcctcgtgctgctcgatgcgttcggcaacaatgtgggcggcccgttcgcgattttcggcgtgttttcggccctgtccatcccgttcgtgatgcgcttggtgcccgagaccaacggcaagtcgctggaggaaatcgaggaggaaatgaccaagcgctagacaaccggcacacgattcgcacaaaagttgacaactcttaacataatcgtacccaacgtggcgaaaaaacgtggcagaatagggagcatggtagcaaacaatgcgggtcagcccgccaccccagcagatctgatcaatgtcgatgaggttatcggcaaatactatgacctcgtccccgatcccgaagtccccgagcagcgtgtcatcttcggcacctccggccaccgcggatcgtccctgaagacctcgttcaacgaggcccacatcatcgccatctcccaggccatcgccgaataccgcaagaaggccggcgtcaccggcccgctgtacctcggctccgacacccacgcgctgtccggcccggccaagaagaccgccatcgaggtgctcgtcgccaacggcgtgcacgtgcgcgtcgattcccgtgacgacttcgtgcccaccccggtggtctcccaggccatcctgacccacaaccgtgcggccgacggcacccagcgcttcgagggcgagggcctcgccgacggcatcgtcgtcacgccgtcccacaacccgcccaccgacggtggcttcaagtacgaccccgtcaccggcggcccggctccggccgagaccaccaatgccatcgccgctcgcgccaacgagctgctcggcgacttcaagtccatcaagcgtgtgccctacgaggaggccatcaagtccgagtacgtcgagggcttcgacttccgcgagcactacgtggacgacctggagaacgtcatcgacttcgacgtgatccgcaactccggcgtgcgtctgggcatcgatccgctcggcggcgcttccgtgaactactggccgctcatcaacgagaagtacggcctgaacatcggcgtggtgcgtcctgaggtcgacccgacctggcgcttcatgaccatcgaccacgacggcaagatccgcatggacccgtcttccccgtacgccatgaagggcctggtcgacgagctcaacgccggcgcttgggacaagtacgatctggtcggcggcaccgacccggacgccgaccgtcacggcatcgtctgcccgaactggggcgtgatgaacccgaaccactacatcgccgtgtgcgtggagtacctgttcggcggcaaccgtccgggctggcctgagggcgcagccgtgggcaagacgctggtctcctcttccctgatcgaccgcgtggccgcatcgatcaacgcgaaggtcatcgaagtgccggtgggcttcaagtggttcgtggacccgctgttcagcggcgaagtcgccttcggcggcgaggagagctccggcatgagcttcctgcgcaaggacggccgcgtgtggaccaccgataaggatggtctgatccccgacctgctggccgccgagatcaccgccaagaccggcaagaacccggcccagcttcaccaggagcaggtcgagcgcttcggcgagtcttggtacaagcgcgtcgacaccccgaccacgctggagcagaaggccaagttcgccaagctgaccggtgatgatgtggccgccacgcagctggctggcgaagacatcaccgccaagctgaccgaggcaccgggcaaccacgccaagatcggcggtctgaaggtcaccaccaaggacaactggttcgccgcccgcccctccggcaccgagaacatctacaaggtgtacgccgagtctttcgtctcccccgaggctctggacaaggtgctcgacgaggccaccgtcgtggtagacaaggccctgagcgagtgaaatcgctgcgttagtcgcgttcaccgcaactaataaggctctgcattggattcatacaatccactgcagagcttttttagcgcatatgcagttcgcgaccactgaaacacgcaggtcaacggttctcctcatgcaccgtgactgcattttctcaacatcactgcagggcaggacggccagatgaccgcgaaacgttcgcctgcctaccatcatcattgtggggtcacagcggccagatgaccgccgaagcgttcggtcggcttgcatcatggtcgagttttaacatcgttgtgggacgccacgacgaatttgcccattccagagttgccatcccacaaaagcgtgggacaacagctaagtcaatcgttttacattttcccccatcccacacactcaaactggaaaccccggaaagacgccattcctgccacacccgtcacagccattacccgaggggccgtgggacgccacgcaaaaatcggcaaaacacgcgtagcgtcccacacccattggcgcaaatccacgcccaatgcaccgcccccccccaatcgaccactatgacacaggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgcctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaacctcaggtgttgcaaccaccactagaatctgccacatttccctccacaatcgaacactagtcattcacgaaatccatcactacgaggcatcgcaatcgaacggcatgcaatatcaagcacacaccacaacaacaggtcgtacaaatattgcctttacatcagtccatttcggacattatggtcacagcaggctctgcgacaactcttcaagagacatggcaactacatgaaactcgaatacggcaccgcgcgaagcaagcgccctcgccacgttgaaagcgaattcagcacgagcgtcctcgttagcgatacttgccgccgtggcgacgaagaccagccatctccgcccgaccagcacaccccttttctcttggtcacggcgccattgagccttactcgtacgatgatgatggccatcatattcaacagcgaccttgaactctggccacgctaagtccaacgttatgggagctccagatgcaaaagccgcatccggcaccacatagttcgcaaccggctgtggaatcccatgcgctaccagagagagtcgttcttctgattctttgggcgaatcagcaccaggtgatatcagcggcaatgctcgaacgcaggacgggcgccctctgaatcgggtaaatcgctccacgaacttcaccagatcctgatagattgcagcagcatcacgatccttggccaatactggctgtttgctcgtagcagcgatgacggcatccccgagcacaatcagggactcaaaagaaacatacggggcaagttgggcccatacgtgaaacaggtccagcgcaaacacgtgttggttcatttccacattggcggctttagccgcatgtttccaaatatgcgtttgcagtggtgcatggcgtgtacgaaaccgcttgctcttaacgctggatacagtgtgcagcttggccgagtcgaggtcgcaatcggcgggaatcggtacggattgcagagcgagggaagtggtcatgccgaaaagcagcttcttgcccgcccgtttcgcttcctcagtgcagcgtgcgaccatgtcgcgtctgcgctgggcgaggctttcgctcatggtcggtgtcgctgcagaatcatgtgcaccactgttcggcgatgacgagtcgcgagaagtcgggtatttcgagtcagtagaaaatgaccccgcaaattcaggcggaacaaaaaccgcctccgattcttccggaggctgatcgtatatagagcctggcagagctccatagttggtgatgccgtcggtcatcctgttcatgacaccaccatatgggtagtgggtgcggaaacggaagccgatccgaggtatgtggtcctagcttcacttacgcacattcattgtggataaccatgtggacacctcacttatacacatagtcatccacctcttcaaccccgatttgacacactaactgtatctgatatgattacagtatcataactgtacacatcatagttacagtatcgactcggtaaggaggtcgtttcatgaacggcgaccattcactggcagtgcacgcattggtctaccttgaccatcgcgccacacacctgcccagtcagatcctggccgagaacatatgtaccaatgcggcgcgcgtgcgcaaagtaatgcgaccgctcgcctcagccggactcatcgccactaaagagggtgctgaaggcgggtacgctctggcccggcccgccgccgaaatcactttgcgcgcggtagcggaagccaccggcaccacttttgtgaaagtgaactggacaccgggcgacgtacacgaggactgtctggtgtcatcttcaatgggcgcagtgatgaacgacatctatgccgggctcaaccgcacttgcctcgaacaactcgaacacaccaccatccacgacatcaccgaacagatattcagcgagcgcaaaggctaataatcccgcgcgtttcccctagccagcatcagtcgataacgcttcggcagtcaaagaagaaaacagacgccgcacggcacacaacacatcagcacaacgcactcttatcactcgaatacgtaaggaagtaaccatgtccatcagcacacccaatgccatcagcacacccagcacctcccccactatcaccaccgacgccctgatcattggattcggcaagggcggcaaaaccttggctgccaagctcagtgcagccggccgcaaggtcgtcgtcgccgaggcaagcgccgacatgtacggcggcacctgcatcaatatcggatgcttgccgtccaagtcactgattttgtccgccgaacaggcgcggcgggatggcgcgaacagtactcccgaaacccgcgaagcagcgttcgaggctgctatcaaggagaagcgccgcgtcacttcgatgctgcgcgacaagaactatcacaagctcgccgaccaagacaacatcaccgtaatcaccggccgcgctcacttcaccggccctcatagcgtggaaatcgccaccgctgagggcccggtcgccgtgaccgccagcaagatcttcatcaataccggtgccacgccgcgcattccggatattcccggtatccacactacgcccggcgtctacaccagcactggactgatggatctcgacgatatgccgcagcgactggtgattatcggttcaggattcattggacttgagtttgcctcgatgtttgccgatttcggcacggcggttaccgtgctgcagcacaatgccgagttcctgccgcgcgaggatgcggatgtggcggccgcgattcgcgcacagttggaagcgcagggcgtcaagttcctgttcaacgcggataccaaggccatcgcgcctgctgctgacggcggcgtcaggttgtccgttgcggtgaagggtatgactcgcggcgcatcgcaagcttgcgattccacccccgccggcaccgggaacgctcataccgatatcaccggcgccaccgacactacaacaaccaccagccccactagcaacccgaccgatcacgccacgatgtcacacgttcaaacgaaaccatcagacgatggcgagccgcggttcgccgagccggctgaagcccgattctgcctgaccaccgacgcggtactggtggccaccggacgtacgccgaacgtcgagggactgcatcttgaggcagctggcgtggagctcaccgaacgcggtgccgtgaaagtcgacgagcttctgcgcaccacagcagccgacatttgggctctgggcgatgtgaacggcggcccgcagcacacgtacatttcgctggatgactatcgcgtggtgtggtcgcagctcaatggttccgaccgtccgtacacggtgaaggaccgcaagcatgtgccgtcgagcacattcctcgccacgccttactcgcgcgtgggattgaatgagcgcgaggcgaaggcggctggattggattatgtggtcaagcgattgccggtggccgctgtgccgaaggcccaggtaatgcggcgaccggatggtctgatgaaggcgattgtggaacgcaatactggccgcattctgggtgcgatgctgctttccgtcgagtcgcacgaggtgatcaatatcgtcaagttggcgatggatcttgacgcgccggccagcacgttgcgcgatatggtgttcacgcatccgacgattgccgaggcactgaacgacttgttcgcgtagtttgttcgcatagcacgcccgcgcagcatgacccgcgtagcgcagcccgcaacagactcccctaatgcgcgcgaaggtcctcatcgacgtaaaccgatgaggaccttcgcgctgtcgtcatgatccgtacgtgacagcaatcacgtccgaaccagccgttacttcaagccgagcttacggtccagaatgtcggaggcatccaatcctaagcggcgtcggatgaaccagccaagaccgagcggcaggccgggagccaaggccatgccgcctggaccgagtgccacggttttggagttgcctgcgataagcatggtgcccttggatgcggccgtggaggtcgaaccatcgctgtccgcctctggtttgaggatttcgatgttgccgtcactggttttgtacagtcccttattctcattccagataccggatgcgccattgttgccggcctcacccgcagagaggaaatgtcttgtttttcttgtgagcgctcacctattcacgcgcgatggcatgtttttcaagcaaagtcaataggtgtgatgttattcacactcttcactacgttgttttgcctcgcactgggcaaccccacttcagcaagagattgcacagcttgcgttagggtggagaacatgactatcacagtatccacagatgggtccgcattagggaatccaaacgggccaatgggctgggcctgggccgatcatgagcagaacgccggcggcaagcccggccataagcacgacgaccatggttatgatgcgggcggcgcgaccaacggcaccaatcagattggtgagctgtgcgcagtgctggaagctttgcgagcgcacccgggccctgagccattgctcatcgaatcggattcgcagtacgccatcaattgctcgaccaagtgggtcaaaggctggaagaagaacggctggaaaaattcgcagaaaaagcctgtgaagaacaaagagcttattcaggcgatcgaccgtgagatctcacaacgccctggcccggtggatttccgatgggtcaaaggtcacgccggcaacgagggcaatgagttggtcgatgaactggcacgcacctatgcgggcgattgccgttcgggtgcgcgcgacggctatctaccgattgaaggctggcagtcgctgctgggctccgaatacgcacatggcaccgatgtgcctccagacgtgcaattggtattggacggcaaagcggatgcggcaagtttgcgcaagccggctgcggcgacggatcagacggatgccgcaaggccggagaccaagtcttcgtcacccttagcggcacaatcaacgcaacctgtacaatcaacgcaacctgtacaatcaacgcaacctgtacaatcaacgcaacctgtacccccgcaaagcccagcgggctgacggtatccggtacgctgaccttctcccccgcgccgaaaacgagcccgtatttcaacgggcagccgatgccgatcaaaggcagcatcgaaatcgaaggctatgtggacggcgacggcaacctgaccatcaccaacgcaccattcgtacgacactgacacccaaacacacgaatatgtaccgcaatcggacacgatgacacaaaatcgctcattcgcgttaggataggagataaggcttcacgccgttgatccatgcggcggaggcaaggatggcaaaggagaaaccatggataaggcacagcaggatgcgctgaagaaggcggccggcatcgaagccgccaagctcgttgaaaacggcatgatcgcaggcctcggcactggttcgaccgtgaagttcctggtggacgagctcggccgccgtcatcaggaggaaggtcttgagttcactggcgtgaccacgtctcgccgcacgcaggcccaggccgagagctacggcatcaagatcgtggacatcgacgacgtggaccacatcgacgtgaccattgacggcgccgacgaagtcgacaagaacttcaacggcatcaagggcggcggcgctgctctgctgtgggagaagatcgtggccaccaactccaaccagatcgtgtggatcgtggacgagtccaaggttgtggacaccatcggcaagttcccgctgccggtcgaggtcattccgttcggtgccggccaagtcatcaagaagttcgaggcccgcggctacaagccggtgcttcgtcttgacgccgacggcaaggaagtgcgcaccgacgagaacaacttcgtggtggacctgcacctggagcgcatcgatcacccgcaggagctggccgaagacctcatcaacacggtcggcgtggtggagcacggcctgttcctcaacatggtcgacaaggtcatcgtcggcgacccgaacggcccgcgcgtgatgaccaacgccaacaagtgatcgtctcacaccactaagcttttccaagcccgcatctgcacatcgcaggtgcgggctttactgttgcccgaacaaggcaaagagccaagcaaaagagaaaccccgcgaccataacgatcacggggtttctaatgccttgattgcaggtaagactacttacgctggtggcgggtcttacgcagcagtttgcggtgcttcttcttgctcatccgcttgcggcgcttcttgatgacagaacccatctgaagcctccatttcgattaatcgtaaaagttgcaactcgcaccataatacacgtgttgccagacagaggaaaccagtatgttgtcgatagtccgcatatgccctgaacgcagttggggcatccacatcagcaatgtggatgccccaacgttcataagtttgtgcagcagctgacagccgatactagatactacatcgggaacttctggtagaagcgatcgaccgcttccttggtgccggtagcttggaagaccacggtatcgttctgccagatggcaacggcgttcttgctgttggaggcatcggccttcaccacgtacgcgcccgtgacgttgccggaaaccttgacgttgccggatgccgactcatcgccggtctgcgcagcgaccaacgcatcgtactgggtcttggcattgtccgccgacgaccactgcgcggcgaccagcgtgacatccttggcggcatcaccagtggagtaggtcagagtgtactcctcgagcggcgacgcggaattccacgtcgtggaggcatccgccttggtacgcgcgtaattcagcacgctgcccggcatggccttcaacagctcactggcatcatccggcaaagctgtggcgtcgatggtcggcttggtcggctcggatgattcggttttctgctggctgttttgggtggtagtggaggtgccatcattcttctggatggcccaacccggccacacaaaggccgaaagcactgccaggataatcacaacagctgcggcaaccaccactgcaatcaacttgccatgggattgcgtggtcgaggagttctcactattagtcatgccccgattctctcacagccgcgtgacgctaggcggccgtaattttagtcgttgtgcgcaagccgcgtgaaactcttgtgaacggtaaaaatttaccgtccgctggtgtttgggttagggtgagaccatggcgaaatcaagtgtgcagtatgtatgttccgaatgcggttggaacgggccgaagtggtacggccgttgccccgagtgtggtcagtggggcacggtcgaggaatttcacgaggctcggccggcggcaggctctcgcacggccgctcccggccgaacatcacgcacgcagtcggttacggttgccaacaacgccagatctgcagcccgtccgattaccgaagtgggcacggaaagcgtcgagcggctcggtaccgggttttccgaattcgaccgtgtgctcggcggtggcgtggtgccgggttcagtaacgctgatagcgggcgaaccgggtatcggcaagtcgacattgctgttgcagacggccggcaatatcgcgcgcgttgtggcgggagacagtacgttccgaggggcaggtcagcggtctgcccaacagtcgggccgggcgcagggcaacgcatcgaacacggtgccgatgcggggcaacgcatcatcaacacacgccaacaccgtgctgtacatttccggcgaggaatcacaggcgcaggttcgtttgcgcgcttcccgcatcaatgcggtggagccgaacttgttactggcctccaccaccgacctgtccacagtattggggctgatcgaacagaacaagccggccttggccattgtggattcggcgcagaccatcgtctcgcaggaggtcgatggcatttccggcggttcgactcaggtgcgcgaagtggcaagcgcgctgatagataccgctaagacacttgacattccagtatttctggttggtcatgtgaccaaggatggttcgattgcaggcccgcgcacattggagcatctggtcgatgtggtctgccaattcgaaggcgacagcgagactgcgctgagaatgctgcgagcggtgaagaatcgttttggcccgaccgatgaagtcggctgtttcgacatgagcggtgaaggcatcgaagaggtcaccgatcccgccggattgttcctgtctggagacggccctgatgcggccaacgcggcacccgtggaaggcacctgcgtgacgttcacattggatgggcatcgcagtctgcctatcgaagtacaggctctggtcaccacgtcggtgctgcccacaccccgtcgtgcggtcaatggcgtggaccccagccgtatcgccatgctggtcgcggtgctctaccgtcacagcaagctcaacctgctgtccaacgacctgtatatctccactattgccgggggccaggccaaggagcccggttccgacttggcgatagtggcggcactggcgagcgccgccacgtcaaaacccattgcgcgagccacgtgcgccattggtgagatttccctgaccggtcaggtgcgcccggtaccgcgtatggaatatcgccttcgcgaggccgcacgcctcggcttcaccacggcggtcattccgccactgcgcaagccggtgcatgtcgagggacttcagctggtggagtccaacacattgtccgacgcattagacgccttgggagtgcgtaaatagccctgagatatgcctcaggcggtaagacgcttggtctcctcgacgttgcgcttgagttcgtcgacgagttggtcggggccatcaaacttgacctgcgggcgcaggaagccgacgaattcgacgcgaaccttgtggtcgtacaggtcgatccattcttcagtgatgcagtaggcctccaccacacgttcgttgagccctgttttctcgctgaaggtgggtttggtgccaatggagatggcggcgggccaacggttttcaccatctaccagccaaccggcatagacgccgtcgaccggaatgtagcctgcaatgtcggagccaagattggcggtggggaatccgatggtgcggccacgctcctcaccgtgcaccacttcgccctcgatggagtgcggagcacccagaatggcgttggcgtcctggattcggccatgagccagcaggtagcgcacattggtggagctccatgcgcgcattgccttggcctggttcttcttgctccatgcgcggcgctcggccttggtggcattggccagcgggtcgacgggctctccccattcgctcggggcttccggcttgaaatcgcgcggaatacgcacttcacccgggccacggtcatcgaccacatcaagttcgaatacaccggtggcggcggcaagattggcgatatgcttcacatcaccttctcgacccttgcccatggcggcatcctgcccaaggaccaacgtgcgcatacccagcttgccggtgagtcggccaaggaagaaaatgtatgacatagctgcgaaggccagcgtgtagtgcaccaccagcacgtggtccacgccgaactgttccatgcggtgcagtcgatcatccacactggtcaaggcttcggcatccacgttctgcaccgcgggttcttcgccatggtgcgagatgacccagccgtgcacgaatgcggggcgcggatcaaacagaatcaccacggaaaaagcatcatgctggtgcgcgagttccaccacacgcttgatcaccgcctgatgacccaagtgcatgccatcaaatgcgcccaatgtcaccacggccttcttatcgttactgaacgagggccattcaatcgaaccttcggcgtcaggggtcaggtgcgtgatatccatcagtgtgctgttccttttatccgtgcgatgttattcatgcaatatagacgttgttgtgcgcggcctgtatcaagctgcacttttcaccgcgtctactttacgcgagggggaatacggtgaccggcttggcctgatgagcgtttgcacgctcgataatcgccgccacatcatgcgtttgcggcacaatggcggcagtgggctcgctgattgtacgctcaatacggcggccgaagcgtaattcgctggcctcctcaggagtgatgtcaagcgccggcatcgcacctcgagcggcctgttccatggtaagggcatggtcaagcagccagttgcggcgctcgtcaccggcaagaccttcaggagtgtccaatacgcacttgttgcgcgtgacggtttgcccttcccgattagtgaacgtcttctgatcggtatgtgcggtgacggtatgggttcgcgtgtcaagcatcgcctcaggagcgataagtccgctggcatcgtccggcaacgcgaatcggccgactcgcgtacggcgcaaacgggtcaggtatccgccgacgccaagttctttgccgagatcgcgggcgagcgcgcggatataggtgcccgatgaacagctgatccgcacgtcaacatcaagtgcgggaatcgctcccgtgttcgcgtcttcccgcaatggttcagcggcctgctcccctgctacgaatccgctgcggatatccagcacggtgaattcgctgatggtgaccgggcggggtttgagttccacatccttgccttcgcgagccaagtcgtaggcacgctggccgttgattttgatggcggagaacgtattggggacttgttcgatatcgccggtgaaattggtggcgatggtgcgtgtgagcaggtcttgccatgaggcagttggtaacgccgttggttcgccgctctggccaccctcagtcagctgcgctgatagcgtttgccagcgggagcgggcttcgtcatcgacaagcacctcgccttcggcatcgtcggtagtggtgcgcaggccgaggcgtatggtagcctcgtaggttttgtcatgcgccacgatggcgttgagcagtcgtgtggcgtggccgaaggcgatgaccagcgtgccagtggccatggggtcaagggtgccggcgtgaccgaccttcttgatgtgcaacgcgccgcgcacggcggcgacggcgtcgaaactggtcacgccttgcggcttgtcgatgatgagcagaccgctgggggttgtatgaagcacactactcctcgtcagagtcgtcttcgaagtcgtcgctgggctcgtcgtcatgcttgtacggatcggcgtcgccggcgtactgggcggtggcgcgagcacgggcgagttcttcgtcacgcttcttggccacggcgagaatgtcttcgatctcgtgagcctcgccgggcacttcatcgaacacgaattggagctgcggagtcagacgcaggccagccttgtggcccaccagagaacgcaggtggcccttggcctgatcgagtgcctgctgggcgcgcttgcgttcgccttcctcgtggccttcgtggccgagctgggtccagtagaccttggcgatctgcaaatcgttggtcacacgaacttcggtgacggtgatgctggcgagtcgcttgtcatgcagttcgcgctcaatggaggaggcgacgacacgctgaatcaaggccgcaatacgtgcggcgcgcgggttggttcctgccataggaatttccttttctagacttgagccccctctgacgaggggctgccgaacgcagtgaggctggggagagaaaatcatggaactaccatgtctctcccccagtcagtctgcggctgacagccccctcgtcagagggggcttaacaatgactacttgcgctcgacttcccgcatctcgaaggtctcgatgatgtcgccgagttcaatgtcgttgaaggtgccgaggttgataccagcctcgtagccttccttgacggactgaacgtcgtccttgaagcgacgcagcgaggagatctcgaggtcgttgaccgtggccacgccgttgcgcaggatacggcacttcgtaccacgcttgacctcgccgtcctgcaccataacgccggcgatgttgccgaacttggaggagcggaagatctcgcggatctcggagtgagaggtgacgacctcttcgtattccggcttgagcatgcccttgagggatgcctcgatgtcttcgatcgcacggtagatgaccgagtagtacttgatctccacgccctcgcgctcggcgaggtccgcgacctgacggttcggacgcacgttgaaaccgatgataacggccttgtcgaccgtggccaggttgacatcattctgggtgatcgcaccgacgccgcggtggatgacctggatgccgacctcgtcggatacctcgatcttcatcaaggaatcctcgagcgcctcgacagaaccggacgaatcgcccttgatgacaatattgagcatgtcgatctcggactcggcgaacttcttcttgaagtcctcgagggagacgaccttgcgacgcttggccagctgggcggcacgctcggtggcctgacgcttctcggcaatctggcgagcggcacgatcatcggaggcgaccaggaagaggtcaccggcggtgggcacggaggtcaagcccagcacctgaacaggtgtggacggaccggccgcttccatcggctgaccgttctcgtcgagcatggcacgcacgcggccgtacgaagtgccggccacgatggcatcgcccacgtggagcgtaccctgctgaaccagcacagtggccacggcaccacgacccttgtcgagtcgggcttcgacggtggcaccacgggcgtccatgtcggggttggcgcggaggtccagctcagcgtcagccgtgagcagcacggcttcgagcagcttgtcgacgtgcaggttctgcttggcggagatgtcgacgaacatggtgtcgccaccatactcttcagggaccaagccgaactcggtgagctggccgcggaccttctccgggttggcaccgggcacatcgatcttgttgacggccacgacgatcggcaccttggcggcctgagcgtggttgatggcctcaacggtctggggcatcacaccatcgtcggcggcgaccacgaggatcgcgacgtcagtgagctcggcaccacgggcacgcatggcggtgaacgcctcgtggccaggggtatcgaggaaggtgatcttgcgcggttcgccttcaaggttcacggtgacctggtaggcaccgatgcgctgggtaatgccgccggcctcacgtgcgatgacgttggtcttgcggatggtatccagcagtcgtgtcttaccgtggtcgacgtggcccatgacggtaacgaccggcgggcgaggcttgagatcctcgtcatcctgcagttcttcctcgtcaaggttgatgtcgaactgctggagcagttccttgtcttcctcttctgcggagacgagctggatgttccagccgatctcttcgcccagaatctggaaggtctcctcatccaaggactgggtggcggtagccatctgacccaggtggaagagcacggtgaccagcgcggcctggttgacgttgatcttctccgcaagatcggccagggacgcgccctgacgcagacggatggtctggccgttgccgttggggatgcgaacgccgccgatggtcggtgctttcagctcctcatactcatggcgctttgccagacggttcttacgggcctttgaagacttgccgccctgacgtccgaatgcgcctgcggcaccgccgcgaccgccgcgaccgccgccacgtgcgggaccgttgctcggtgcaccgccgccctggaagttattgccgccgccttggcccccacggaagccgccgcgtgcgccgccctgaccggcaccctgggagccgccgccctgacccggacggttgtggccccactggccgggacgcggaccgccctgaccaccttggcccggacgaccgccacggaagccgcggccctgcccctggccttggccgggacggcccggacgaccgccacgaccgttatcagcagtcggacgagccatcggatgcggacgcggaatatcacccggcgtcggggtgtgcataccctgcttgcgggagaacgggttgttgcccgggcgcgggccctgagcgtgcgggcgcggaatcgcatttgaagcggcattgccgccattggcaccggcgccgccctgagcgtgcgggcgcggagccgaagcattgccgcggttgttctgatgctgaaccggctggccattgttcggacggccctggttgttacgacgatcgttgttacggcgatcgttcgggcgactctgacgaccgttctcacggccttcgcgattatcgcgaccattctcacggttgtcgttctgaccgtggcggccgggggtcggcatgccggggcgtgcgccgccctgcggacgcggtgtcggtgcacccggagtcggagcctgctgatgtgccgaggcaggcgatgcctgacgtgcgggagcggccggagtcggtgcggaagatgaagtggaagccggggccgaaggtgcggccgggcggcgctgctgcacgggcttggaatcgcccttggcgttgtccttggcgaactctgccttcagacgccgggctaccggcggttcaatcgtagaagaagcggacttgacgaattctcccatgtccttaagcttctcaagcacggttttgctatcgacattcaaaaccttagccagttcgtatacgcgtggtttcgccactaattactcctattctgtgaccacgcgcgtgcatgggcgtggtcagttggtgatgacggcaagcctaccctgtctcatcgtgcgaccatgatcgtgttacctcgtctctggtgtgggcgatttcgcgcacactgcgccagcccacatacgccaatcaagcatactcatagcgctggatagcgtagacgcagcgagccgcgccattgctgacgcggctcgtatcaggaaataatgcgccctgaagatcattcgccttcgagcccggcggcctattcggcttccggagcagcagcctcggccgcagcctgggcggccttttcggcggcgactttcttggcatgggcctcggcggattcgatgccgatcttccagccggtcagcttggctgccagtcgtgcgttctggccttccttgccgatggccaaggacagctggtcgtcgtggatgaaggcgatggcggtcttgttcttctcgctgatcacctgcacgccggtggccacagccggggacagcgcggctgccacgaacttggccggatcgtcggagtagtcgacgatgtcgatcttctccgggccaaggttctccataacggcacgcacgcgagcgccgccggggccgatcagcgcgcccttcgggttcacgccatcggtgttggccttgaccgcgatcttggtgcgggcgccggcctcacgagcgatggccatgatggacacggcaccggagaccagttccggcacttcgcgctcgaacagcttgcggaccagctccgggtgggagcgggacaccacgatttccgggcccttgatgccacgggccacgttcaccacgtacacgcggatgcgttcgccgtggcggtaacgttcgccgggcacctgctcacggcgaggcagaatggcttcgacatcgcccatcgcgacatgcacgttggaggggtcggaagcatcctgctggatgatgccggtgatgagcttgcccttctggccggagaacgcaccgaataccttctcatcttcggcgcggcggaacagctgggtgatgacctggcgtgcggtggctgcggcgagacggccgaagtcacgcggggtgtcatcgtattcctcgcccagcttgggaacggggtaagggttgtcttcggtgggttcgaccggaatttcgtcggcggcccacacggtgaagttgccggaacgttcgtcaagctccacgcgcgcgtgcttggcggcgtgcggggtcttgaggtaggcgaggcgcagggcctctgccagcgcatcatccagggtttcggggtcgattccttgctcggcggcgagcttgtgtattcctgtcaggtccagttccatcgatccgtacctcctatgaagttatgtggcgcatggcctatgagtagtcacagttagctattagtgtatgtttccatgcagacacgcttctcttcaggacggtttacccggcgcttggcatccgtactatgcgcgagcgcgatgctgtgttcgctttcggcgtgttcgatgccgcgactggccggacgggccgaggcggaagctcaaatgaccccttgcgagaaagcgatgacgttggcgaactacgccacccatccggctgaaggcacaccgttattagagcagtatgccaccggtctggccgccccctggcttggattgacgttgccgggtattgttcgggtcgttttgccgagggaacgttacgtgacgcgcagaccaagcaatggatggcttttctggccgataaattcgggcagtccgcgcctgaggtgacgccggcgcgtcttgatggcgtcacgtccgccaacgttgaccgatcggtattggatgcgatggccgtggccgaggatcgcgccggattcgctatcgaggtcttggccgcacgaggacagaccgctggggctacgttggcgttgagtgatatgcataagaccgccgggcagcagttggttgcgctggcgaacggcaattttgatgattccggcgcacaatccagttcttccggccaaagcgacccccgccaaaaggtctatgccatcgaccaactactggccaaccccaccaccatcgccgacaaggcaagtggccaaaccgtaccgaccgccgccgccatcgaaatggactgcgcccgcgcgcagatcaaggccgtgaccgaatcgaaatcttccaccgagagcgatatgctgctcatcctcgccgcactggccgccaagcacgcctacaccgcgttccaacttggctacccagcgactgacgccgaattgttcgagtagacacacactcctcacgaagccgatgcgaacttgttggatgctagtgggcaagtcgagttgaggcacgttccaccaatgtgaaatcggtggtgtacgtacgggccgggcctgagtatccttcgatgcggtcgataagcatgtcaacggcatgcttggcataatcatcgatatgaggatcgatggtggtcagcgccggcaccgagtactcggcttccggcacgttatcgaagccgaccacttgtacatcgtcaggtacatgcaaaccacatcgttgcaattcatgaattgcgcctaaagcaatggcatcattgagacacactacaacatccgggcatgggagcttgtctagcatagcttttgtcacgcgcataccttcacgctgattcatgctttctgccggaatcacataccgccaatttaccgataatccgcgctcttcaaatgccttcacatatccttgggcgcgtaacgcctgggtcccttccgtctgacgacgcagcactgcctcatccaccagttcaggaagaacacccatcagagcaaccgtttgggcaccttcatccaaaaatcttcctacaaccgtggagatggattcaatgttgggcatggtgatccaatcgcttttcccgtaggccagatggtctccggtcgttacaatcggatatggctgctccagaacggccccttcatccgcgagcggcgacattacgaacagaatccatccttccgtccctaaacgatagaactcgtcaacgctggcaaccaacccttcaccgtcggaaccatatgtgttgatgactacaccgtaatggcgttcttttgcgtattcaatgaccttgtcagtgaaaaaaggaacgaacggctgcgagaaatcgaagatgttgagtccaataagctttgtgccgccagatcgcattgcacgcgccgaaatattgacggtatatccaagcttacgcatcacctcttccacacggcgacgtgtatccggtctcatactgccagtgtcattcagcacattggaaaccgtcttgatggagacgttcgcctcacgcgccacgtccttgatagttacgcggtttcccattgttcgaatccatttctgcttattacatgacacaccttcaacagcgtcattatgttcttattatggtaagtcacagtcgggtcgagcatctcctcctcatatcggaatcatctacccctcaacctcagaattcagccaaggagctttcctccgttggaccccatgcaccattaggcaaatatccttctgacaatactgcaggacgatcgaacgtagaggttaaactttctggttgaagaaacgcacgcacgccatccgaacaagggactttctgaccgccggctttcaacctagctttttacatacccgtcttttctccttattcctttgttgggtatcgaattgttccagtcgatgtgaatgacggcattgtcttcctttgactggtatgccacattacattagtggcgaatccgaacctctctttctgcaatccgggcatgttgatgattgtttgggtattgcttggtggttgtacagggcacagcaaccataagagactgcgccctgtcatgcgccaccgtcactcgaatcacttcacgtgcacggcggtccaggagaccggcggcaaggtcacacgcacagtgccggtatcggcgtcggacgtgatggtggtgttggggtgcagaacgactcggttctggtcttccagcgtgttttttgccagcagatcatcctcgtgcagggtttgcgcctcgaccgcggaaagtgcgaatccttccggcagcttgatggcaaagtcattggccgcttccatggagcgattgaccacaaacacgctgatcgtaccgtcctcaccacgcacggctacggaattgatcgtcggcacttcaccgtatttgtcggtttcatacgttccggaagccagtttcggttcaagcaccgtgccgcccttggcgagctttgcggtcagcgagaacggatagaacgtggtctgacgccacgccgggccgcccggttcggtcataatcggcgcaattacgttgaccaactgggccaggctggcggcgtgcacgcggtcggcgttcttgagcagggtaatcatcaaatcaccgaacaccacggcgtcggcggcgctgtacacatcctcgagcaggcgcggggcaaccggccaattgccgatgccttccggattcttgctcggctcttcgttgagataccagacattccattcatcgaacgagatgaacacgtcgtgcttgctcttcagccgggccttggttgcatcgatggcggcggcgacatcgttgatgaaaccgtccatatcgacgcccgaggcaaggaagctcttcatgtcacgggtgccatcaggctgaagttccggatggtagtacgcatggcaggagacgaagttgacgttgtcaaacgtcttctcaagtacggtttcttcccacttgccgaaggtgtccatcacgtggctggatgaaccacagaccaccagttcaacgttcggatcgatggcgcgcatacctgccgccaccgaggccgccaaggtgccgtaatcctcggcggacttgtgaccggtctgccacgggccatccatctcattgcccaagcaccacatcttgatgccgaacggctgatcggcaccattggcgcgacgctcctcggagagcttggtgccgccgggaatattcgcgtattccaacaggtcgagggcctcttcaagaccacgggtacccagatttacggcttccatcagctcgttgccgccggttttttccagccatttcgccatttcgtgcagaccaaactgattggtctcggtggaatgccatgccaagtccaggcgacgcggccgctcatcacgaggaccaacgccatcctcccagcgatagccggaaacgaaattgccgccaggatagcgaatcgtggtagcgccgagttccttgaccagttcgatgacgtccttgcggaaaccgtcttcatcggcttcggggtggcccggctcatagatgccgtcgtatacgcagcgacccagatgctccacgaacgacccgaacagtctgtcgttgaccggagctacttcaaagtcattatcgacgacgagtcgagattcctccagctcccccggtttattgtcgtgcgaatgctcggacatgtgctctcctttaatcgttgtcttcaataccgcaagacaacgttgtgctaaataccaaaagcaatcggcccatcttcttggttcacctgttttgcggcatcgccaatcagcggtgaatgtgcgttctggatatttaatacaaccttgtacttctgttgatatcgataatacgatggttgtacttagtacgcaagtcccgctgagtacaacgttatccttttcgctattttccacccgacacgccgtatacgatacagcacaggagcgaatacggacgttcgtatcaaaaacaaaaagggttccgggacaaacccggaaccctaaaggcggataaggcgagattcgaactcgcggaggctttcacctcacacgctttcgaggcgtgctccttagaccgctcggacacttatccatgctgccaaaatggcaacttgttcattatgccacattctgccgacctggcaaatcggagtttcgctgagctcgattcggcgtgggataatgcgattttgtgtgagattgcaatgggtcagacgatgagccgattaacagtccgaattgatcaactaccaaaatccgaatgttgcaacgacgaaaatccgaatattggtggtggtagaagcggtgacggggccactctgcattgagtggtctctccctcggtcagccttacggctgacagctcgaacgcaattaaggacagctttccagctgccattttatttgctcactgtcgttcgccttcgcctaaaaacgcctccggcgttttcttcacggctcagctcatcagagggggcttggaattttatttatgccacctgttcgtggacggaggcgttgacccattgggactgctggacgttgtatccagagaagatgccgatgtcgagcatgcagtcgcggtaatcgcggccgtgggcgatggtgatgtagctgtcgtccaccaatcggttatgcgtgggatccagtccgacccatcggccatcctgatacacctcgacccaagcatgggtcgcgccctctccccaagcaaaccggcaatgtagcgcgcggtcaatccacatgccggcacacggacagcatcacgtgcgcataatcctggcatacgcccttgcgctgagccaaggcctgttcggcggtggtgcgaatcgtggtggaaccgggcgtatacacaaacgccttgtagacctcatccatcacttcggcagcctgctgcaccggagtggcgtcggaaggcagcgccgccaagcgttcgcggcatacggcaatcatcgcctccacgttcgggccgggaatggtgagcgctgaattgaatcggtacagcggttataggcttccttatggatatgcgcattgtcccgaaggcgataccggtcaccgagtagctgaatatgtcgtgcggctcagggatgaatccggtcataccacggagtcaaaggagtcgatggtggtttcgagttcggtttcgggctgaatcttcactccacgtcaatcacctgttggcgagggccagtggagggaatacagcgaagctggaacctgtgatcggtgaccggtgcgctgaaggacagcctcatctcatagtcgaacacgagttttttcacaacgtctcctgcacttgcacacgagccggcaaccggcatattctcgggataacgacactacagccatggctgaggtatggtccgtgcgctcacagcccacgcatatattccggcaatctgctgatatgcacaggccggcactcggggcacggttttttcgccataccaccatagcatttgaaccgtcagggtgtcaggtcgggatcagggacgcttggcgtccatgttcatggagctcagtgagcccatgtctttgatggccagcgcgctgacacggccggagtagtcgtcaaggtacttcttcagcaggtcggcgacttcctgatatccgcgagacggcagctgaccgaccagccagctcagtccgtcggcgaagcagctgggcagcggcatgccgtccaaggtcatcgaataggcggcgagcttcttgagcggcgcttccagatctccatcgtcagg
